US010323076B2

(12) United States Patent
Ellsworth et al.

(10) Patent No.: US 10,323,076 B2
(45) Date of Patent: Jun. 18, 2019

(54) POLYNUCLEOTIDES ENCODING LOW DENSITY LIPOPROTEIN RECEPTOR

(71) Applicant: ModernaTX, Inc., Cambridge, MA (US)

(72) Inventors: Jeff Lynn Ellsworth, Lexington, MA (US); Joseph Beene Bolen, Boston, MA (US); Francine M. Gregoire, Newton, MA (US); Justin Guild, Framingham, MA (US)

(73) Assignee: ModernaTX, Inc., Cambridge, MA (US)

( * ) Notice: Subject to any disclaimer, the term of this patent is extended or adjusted under 35 U.S.C. 154(b) by 0 days.

(21) Appl. No.: 15/026,945

(22) PCT Filed: Oct. 3, 2014

(86) PCT No.: PCT/US2014/058967
§ 371 (c)(1),
(2) Date: Apr. 1, 2016

(87) PCT Pub. No.: WO2015/051214
PCT Pub. Date: Apr. 9, 2015

(65) Prior Publication Data
US 2016/0244501 A1 Aug. 25, 2016

Related U.S. Application Data

(60) Provisional application No. 62/052,139, filed on Sep. 18, 2014, provisional application No. 61/952,906, filed on Mar. 14, 2014, provisional application No. 61/903,485, filed on Nov. 13, 2013, provisional application No. 61/886,137, filed on Oct. 3, 2013.

(51) Int. Cl.
*C07K 14/705* (2006.01)
*A61K 38/00* (2006.01)

(52) U.S. Cl.
CPC ............ *C07K 14/705* (2013.01); *A61K 38/00* (2013.01)

(58) Field of Classification Search
CPC .......................... C07K 14/705; A61K 38/00
See application file for complete search history.

(56) References Cited

U.S. PATENT DOCUMENTS

| 2,008,526 A | 7/1935 | Wrappler et al. |
| 3,552,394 A | 1/1971 | Horn et al. |
| 3,737,524 A | 6/1973 | Ebel et al. |
| 3,766,907 A | 10/1973 | Muenzer |
| 3,872,171 A | 3/1975 | Cronin et al. |
| 3,906,092 A | 9/1975 | Hilleman et al. |
| 4,373,071 A | 2/1983 | Itakura |
| 4,399,216 A | 8/1983 | Axel et al. |
| 4,401,796 A | 8/1983 | Itakura |
| 4,411,657 A | 10/1983 | Galindo |
| 4,415,732 A | 11/1983 | Caruthers et al. |
| 4,458,066 A | 7/1984 | Caruthers et al. |
| 4,474,569 A | 10/1984 | Newkirk |
| 4,500,707 A | 2/1985 | Caruthers et al. |
| 4,579,849 A | 4/1986 | MacCoss et al. |
| 4,588,585 A | 5/1986 | Mark et al. |
| 4,668,777 A | 5/1987 | Caruthers et al. |
| 4,737,462 A | 4/1988 | Mark et al. |
| 4,816,567 A | 3/1989 | Cabilly et al. |
| 4,879,111 A | 11/1989 | Chong |
| 4,957,735 A | 9/1990 | Huang |
| 4,959,314 A | 9/1990 | Mark et al. |
| 4,973,679 A | 11/1990 | Caruthers et al. |
| 5,012,818 A | 5/1991 | Joishy |
| 5,017,691 A | 5/1991 | Lee et al. |
| 5,021,335 A | 6/1991 | Tecott et al. |
| 5,036,006 A | 7/1991 | Sanford et al. |
| 5,047,524 A | 9/1991 | Andrus et al. |
| 5,116,943 A | 5/1992 | Koths et al. |
| 5,130,238 A | 7/1992 | Malek et al. |
| 5,132,418 A | 7/1992 | Caruthers et al. |
| 5,153,319 A | 10/1992 | Caruthers et al. |
| 5,168,038 A | 12/1992 | Tecott et al. |
| 5,169,766 A | 12/1992 | Schuster et al. |
| 5,194,370 A | 3/1993 | Berninger et al. |
| 5,199,441 A | 4/1993 | Hogle |
| 5,240,855 A | 8/1993 | Tomes |
| 5,240,885 A | 8/1993 | Tomes |
| 5,262,530 A | 11/1993 | Andrus et al. |
| 5,273,525 A | 12/1993 | Hofman |
| 5,298,422 A | 3/1994 | Schwartz et al. |
| 5,332,671 A | 7/1994 | Ferrara et al. |

(Continued)

FOREIGN PATENT DOCUMENTS

| AU | 652831 B2 | 9/1994 |
| CA | 2376634 A1 | 12/2000 |

(Continued)

OTHER PUBLICATIONS

US 2002/0198163 A1, 12/2002, Felgner et al. (withdrawn)
Jeon et al.; Structure and Physiologic Function of the Low-Density Lipoprotein Receptor; Annu. Rev. Biochem (2005) 74:535-62.*
Abifadel, M., et al., "The Molecular Basis of Familial Hypercholesterolemia in Lebanon: Spectrum of Ldlr Mutations and Role of PCSK9 as a Modifier Gene," Human Mutation 30(7):E682-E691, Wiley-Liss, United States (2009).
Akinc, A., et al., "Targeted Delivery of RNAi Therapeutics with Endogenous and Exogenous Ligand-Based Mechanisms," Molecular Therapy : The Journal of the American Society of Gene Therapy 18(7):1357-1364, Academic Press, United States (2010).

(Continued)

*Primary Examiner* — Antonio Galisteo Gonzalez
(74) *Attorney, Agent, or Firm* — Cooley LLP; Carol D. Laherty; William T. Christiansen, II

(57) ABSTRACT

The invention relates to compositions and methods for the preparation, manufacture and therapeutic use of polynucleotide molecules encoding low density lipoprotein receptor comprising at least one mutation (e.g., an LDLR signally enhancing mutation).

13 Claims, 25 Drawing Sheets

Specification includes a Sequence Listing.

(56) References Cited

U.S. PATENT DOCUMENTS

| | | |
|---|---|---|
| 5,399,491 A | 3/1995 | Kacian et al. |
| 5,409,818 A | 4/1995 | Davey et al. |
| 5,426,180 A | 6/1995 | Kool |
| 5,437,990 A | 8/1995 | Burg et al. |
| 5,457,041 A | 10/1995 | Ginaven et al. |
| 5,466,586 A | 11/1995 | Davey et al. |
| 5,484,401 A | 1/1996 | Rodriguez et al. |
| 5,514,545 A | 5/1996 | Eberwine |
| 5,527,288 A | 6/1996 | Gross et al. |
| 5,545,522 A | 8/1996 | Van Gelder et al. |
| 5,554,517 A | 9/1996 | Davey et al. |
| 5,580,859 A | 12/1996 | Felgner et al. |
| 5,588,960 A | 12/1996 | Edwards et al. |
| 5,589,466 A | 12/1996 | Felgner et al. |
| 5,663,153 A | 9/1997 | Hutherson et al. |
| 5,665,545 A | 9/1997 | Malek et al. |
| 5,672,491 A | 9/1997 | Khosla et al. |
| 5,674,267 A | 10/1997 | Mir et al. |
| 5,677,124 A | 10/1997 | DuBois et al. |
| 5,679,512 A | 10/1997 | Laney et al. |
| 5,693,622 A | 12/1997 | Wolff et al. |
| 5,693,761 A | 12/1997 | Queen et al. |
| 5,697,901 A | 12/1997 | Ericksson |
| 5,700,642 A | 12/1997 | Monforte et al. |
| 5,702,384 A | 12/1997 | Umeyama et al. |
| 5,703,055 A | 12/1997 | Felgner et al. |
| 5,712,127 A | 1/1998 | Malek et al. |
| 5,716,785 A | 2/1998 | Van Gelder et al. |
| 5,736,137 A | 4/1998 | Anderson et al. |
| 5,756,264 A | 5/1998 | Schwartz et al. |
| 5,759,179 A | 6/1998 | Balbierz |
| 5,766,903 A | 6/1998 | Sarnow et al. |
| 5,773,244 A | 6/1998 | Ares, Jr. et al. |
| 5,776,456 A | 7/1998 | Anderson et al. |
| 5,789,554 A | 8/1998 | Leung et al. |
| 5,807,707 A | 9/1998 | Andrews et al. |
| 5,807,861 A | 9/1998 | Klein et al. |
| 5,824,307 A | 10/1998 | Johnson |
| 5,824,497 A | 10/1998 | Andrews et al. |
| 5,840,299 A | 11/1998 | Bendig et al. |
| 5,843,439 A | 12/1998 | Anderson et al. |
| 5,848,996 A | 12/1998 | Eldor |
| 5,849,546 A | 12/1998 | Sousa et al. |
| 5,851,829 A | 12/1998 | Marasco et al. |
| 5,861,501 A | 1/1999 | Benseler et al. |
| 5,869,230 A | 2/1999 | Sukhatme |
| 5,889,136 A | 3/1999 | Scaringe et al. |
| 5,891,636 A | 4/1999 | Van Gelder et al. |
| 5,914,269 A | 6/1999 | Bennett et al. |
| 5,955,310 A | 9/1999 | Widner et al. |
| 5,958,688 A | 9/1999 | Eberwine et al. |
| 5,962,271 A | 10/1999 | Chenchik et al. |
| 5,962,272 A | 10/1999 | Chenchik et al. |
| 5,965,720 A | 10/1999 | Gryaznov et al. |
| 5,965,726 A | 10/1999 | Pavlakis et al. |
| 5,972,900 A | 10/1999 | Ferkol, Jr. et al. |
| 5,980,887 A | 11/1999 | Isner et al. |
| 5,989,911 A | 11/1999 | Fournier et al. |
| 5,994,511 A | 11/1999 | Lowman et al. |
| 6,004,573 A | 12/1999 | Rathi et al. |
| 6,019,747 A | 2/2000 | McPhee |
| 6,022,715 A | 2/2000 | Merenkova et al. |
| 6,057,494 A | 5/2000 | Koops et al. |
| 6,063,603 A | 5/2000 | Davey et al. |
| 6,074,642 A | 6/2000 | Wang et al. |
| 6,090,382 A | 7/2000 | Salfeld et al. |
| 6,090,591 A | 7/2000 | Burg et al. |
| 6,096,503 A | 8/2000 | Sutcliffe et al. |
| 6,100,024 A | 8/2000 | Hudson et al. |
| 6,124,091 A | 9/2000 | Petryshyn |
| 6,132,419 A | 10/2000 | Hofmann |
| 6,147,055 A | 11/2000 | Hobart et al. |
| 6,177,274 B1 | 1/2001 | Park et al. |
| 6,187,287 B1 | 2/2001 | Leung et al. |
| 6,190,315 B1 | 2/2001 | Kost et al. |
| 6,210,931 B1 | 4/2001 | Feldstein |
| 6,214,804 B1 | 4/2001 | Feigner et al. |
| 6,217,912 B1 | 4/2001 | Park et al. |
| 6,228,640 B1 | 5/2001 | Cezayirli et al. |
| 6,234,990 B1 | 5/2001 | Rowe et al. |
| 6,235,883 B1 | 5/2001 | Jakobovits et al. |
| 6,239,116 B1 | 5/2001 | Krieg et al. |
| 6,251,665 B1 | 6/2001 | Cezayirli et al. |
| 6,255,076 B1 | 7/2001 | Widner et al. |
| 6,258,558 B1 | 7/2001 | Szostak et al. |
| 6,261,584 B1 | 7/2001 | Peery et al. |
| 6,265,387 B1 | 7/2001 | Wolff et al. |
| 6,265,389 B1 | 7/2001 | Burke |
| 6,267,987 B1 | 7/2001 | Park et al. |
| 6,291,170 B1 | 9/2001 | Van Gelder et al. |
| 6,300,484 B1 | 10/2001 | Duhl |
| 6,303,378 B1 | 10/2001 | Bridenbaugh et al. |
| 6,303,573 B1 | 10/2001 | Ruoslahti et al. |
| 6,322,967 B1 | 11/2001 | Parkin |
| 6,326,174 B1 | 12/2001 | Joyce et al. |
| 6,334,856 B1 | 1/2002 | Allen et al. |
| 6,355,245 B1 | 3/2002 | Evans et al. |
| 6,368,801 B1 | 4/2002 | Faruqi |
| 6,376,248 B1 | 4/2002 | Hawley-Nelson et al. |
| 6,395,253 B2 | 5/2002 | Levy et al. |
| 6,399,061 B1 | 6/2002 | Anderson et al. |
| 6,406,705 B1 | 6/2002 | Davis et al. |
| 6,410,276 B1 | 6/2002 | Burg et al. |
| 6,413,942 B1 | 7/2002 | Felgner et al. |
| 6,433,155 B1 | 8/2002 | Umansky et al. |
| 6,440,096 B1 | 8/2002 | Lastovich et al. |
| 6,455,043 B1 | 9/2002 | Grillo-Lopez et al. |
| 6,491,657 B2 | 12/2002 | Rowe et al. |
| 6,500,419 B1 | 12/2002 | Hone et al. |
| 6,500,919 B1 | 12/2002 | Adema et al. |
| 6,514,948 B1 | 2/2003 | Raz et al. |
| 6,517,869 B1 | 2/2003 | Park et al. |
| 6,520,949 B2 | 2/2003 | St. Germain |
| 6,525,183 B2 | 2/2003 | Vinayak et al. |
| 6,541,498 B2 | 2/2003 | Antonsson et al. |
| 6,527,216 B2 | 3/2003 | Eagleman et al. |
| 6,528,262 B1 | 3/2003 | Gilad et al. |
| 6,534,312 B1 | 3/2003 | Shiver et al. |
| 6,552,006 B2 | 4/2003 | Raz et al. |
| 6,555,525 B2 | 4/2003 | Burke |
| 6,565,572 B2 | 5/2003 | Chappuis |
| 6,572,857 B1 | 6/2003 | Casimiro et al. |
| 6,586,524 B2 | 7/2003 | Sagara |
| 6,589,940 B1 | 7/2003 | Raz et al. |
| 6,610,044 B2 | 8/2003 | Mathiesen |
| 6,610,661 B1 | 8/2003 | Carson et al. |
| 6,613,026 B1 | 9/2003 | Palasis et al. |
| 6,617,106 B1 | 9/2003 | Benner |
| 6,623,457 B1 | 9/2003 | Rosenberg |
| 6,652,886 B2 | 11/2003 | Ahn et al. |
| 6,653,468 B1 | 11/2003 | Guzaev et al. |
| 6,664,066 B2 | 12/2003 | Parks |
| 6,670,178 B1 | 12/2003 | Selden et al. |
| 6,676,938 B1 | 1/2004 | Teti et al. |
| 6,696,038 B1 | 2/2004 | Mahato et al. |
| 6,743,211 B1 | 6/2004 | Prausnitz et al. |
| 6,743,823 B1 | 6/2004 | Summar et al. |
| 6,777,187 B2 | 8/2004 | Makarov et al. |
| 6,808,888 B2 | 10/2004 | Zhang et al. |
| 6,818,421 B2 | 11/2004 | Kossmann et al. |
| 6,835,393 B2 | 12/2004 | Hoffman et al. |
| 6,835,827 B2 | 12/2004 | Vinayak et al. |
| 6,890,319 B1 | 5/2005 | Crocker |
| 6,896,885 B2 | 5/2005 | Hanna |
| 6,900,302 B2 | 5/2005 | Teti et al. |
| 6,902,734 B2 | 6/2005 | Giles-Komar et al. |
| 6,924,365 B1 | 8/2005 | Miller et al. |
| 6,949,245 B1 | 9/2005 | Sliwkowski |
| 6,960,193 B2 | 11/2005 | Rosenberg |
| 6,962,694 B1 | 11/2005 | Soegaard et al. |
| 7,001,890 B1 | 2/2006 | Wagner et al. |
| 7,052,891 B2 | 5/2006 | Leung et al. |
| 7,074,596 B2 | 7/2006 | Darzynkiewicz et al. |
| 7,125,554 B2 | 10/2006 | Forsberg et al. |

(56) References Cited

U.S. PATENT DOCUMENTS

| | | |
|---|---|---|
| 7,135,010 B2 | 11/2006 | Buckman et al. |
| 7,195,761 B2 | 3/2007 | Holtzman et al. |
| 7,198,899 B2 | 4/2007 | Schleyer et al. |
| 7,202,226 B2 | 4/2007 | Murray et al. |
| 7,208,478 B2 | 4/2007 | Carson et al. |
| 7,226,439 B2 | 6/2007 | Prausnitz et al. |
| 7,226,595 B2 | 6/2007 | Antonsson et al. |
| 7,268,120 B1 | 9/2007 | Horton et al. |
| 7,276,489 B2 | 10/2007 | Agrawal et al. |
| 7,316,925 B2 | 1/2008 | Draghia-Akli et al. |
| 7,320,961 B2 | 1/2008 | Kempf et al. |
| 7,329,741 B2 | 2/2008 | Duhl |
| 7,335,471 B2 | 2/2008 | Guillerez et al. |
| 7,348,004 B2 | 3/2008 | Peters et al. |
| 7,354,742 B2 | 4/2008 | Kamme et al. |
| 7,371,404 B2 | 5/2008 | Panzner et al. |
| 7,374,778 B2 | 5/2008 | Hoffman et al. |
| 7,374,930 B2 | 5/2008 | Oh et al. |
| 7,378,262 B2 | 5/2008 | Sobek et al. |
| 7,384,739 B2 | 6/2008 | Kitabayashi et al. |
| 7,404,956 B2 | 7/2008 | Peters et al. |
| 7,422,739 B2 | 9/2008 | Anderson et al. |
| 7,476,506 B2 | 1/2009 | Schleyer et al. |
| 7,476,709 B2 | 1/2009 | Moody et al. |
| 7,479,543 B2 | 1/2009 | Tsuchiya |
| 7,498,414 B2 | 3/2009 | Zhu |
| 7,501,486 B2 | 3/2009 | Zhang et al. |
| 7,521,054 B2 | 4/2009 | Pastan et al. |
| 7,547,678 B2 | 6/2009 | Kempf et al. |
| 7,550,264 B2 | 6/2009 | Getts et al. |
| 7,575,572 B2 | 8/2009 | Sweeney |
| 7,579,318 B2 | 8/2009 | Divita et al. |
| 7,615,225 B2 | 11/2009 | Forsberg et al. |
| 7,629,311 B2 | 12/2009 | Tobinick |
| 7,641,901 B2 | 1/2010 | Goldenberg et al. |
| 7,667,033 B2 | 2/2010 | Alvarado |
| 7,682,612 B1 | 3/2010 | White et al. |
| 7,699,852 B2 | 4/2010 | Frankel et al. |
| 7,708,994 B2 | 5/2010 | Benyunes |
| 7,709,452 B2 | 5/2010 | Pitard |
| 7,718,425 B2 | 5/2010 | Reinke et al. |
| 7,737,108 B1 | 6/2010 | Hoffman et al. |
| 7,745,391 B2 | 6/2010 | Mintz et al. |
| 7,763,253 B2 | 7/2010 | Hedlund et al. |
| 7,776,523 B2 | 8/2010 | Garcia et al. |
| 7,794,719 B2 | 9/2010 | Bardroff et al. |
| 7,799,900 B2 | 9/2010 | Adams et al. |
| 7,829,092 B2 | 9/2010 | Lobb et al. |
| 7,820,161 B1 | 10/2010 | Curd et al. |
| 7,820,624 B2 | 10/2010 | Hart et al. |
| 7,846,895 B2 | 12/2010 | Eckert et al. |
| 7,884,184 B2 | 2/2011 | Degroot et al. |
| 7,906,490 B2 | 3/2011 | Kool |
| 7,862,820 B2 | 4/2011 | Peters et al. |
| 7,943,168 B2 | 5/2011 | Schlesinger et al. |
| 7,943,581 B2 | 5/2011 | Divita et al. |
| 7,964,571 B2 | 6/2011 | Fewell et al. |
| 7,999,087 B2 | 8/2011 | Dellinger et al. |
| 8,003,129 B2 | 8/2011 | Hoffman et al. |
| 8,008,449 B2 | 8/2011 | Korman et al. |
| 8,039,214 B2 | 10/2011 | Dahl et al. |
| 8,048,999 B2 | 11/2011 | Yamanaka et al. |
| 8,057,821 B2 | 11/2011 | Slobodkin et al. |
| 8,058,069 B2 | 11/2011 | Yaworski et al. |
| 8,101,385 B2 | 1/2012 | Cload et al. |
| 8,105,596 B2 | 1/2012 | Goldenberg et al. |
| 8,108,385 B2 | 1/2012 | Kraft et al. |
| 8,137,911 B2 | 3/2012 | Dahl et al. |
| 8,153,768 B2 | 4/2012 | Kunz et al. |
| 8,158,360 B2 | 4/2012 | Heise et al. |
| 8,158,601 B2 | 4/2012 | Chen et al. |
| 8,178,660 B2 | 5/2012 | Weiner et al. |
| 8,183,345 B2 | 5/2012 | Fay et al. |
| 8,183,352 B2 | 5/2012 | Ayyavoo et al. |
| 8,202,983 B2 | 6/2012 | Dellinger et al. |
| 8,217,016 B2 | 7/2012 | Hoerr et al. |
| 8,226,950 B2 | 7/2012 | Lobb et al. |
| 8,242,081 B2 | 8/2012 | Divita et al. |
| 8,242,087 B2 | 8/2012 | Adelfinskaya et al. |
| 8,242,258 B2 | 8/2012 | Dellinger et al. |
| 8,246,958 B2 | 8/2012 | Bendig et al. |
| 8,278,036 B2 | 10/2012 | Kariko et al. |
| 8,304,183 B2 | 11/2012 | Sooknanan |
| 8,304,532 B2 | 11/2012 | Adamo et al. |
| 8,309,706 B2 | 11/2012 | Dellinger et al. |
| 8,329,172 B2 | 12/2012 | Grillo-Lopez et al. |
| 8,329,182 B2 | 12/2012 | Peters et al. |
| 8,329,887 B2 | 12/2012 | Dahl et al. |
| 8,333,799 B2 | 12/2012 | Bales, Jr. et al. |
| 8,344,153 B2 | 1/2013 | Cottrell et al. |
| 8,349,321 B2 | 1/2013 | Burke et al. |
| 8,367,328 B2 | 2/2013 | Asada et al. |
| 8,367,631 B2 | 2/2013 | Pitard |
| 8,383,340 B2 | 2/2013 | Ketterer et al. |
| 8,394,763 B2 | 3/2013 | Forte et al. |
| 8,399,007 B2 | 3/2013 | Taft et al. |
| 8,404,222 B2 | 3/2013 | Harris |
| 8,404,799 B2 | 3/2013 | Podobinski et al. |
| 8,414,927 B2 | 4/2013 | Richard |
| 8,415,325 B2 | 4/2013 | Kiick et al. |
| 8,420,123 B2 | 4/2013 | Troiano et al. |
| 8,420,605 B2 | 4/2013 | Ulijn et al. |
| 8,431,160 B2 | 4/2013 | O'Hagan et al. |
| 8,435,504 B2 | 5/2013 | Kozlowski et al. |
| 8,440,231 B2 | 5/2013 | Smyth et al. |
| 8,440,614 B2 | 5/2013 | Castor |
| 8,444,992 B2 | 5/2013 | Borkowski |
| 8,449,884 B2 | 5/2013 | Rivera et al. |
| 8,449,916 B1 | 5/2013 | Bellaire et al. |
| 8,450,298 B2 | 5/2013 | Mahon et al. |
| 8,454,946 B2 | 6/2013 | Shen et al. |
| 8,454,948 B2 | 6/2013 | Pearlman et al. |
| 8,460,696 B2 | 6/2013 | Slobodkin et al. |
| 8,460,709 B2 | 6/2013 | Ausborn et al. |
| 8,461,132 B2 | 6/2013 | Cohen et al. |
| 8,466,122 B2 | 6/2013 | Heyes et al. |
| 8,470,560 B2 | 6/2013 | Bergmann-Leitner et al. |
| 8,470,771 B2 | 6/2013 | Gao et al. |
| 8,476,234 B2 | 7/2013 | Fima et al. |
| 8,496,945 B2 | 7/2013 | Schlesinger et al. |
| 8,506,928 B2 | 8/2013 | Ferrara et al. |
| 8,506,966 B2 | 8/2013 | Podda et al. |
| 8,512,964 B2 | 8/2013 | Tontonoz et al. |
| 8,518,871 B2 | 8/2013 | Hsu et al. |
| 8,519,110 B2 | 8/2013 | Kowalska et al. |
| 8,529,538 B2 | 9/2013 | Pang et al. |
| 8,529,939 B2 | 9/2013 | Masters et al. |
| 8,530,429 B2 | 9/2013 | Robbins et al. |
| 8,530,625 B2 | 9/2013 | Kaplan et al. |
| 8,535,655 B2 | 9/2013 | O'Shea et al. |
| 8,535,701 B2 | 9/2013 | Peery et al. |
| 8,535,702 B2 | 9/2013 | Richard et al. |
| 8,545,843 B2 | 10/2013 | Curd et al. |
| 8,557,231 B2 | 10/2013 | Langer et al. |
| 8,557,244 B1 | 10/2013 | White et al. |
| 8,562,992 B2 | 10/2013 | Adams et al. |
| 8,563,041 B2 | 10/2013 | Grayson et al. |
| 8,568,784 B2 | 10/2013 | Lillard et al. |
| 8,569,256 B2 | 10/2013 | Heyes et al. |
| 8,580,297 B2 | 11/2013 | Essler et al. |
| 8,603,499 B2 | 12/2013 | Zale et al. |
| 8,603,500 B2 | 12/2013 | Zale et al. |
| 8,603,501 B2 | 12/2013 | Zale et al. |
| 8,603,534 B2 | 12/2013 | Zale et al. |
| 8,603,535 B2 | 12/2013 | Troiano et al. |
| 8,609,142 B2 | 12/2013 | Troiano et al. |
| 8,609,329 B2 | 12/2013 | Barroso et al. |
| 8,609,822 B2 | 12/2013 | Elson |
| 8,613,951 B2 | 12/2013 | Zale et al. |
| 8,613,954 B2 | 12/2013 | Zale et al. |
| 8,617,608 B2 | 12/2013 | Zale et al. |
| 8,618,240 B2 | 12/2013 | Podobinski et al. |
| 8,623,367 B2 | 1/2014 | Momm et al. |
| 8,628,801 B2 | 1/2014 | Garreta et al. |

(56) References Cited

U.S. PATENT DOCUMENTS

| | | |
|---|---|---|
| 8,636,696 B2 | 1/2014 | Ross et al. |
| 8,636,994 B2 | 1/2014 | Bossard et al. |
| 8,637,028 B2 | 1/2014 | Alexis et al. |
| 8,637,083 B2 | 1/2014 | Troiano et al. |
| 8,642,076 B2 | 2/2014 | Manoharan et al. |
| 8,652,487 B2 | 2/2014 | Maldonado |
| 8,652,528 B2 | 2/2014 | Troiano et al. |
| 8,658,211 B2 | 2/2014 | Rozema et al. |
| 8,658,733 B2 | 2/2014 | Jorgedal et al. |
| 8,663,599 B1 | 3/2014 | Sung et al. |
| 8,663,692 B1 | 3/2014 | Muller et al. |
| 8,663,700 B2 | 3/2014 | Troiano et al. |
| 8,668,926 B1 | 3/2014 | Mousa et al. |
| 8,669,049 B1 | 3/2014 | Mata et al. |
| 8,685,368 B2 | 4/2014 | Reineke |
| 8,685,458 B2 | 4/2014 | Miller et al. |
| 8,691,223 B2 | 4/2014 | Van Den Brink et al. |
| 8,691,750 B2 | 4/2014 | Constein et al. |
| 8,691,785 B2 | 4/2014 | Teng et al. |
| 8,691,963 B2 | 4/2014 | Brahmbhatt et al. |
| 8,691,966 B2 | 4/2014 | Kariko et al. |
| 8,696,637 B2 | 4/2014 | Ross |
| 8,697,098 B2 | 4/2014 | Perumal et al. |
| 8,703,204 B2 | 4/2014 | Bloom et al. |
| 8,709,483 B2 | 4/2014 | Farokhzad et al. |
| 8,715,677 B2 | 5/2014 | Bartlett et al. |
| 8,715,689 B2 | 5/2014 | Kinney et al. |
| 8,715,694 B2 | 5/2014 | Apt et al. |
| 8,715,736 B2 | 5/2014 | Sachdeva et al. |
| 8,715,741 B2 | 5/2014 | Maitra et al. |
| 8,722,341 B2 | 5/2014 | Fouchier et al. |
| 8,728,491 B2 | 5/2014 | Sesardic et al. |
| 8,728,527 B2 | 5/2014 | Singh |
| 8,728,772 B2 | 5/2014 | Suzuki et al. |
| 8,734,832 B2 | 5/2014 | O'Hagan et al. |
| 8,734,846 B2 | 5/2014 | Ali et al. |
| 8,734,853 B2 | 5/2014 | Sood et al. |
| 8,735,566 B2 | 5/2014 | Brahmbhatt et al. |
| 8,735,570 B2 | 5/2014 | Miller et al. |
| 8,748,089 B2 | 6/2014 | Kariko et al. |
| 8,802,644 B2 | 8/2014 | Chen et al. |
| 8,835,108 B2 | 9/2014 | Kariko et al. |
| 8,980,864 B2 | 3/2015 | Hoge et al. |
| 9,006,487 B2 | 4/2015 | Anderson et al. |
| 9,029,590 B2 | 5/2015 | Colletti et al. |
| 9,289,398 B2 | 3/2016 | Almstead et al. |
| 9,394,234 B2 | 7/2016 | Chen et al. |
| 9,867,888 B2 | 1/2018 | Benenato |
| 9,868,691 B2 | 1/2018 | Benenato et al. |
| 9,868,692 B2 | 1/2018 | Benenato |
| 9,868,693 B2 | 1/2018 | Benenato |
| 2001/0001066 A1 | 5/2001 | Cezayirli et al. |
| 2001/0005506 A1 | 6/2001 | Cezayirli et al. |
| 2001/0014753 A1 | 8/2001 | Soloveichik et al. |
| 2002/0001842 A1 | 1/2002 | Chapman et al. |
| 2002/0064517 A1 | 5/2002 | Cederholm-Williams |
| 2002/0111471 A1 | 8/2002 | Lo et al. |
| 2002/0123099 A1 | 9/2002 | Weiner et al. |
| 2002/0123723 A1 | 9/2002 | Sorenson et al. |
| 2002/0127592 A1 | 9/2002 | Ichihara et al. |
| 2002/0130430 A1 | 9/2002 | Castor |
| 2002/0132788 A1 | 9/2002 | Lewis et al. |
| 2002/0143204 A1 | 10/2002 | Evain et al. |
| 2003/0026841 A1 | 2/2003 | Trubetskoy et al. |
| 2003/0032615 A1 | 2/2003 | Felgner et al. |
| 2003/0050468 A1 | 3/2003 | Shiver et al. |
| 2003/0073619 A1 | 4/2003 | Mahato et al. |
| 2003/0077604 A1 | 4/2003 | Sun et al. |
| 2003/0082768 A1 | 5/2003 | Baskerville et al. |
| 2003/0083272 A1 | 5/2003 | Wiederholt et al. |
| 2003/0092653 A1 | 5/2003 | Kisich et al. |
| 2003/0138419 A1 | 7/2003 | Radic et al. |
| 2003/0143743 A1 | 7/2003 | Schuler et al. |
| 2003/0153735 A1 | 8/2003 | Breece et al. |
| 2003/0158133 A1 | 8/2003 | Movsesian |
| 2003/0170273 A1 | 9/2003 | O'Hagan et al. |
| 2003/0171253 A1 | 9/2003 | Ma et al. |
| 2003/0186237 A1 | 10/2003 | Ginsberg et al. |
| 2003/0191303 A1 | 10/2003 | Vinayak et al. |
| 2003/0192068 A1 | 10/2003 | Deboer et al. |
| 2003/0225016 A1 | 12/2003 | Fearon et al. |
| 2004/0001810 A1 | 1/2004 | Davis |
| 2004/0005667 A1 | 1/2004 | Ratti et al. |
| 2004/0018525 A1 | 1/2004 | Wirtz et al. |
| 2004/0101863 A1 | 5/2004 | Hattori et al. |
| 2004/0106567 A1 | 6/2004 | Hagstrom et al. |
| 2004/0110191 A1 | 6/2004 | Winkler et al. |
| 2004/0122216 A1 | 6/2004 | Nielsen et al. |
| 2004/0142474 A1 | 7/2004 | Mahato et al. |
| 2004/0147027 A1 | 7/2004 | Troy et al. |
| 2004/0167090 A1 | 8/2004 | Monahan et al. |
| 2004/0171041 A1 | 9/2004 | Dahl et al. |
| 2004/0171980 A1 | 9/2004 | Mitragotri et al. |
| 2004/0197802 A1 | 10/2004 | Dahl et al. |
| 2004/0202658 A1 | 10/2004 | Benyunes |
| 2004/0209274 A2 | 10/2004 | Daly |
| 2004/0236268 A1 | 11/2004 | Mitragotri et al. |
| 2004/0259081 A1 | 12/2004 | Watzele et al. |
| 2005/0032730 A1 | 2/2005 | Von Der Mulbe et al. |
| 2005/0037494 A1 | 2/2005 | Hecker et al. |
| 2005/0054026 A1 | 3/2005 | Atsushi et al. |
| 2005/0059624 A1 | 3/2005 | Hoerr et al. |
| 2005/0064596 A1 | 3/2005 | Riemen et al. |
| 2005/0089913 A1 | 4/2005 | Williams |
| 2005/0112141 A1 | 5/2005 | Terman |
| 2005/0130201 A1 | 6/2005 | Deras et al. |
| 2005/0137155 A1 | 6/2005 | McSwiggen et al. |
| 2005/0143336 A1 | 6/2005 | Ramesh et al. |
| 2005/0147618 A1 | 7/2005 | Rivera et al. |
| 2005/0153333 A1 | 7/2005 | Sooknanan |
| 2005/0181016 A1 | 8/2005 | Freyman et al. |
| 2005/0232919 A1 | 10/2005 | Grasso et al. |
| 2005/0250723 A1 | 11/2005 | Hoerr et al. |
| 2006/0008910 A1 | 1/2006 | Maclachlan et al. |
| 2006/0018971 A1 | 1/2006 | Scott et al. |
| 2006/0035226 A1 | 2/2006 | Scheinert et al. |
| 2006/0057111 A1 | 3/2006 | Hedlund et al. |
| 2006/0083780 A1 | 4/2006 | Heyes et al. |
| 2006/0160743 A1 | 7/2006 | Zhang et al. |
| 2006/0032372 A1 | 8/2006 | Katalin et al. |
| 2006/0172003 A1 | 8/2006 | Meers et al. |
| 2006/0172966 A1 | 8/2006 | Lipford et al. |
| 2006/0188490 A1 | 8/2006 | Hoerr et al. |
| 2006/0204566 A1 | 9/2006 | Smyth-Templeton et al. |
| 2006/0241076 A1 | 10/2006 | Uhlmann et al. |
| 2006/0247195 A1 | 11/2006 | Ray |
| 2006/0265771 A1 | 11/2006 | Lewis et al. |
| 2006/0275747 A1 | 12/2006 | Hardy et al. |
| 2007/0037147 A1 | 2/2007 | Garcia et al. |
| 2007/0037148 A1 | 2/2007 | Fong |
| 2007/0048741 A1 | 3/2007 | Getts et al. |
| 2007/0054278 A1 | 3/2007 | Cargill |
| 2007/0072175 A1 | 3/2007 | Cooper et al. |
| 2007/0087437 A1 | 4/2007 | Hu |
| 2007/0105124 A1 | 5/2007 | Getts et al. |
| 2007/0117112 A1 | 5/2007 | Diener et al. |
| 2007/0122882 A1 | 5/2007 | Nakagawa et al. |
| 2007/0141030 A1 | 6/2007 | Yu et al. |
| 2007/0143878 A1 | 6/2007 | Bhat et al. |
| 2007/0178103 A1 | 8/2007 | Fey et al. |
| 2007/0213287 A1 | 9/2007 | Fewell et al. |
| 2007/0224635 A1 | 9/2007 | Bouquin |
| 2007/0252295 A1 | 11/2007 | Panzner et al. |
| 2007/0265220 A1 | 11/2007 | Rossi et al. |
| 2007/0280929 A1 | 12/2007 | Hoerr et al. |
| 2008/0008711 A1 | 1/2008 | Schleyer et al. |
| 2008/0020431 A1 | 1/2008 | Getts et al. |
| 2008/0025944 A1 | 1/2008 | Hoerr et al. |
| 2008/0057080 A1 | 3/2008 | Luke et al. |
| 2008/0075698 A1 | 3/2008 | Sawada et al. |
| 2008/0076174 A1 | 3/2008 | Selden et al. |
| 2008/0119645 A1 | 5/2008 | Griffey et al. |
| 2008/0166414 A1 | 7/2008 | Hanes et al. |
| 2008/0166793 A1 | 7/2008 | Beer et al. |

(56) References Cited

U.S. PATENT DOCUMENTS

| | | |
|---|---|---|
| 2008/0171711 A1 | 7/2008 | Hoerr et al. |
| 2008/0220471 A1 | 9/2008 | Davis et al. |
| 2008/0260706 A1 | 10/2008 | Rabinovich et al. |
| 2008/0261905 A1 | 10/2008 | Herdewijin et al. |
| 2008/0267873 A1 | 10/2008 | Hoerr et al. |
| 2008/0274463 A1 | 11/2008 | Chen et al. |
| 2008/0275468 A1 | 11/2008 | Chuang et al. |
| 2008/0286813 A1 | 11/2008 | George-Hyslop et al. |
| 2008/0293143 A1 | 11/2008 | Lin et al. |
| 2009/0042825 A1 | 2/2009 | Matar et al. |
| 2009/0042829 A1 | 2/2009 | Matar et al. |
| 2009/0048167 A1 | 2/2009 | Hillman |
| 2009/0053775 A1 | 2/2009 | Dahl et al. |
| 2009/0093433 A1 | 4/2009 | Woolf et al. |
| 2009/0144839 A1 | 6/2009 | Inana et al. |
| 2009/0169550 A1 | 7/2009 | Dummer |
| 2009/0170090 A1 | 7/2009 | Ignatov et al. |
| 2009/0208418 A1 | 8/2009 | Kohler et al. |
| 2009/0208500 A1 | 8/2009 | Joly et al. |
| 2009/0226470 A1 | 9/2009 | Mauro et al. |
| 2009/0227660 A1 | 9/2009 | Oh et al. |
| 2009/0264511 A1 | 10/2009 | de Fougerolles et al. |
| 2009/0281298 A1 | 11/2009 | Manoharan et al. |
| 2009/0286852 A1 | 11/2009 | Kariko et al. |
| 2009/0324584 A1 | 12/2009 | Hoerr et al. |
| 2010/0003337 A1 | 1/2010 | Hanes et al. |
| 2010/0004313 A1 | 1/2010 | Slobodkin et al. |
| 2010/0004315 A1 | 1/2010 | Slobodkin et al. |
| 2010/0009424 A1 | 1/2010 | Forde et al. |
| 2010/0009865 A1 | 1/2010 | Herdewijin et al. |
| 2010/0015232 A1 | 1/2010 | Besenbacher et al. |
| 2010/0021429 A1 | 1/2010 | Brentzel, Jr. et al. |
| 2010/0028943 A1 | 2/2010 | Thomas et al. |
| 2010/0047261 A1 | 2/2010 | Hoerr et al. |
| 2010/0086922 A1 | 4/2010 | Bryant et al. |
| 2010/0120024 A1 | 5/2010 | Cload et al. |
| 2010/0129877 A1 | 5/2010 | Sahin et al. |
| 2010/0137407 A1 | 6/2010 | Abe et al. |
| 2010/0178271 A1 | 7/2010 | Bridger et al. |
| 2010/0189729 A1 | 7/2010 | Hoerr et al. |
| 2010/0196318 A1 | 8/2010 | Lieberburg et al. |
| 2010/0203076 A1 | 8/2010 | Fotin-Mleczek et al. |
| 2010/0215580 A1 | 8/2010 | Hanes et al. |
| 2010/0233141 A1 | 9/2010 | Polach et al. |
| 2010/0239608 A1 | 9/2010 | Von Der Mulbe et al. |
| 2010/0260817 A1 | 10/2010 | Slobodkin et al. |
| 2010/0261231 A1 | 10/2010 | Kore et al. |
| 2010/0266587 A1 | 10/2010 | Mclachlan |
| 2010/0273220 A1 | 10/2010 | Yanik et al. |
| 2010/0285135 A1 | 11/2010 | Wendorf et al. |
| 2010/0291156 A1 | 11/2010 | Barner et al. |
| 2010/0293625 A1 | 11/2010 | Reed |
| 2010/0297750 A1 | 11/2010 | Natsume et al. |
| 2010/0303851 A1 | 12/2010 | Hoerr et al. |
| 2010/0305196 A1 | 12/2010 | Probst et al. |
| 2011/0002934 A1 | 1/2011 | Luqman et al. |
| 2011/0020352 A1 | 1/2011 | Garcia et al. |
| 2011/0045022 A1 | 2/2011 | Tsai |
| 2011/0053829 A1 | 3/2011 | Baumhof et al. |
| 2011/0065103 A1 | 3/2011 | Sahin et al. |
| 2011/0077287 A1 | 3/2011 | Von Der Mulbe et al. |
| 2011/0086904 A1 | 4/2011 | Russell |
| 2011/0091473 A1 | 4/2011 | Golab et al. |
| 2011/0091879 A1 | 4/2011 | Hillebrand et al. |
| 2011/0097716 A1 | 4/2011 | Natt et al. |
| 2011/0112040 A1 | 5/2011 | Liu et al. |
| 2011/0143397 A1 | 6/2011 | Kariko et al. |
| 2011/0143436 A1 | 6/2011 | Dahl et al. |
| 2011/0165123 A1 | 7/2011 | Hartmann et al. |
| 2011/0165159 A1 | 7/2011 | Grillo-Lopez et al. |
| 2011/0172126 A1 | 7/2011 | Brust |
| 2011/0182919 A1 | 7/2011 | Peters et al. |
| 2011/0200582 A1 | 8/2011 | Baryza et al. |
| 2011/0201673 A1 | 8/2011 | Hayden et al. |
| 2011/0218231 A1 | 9/2011 | Fewell et al. |
| 2011/0243942 A1 | 10/2011 | Wang |
| 2011/0244026 A1 | 10/2011 | Guild et al. |
| 2011/0245756 A1 | 10/2011 | Arora et al. |
| 2011/0247090 A1 | 10/2011 | Reed |
| 2011/0250225 A1 | 10/2011 | Fotin-Mleczek et al. |
| 2011/0269950 A1 | 11/2011 | Von Der Mulbe et al. |
| 2011/0274697 A1 | 11/2011 | Thomas et al. |
| 2011/0275793 A1 | 11/2011 | Debart et al. |
| 2011/0287006 A1 | 11/2011 | Friess et al. |
| 2011/0294717 A1 | 12/2011 | Ali et al. |
| 2011/0300205 A1 | 12/2011 | Geall et al. |
| 2011/0311472 A1 | 12/2011 | Hoerr et al. |
| 2012/0009145 A1 | 1/2012 | Slobodkin et al. |
| 2012/0009221 A1 | 1/2012 | Hoerr et al. |
| 2012/0009649 A1 | 1/2012 | Dahl et al. |
| 2012/0015899 A1 | 1/2012 | Lomonossoff et al. |
| 2012/0021042 A1 | 1/2012 | Panzner et al. |
| 2012/0021043 A1 | 1/2012 | Kramps et al. |
| 2012/0027813 A1 | 2/2012 | Podda et al. |
| 2012/0046346 A1 | 2/2012 | Rossi et al. |
| 2012/0053333 A1 | 3/2012 | Mauro et al. |
| 2012/0060293 A1 | 3/2012 | Stelter et al. |
| 2012/0065252 A1 | 3/2012 | Schrum et al. |
| 2012/0076836 A1 | 3/2012 | Hori et al. |
| 2012/0094906 A1 | 4/2012 | Guyon et al. |
| 2012/0095077 A1 | 4/2012 | Burrows et al. |
| 2012/0114686 A1 | 5/2012 | Schneewind et al. |
| 2012/0121718 A1 | 5/2012 | Lai et al. |
| 2012/0128699 A1 | 5/2012 | Kandimalla et al. |
| 2012/0129759 A1 | 5/2012 | Liu et al. |
| 2012/0136073 A1 | 5/2012 | Yang et al. |
| 2012/0156679 A1 | 6/2012 | Dahl et al. |
| 2012/0171290 A1 | 7/2012 | Coursaget et al. |
| 2012/0177724 A1 | 7/2012 | Irvine et al. |
| 2012/0178702 A1 | 7/2012 | Huang |
| 2012/0189700 A1 | 7/2012 | Aguilar et al. |
| 2012/0195917 A1 | 8/2012 | Sahin et al. |
| 2012/0195936 A1 | 8/2012 | Rudolph et al. |
| 2012/0207840 A1 | 8/2012 | de los Pinos |
| 2012/0213818 A1 | 8/2012 | Hoerr et al. |
| 2012/0219573 A1 | 8/2012 | Baumhof et al. |
| 2012/0225070 A1 | 9/2012 | Smith et al. |
| 2012/0232133 A1 | 9/2012 | Balazs et al. |
| 2012/0237975 A1 | 9/2012 | Schrum et al. |
| 2012/0251618 A1 | 10/2012 | Schrum et al. |
| 2012/0252117 A1 | 10/2012 | Selden et al. |
| 2012/0258046 A1 | 10/2012 | Mutske |
| 2012/0276048 A1 | 11/2012 | Panzara et al. |
| 2012/0282247 A1 | 11/2012 | Schneewind et al. |
| 2012/0282249 A1 | 11/2012 | Fox et al. |
| 2012/0295832 A1 | 11/2012 | Constien et al. |
| 2012/0301955 A1 | 11/2012 | Thomas et al. |
| 2012/0321719 A1 | 12/2012 | McDonnell et al. |
| 2012/0322864 A1 | 12/2012 | Rossi et al. |
| 2012/0322865 A1 | 12/2012 | Rossi et al. |
| 2013/0012426 A1 | 1/2013 | de los Pinos |
| 2013/0012450 A1 | 1/2013 | de los Pinos |
| 2013/0012566 A1 | 1/2013 | de los Pinos |
| 2013/0017223 A1 | 1/2013 | Hope et al. |
| 2013/0017265 A1 | 1/2013 | Farokhzad et al. |
| 2013/0022538 A1 | 1/2013 | Rossi |
| 2013/0029418 A1 | 1/2013 | Angel et al. |
| 2013/0059360 A1 | 3/2013 | Bossard et al. |
| 2013/0064894 A1 | 3/2013 | Martin et al. |
| 2013/0065942 A1 | 3/2013 | Matar et al. |
| 2013/0071450 A1 | 3/2013 | Copp-Howland |
| 2013/0072670 A1 | 3/2013 | Srivastava et al. |
| 2013/0072709 A1 | 3/2013 | McManus et al. |
| 2013/0090287 A1 | 4/2013 | Alessi et al. |
| 2013/0090372 A1 | 4/2013 | Budzik et al. |
| 2013/0102034 A1 | 4/2013 | Schrum et al. |
| 2013/0102545 A1 | 4/2013 | Gao et al. |
| 2013/0102655 A1 | 4/2013 | Kore et al. |
| 2013/0108629 A1 | 5/2013 | Dumont et al. |
| 2013/0108685 A1 | 5/2013 | Kuboyama et al. |
| 2013/0111615 A1 | 5/2013 | Kariko et al. |
| 2013/0115192 A1 | 5/2013 | Ali et al. |
| 2013/0115196 A1 | 5/2013 | Hantash et al. |
| 2013/0115247 A1 | 5/2013 | de los Pinos |

(56) References Cited

U.S. PATENT DOCUMENTS

| | | |
|---|---|---|
| 2013/0115272 A1 | 5/2013 | de Fougerolles |
| 2013/0115273 A1 | 5/2013 | Yang et al. |
| 2013/0115274 A1 | 5/2013 | Knopov et al. |
| 2013/0115293 A1 | 5/2013 | Sabnis et al. |
| 2013/0116307 A1 | 5/2013 | Heyes et al. |
| 2013/0116408 A1 | 5/2013 | de los Pinos |
| 2013/0121954 A1 | 5/2013 | Wakefield et al. |
| 2013/0121988 A1 | 5/2013 | Hoerr et al. |
| 2013/0122104 A1 | 5/2013 | Yaworski et al. |
| 2013/0123338 A1 | 5/2013 | Heyes et al. |
| 2013/0123351 A1 | 5/2013 | Dewitt |
| 2013/0129627 A1 | 5/2013 | Delehanty et al. |
| 2013/0129726 A1 | 5/2013 | Lee |
| 2013/0129785 A1 | 5/2013 | Manoharan et al. |
| 2013/0129794 A1 | 5/2013 | Kleiner et al. |
| 2013/0129830 A1 | 5/2013 | Chen et al. |
| 2013/0130348 A1 | 5/2013 | Gu et al. |
| 2013/0133483 A1 | 5/2013 | Yang et al. |
| 2013/0136746 A1 | 5/2013 | Schneewind |
| 2013/0137644 A1 | 5/2013 | Alluis et al. |
| 2013/0138032 A1 | 5/2013 | Kim et al. |
| 2013/0142818 A1 | 6/2013 | Baumhof et al. |
| 2013/0142868 A1 | 6/2013 | Hoekman et al. |
| 2013/0142876 A1 | 6/2013 | Howard et al. |
| 2013/0149318 A1 | 6/2013 | Reynolds et al. |
| 2013/0149375 A1 | 6/2013 | Geall |
| 2013/0149783 A1 | 6/2013 | Yockman et al. |
| 2013/0150295 A1 | 6/2013 | Jaworowicz |
| 2013/0150625 A1 | 6/2013 | Budzik et al. |
| 2013/0150822 A1 | 6/2013 | Ross |
| 2013/0156721 A1 | 6/2013 | Cheng et al. |
| 2013/0156776 A1 | 6/2013 | Chang et al. |
| 2013/0156845 A1 | 6/2013 | Manoharan et al. |
| 2013/0156849 A1 | 6/2013 | de Fougerolles et al. |
| 2013/0158021 A1 | 6/2013 | Dong et al. |
| 2013/0164219 A1 | 6/2013 | Brinkmann et al. |
| 2013/0164343 A1 | 6/2013 | Hanes et al. |
| 2013/0164348 A1 | 6/2013 | Palasis et al. |
| 2013/0164400 A1 | 6/2013 | Knopov et al. |
| 2013/0165499 A1 | 6/2013 | Vaishnaw et al. |
| 2013/0165772 A1 | 6/2013 | Traverso et al. |
| 2013/0171138 A1 | 7/2013 | Peters et al. |
| 2013/0171175 A1 | 7/2013 | Pierce et al. |
| 2013/0171183 A1 | 7/2013 | Schneewind |
| 2013/0171241 A1 | 7/2013 | Geall |
| 2013/0171646 A1 | 7/2013 | Park et al. |
| 2013/0172406 A1 | 7/2013 | Zale et al. |
| 2013/0172600 A1 | 7/2013 | Chang et al. |
| 2013/0177499 A1 | 7/2013 | Brahmbhatt et al. |
| 2013/0177523 A1 | 7/2013 | Ghandehari et al. |
| 2013/0177587 A1 | 7/2013 | Robinson et al. |
| 2013/0177611 A1 | 7/2013 | Kaplan et al. |
| 2013/0177633 A1 | 7/2013 | Schutt et al. |
| 2013/0177634 A1 | 7/2013 | Schutt et al. |
| 2013/0177635 A1 | 7/2013 | Schutt et al. |
| 2013/0177636 A1 | 7/2013 | Schutt et al. |
| 2013/0177637 A1 | 7/2013 | Schutt et al. |
| 2013/0177638 A1 | 7/2013 | Schutt et al. |
| 2013/0177639 A1 | 7/2013 | Geall et al. |
| 2013/0177640 A1 | 7/2013 | Geall et al. |
| 2013/0178541 A1 | 7/2013 | Stanton et al. |
| 2013/0183244 A1 | 7/2013 | Hanes et al. |
| 2013/0183355 A1 | 7/2013 | Jain et al. |
| 2013/0183372 A1 | 7/2013 | Schutt et al. |
| 2013/0183373 A1 | 7/2013 | Schutt et al. |
| 2013/0183375 A1 | 7/2013 | Schutt et al. |
| 2013/0183718 A1 | 7/2013 | Rohayem |
| 2013/0184207 A1 | 7/2013 | Fares et al. |
| 2013/0184443 A1 | 7/2013 | Bentley et al. |
| 2013/0184453 A1 | 7/2013 | Davis et al. |
| 2013/0189295 A1 | 7/2013 | Arico et al. |
| 2013/0189351 A1 | 7/2013 | Geall |
| 2013/0189741 A1 | 7/2013 | Meis et al. |
| 2013/0195759 A1 | 8/2013 | Mirkin et al. |
| 2013/0195765 A1 | 8/2013 | Gho et al. |
| 2013/0195846 A1 | 8/2013 | Friess et al. |
| 2013/0195867 A1 | 8/2013 | Hoerr et al. |
| 2013/0195898 A1 | 8/2013 | O'Hagan et al. |
| 2013/0195967 A1 | 8/2013 | Guild et al. |
| 2013/0195968 A1 | 8/2013 | Geall et al. |
| 2013/0195969 A1 | 8/2013 | Geall et al. |
| 2013/0197068 A1 | 8/2013 | Kariko et al. |
| 2013/0202595 A1 | 8/2013 | Pierce et al. |
| 2013/0202645 A1 | 8/2013 | Barner et al. |
| 2013/0202684 A1 | 8/2013 | Geall et al. |
| 2013/0203115 A1 | 8/2013 | Schrum et al. |
| 2013/0203870 A1 | 8/2013 | Rogers et al. |
| 2013/0209454 A1 | 8/2013 | Diskin et al. |
| 2013/0209456 A1 | 8/2013 | Kano et al. |
| 2013/0236419 A1 | 9/2013 | Schneewind et al. |
| 2013/0236500 A1 | 9/2013 | Zale et al. |
| 2013/0236533 A1 | 9/2013 | Von Andrian et al. |
| 2013/0236550 A1 | 9/2013 | Ausborn et al. |
| 2013/0236556 A1 | 9/2013 | Lai et al. |
| 2013/0236968 A1 | 9/2013 | Manoharan et al. |
| 2013/0243747 A1 | 9/2013 | Fima et al. |
| 2013/0243827 A1 | 9/2013 | Troiano et al. |
| 2013/0243848 A1 | 9/2013 | Lobovkina et al. |
| 2013/0243867 A1 | 9/2013 | Mohapatra et al. |
| 2013/0244972 A1 | 9/2013 | Ben-Shalom et al. |
| 2013/0245091 A1 | 9/2013 | Rozema et al. |
| 2013/0245104 A1 | 9/2013 | de Fougerolles et al. |
| 2013/0245107 A1 | 9/2013 | de Fougerolles et al. |
| 2013/0251679 A1 | 9/2013 | Pearlman et al. |
| 2013/0251766 A1 | 9/2013 | Zale et al. |
| 2013/0251816 A1 | 9/2013 | Zale et al. |
| 2013/0251817 A1 | 9/2013 | Zale et al. |
| 2013/0259923 A1 | 10/2013 | Bancel et al. |
| 2013/0266553 A1 | 10/2013 | Ballance et al. |
| 2013/0266611 A1 | 10/2013 | Rabinovich et al. |
| 2013/0266617 A1 | 10/2013 | Mirosevich et al. |
| 2013/0272994 A1 | 10/2013 | Fu et al. |
| 2013/0273039 A1 | 10/2013 | Grillo-Lopez |
| 2013/0273047 A1 | 10/2013 | Rivera et al. |
| 2013/0273081 A1 | 10/2013 | Monaci et al. |
| 2013/0273117 A1 | 10/2013 | Podobinski et al. |
| 2013/0274194 A1 | 10/2013 | Dumont et al. |
| 2013/0274504 A1 | 10/2013 | Colletti et al. |
| 2013/0274523 A1 | 10/2013 | Bawiec, III et al. |
| 2013/0280334 A1 | 10/2013 | Karp et al. |
| 2013/0280339 A1 | 10/2013 | Zale et al. |
| 2013/0281658 A1 | 10/2013 | Rozema et al. |
| 2013/0281671 A1 | 10/2013 | Peters et al. |
| 2013/0287832 A1 | 10/2013 | O'Hagan |
| 2013/0289093 A1 | 10/2013 | Bhat et al. |
| 2013/0295043 A1 | 11/2013 | Kallen et al. |
| 2013/0295183 A1 | 11/2013 | Troiano et al. |
| 2013/0295191 A1 | 11/2013 | Troiano et al. |
| 2013/0302432 A1 | 11/2013 | Zale et al. |
| 2013/0302433 A1 | 11/2013 | Troiano et al. |
| 2013/0315831 A1 | 11/2013 | Shi et al. |
| 2013/0317079 A1 | 11/2013 | Wakefield et al. |
| 2013/0323179 A1 | 12/2013 | Popov et al. |
| 2013/0323310 A1 | 12/2013 | Smyth et al. |
| 2013/0330401 A1 | 12/2013 | Payne et al. |
| 2013/0336998 A1 | 12/2013 | Kallen et al. |
| 2013/0338210 A1 | 12/2013 | Manoharan et al. |
| 2013/0344091 A1 | 12/2013 | Berger et al. |
| 2013/0344158 A1 | 12/2013 | Zale et al. |
| 2014/0005379 A1 | 1/2014 | Gu |
| 2014/0017327 A1 | 1/2014 | Cheng et al. |
| 2014/0017329 A1 | 1/2014 | Mousa |
| 2014/0030351 A1 | 1/2014 | Zale et al. |
| 2014/0037573 A1 | 2/2014 | Eliasof et al. |
| 2014/0037660 A1 | 2/2014 | Folin-Mleczek et al. |
| 2014/0037714 A1 | 2/2014 | Quay et al. |
| 2014/0039032 A1 | 2/2014 | Kumboyama et al. |
| 2014/0044772 A1 | 2/2014 | Maclachlan et al. |
| 2014/0044791 A1 | 2/2014 | Basilion et al. |
| 2014/0045913 A1 | 2/2014 | Kumboyama et al. |
| 2014/0045950 A1 | 2/2014 | Lacko et al. |
| 2014/0050775 A1 | 2/2014 | Slobodkin et al. |
| 2014/0056867 A1 | 2/2014 | Lebowitz et al. |
| 2014/0056970 A1 | 2/2014 | Panzer et al. |

(56) References Cited

U.S. PATENT DOCUMENTS

| | | |
|---|---|---|
| 2014/0057109 A1 | 2/2014 | Mechen et al. |
| 2014/0065172 A1 | 3/2014 | Echeverri et al. |
| 2014/0065204 A1 | 3/2014 | Hayes et al. |
| 2014/0065228 A1 | 3/2014 | Yarowoski et al. |
| 2014/0066363 A1 | 3/2014 | Bhunia et al. |
| 2014/0072580 A1 | 3/2014 | Tontonoz et al. |
| 2014/0073715 A1 | 3/2014 | Fonnum et al. |
| 2014/0073738 A1 | 3/2014 | Fonnum et al. |
| 2014/0079774 A1 | 3/2014 | Brinker et al. |
| 2014/0079776 A1 | 3/2014 | Lippard et al. |
| 2014/0080766 A1 | 3/2014 | Pirie et al. |
| 2014/0081012 A1 | 3/2014 | DeSimone et al. |
| 2014/0093575 A1 | 4/2014 | Hammond et al. |
| 2014/0093579 A1 | 4/2014 | Zale et al. |
| 2014/0100178 A1 | 4/2014 | Ansari et al. |
| 2014/0106260 A1 | 4/2014 | Cargnello et al. |
| 2014/0107227 A1 | 4/2014 | Masters et al. |
| 2014/0107229 A1 | 4/2014 | Kormann et al. |
| 2014/0107349 A1 | 4/2014 | Bentley et al. |
| 2014/0107594 A1 | 4/2014 | Guo et al. |
| 2014/0113137 A1 | 4/2014 | Podobinski et al. |
| 2014/0120091 A1 | 5/2014 | Ledbetter et al. |
| 2014/0121263 A1 | 5/2014 | Fitzgerald et al. |
| 2014/0121393 A1 | 5/2014 | Manoharan et al. |
| 2014/0121587 A1 | 5/2014 | Salberg et al. |
| 2014/0127227 A1 | 5/2014 | Chang |
| 2014/0127301 A1 | 5/2014 | Alexis et al. |
| 2014/0128269 A1 | 5/2014 | Hinz et al. |
| 2014/0128329 A1 | 5/2014 | Gore et al. |
| 2014/0134129 A1 | 5/2014 | Thalhamer et al. |
| 2014/0134201 A1 | 5/2014 | Tureci et al. |
| 2014/0134230 A1 | 5/2014 | Frank et al. |
| 2014/0134260 A1 | 5/2014 | Heyes et al. |
| 2014/0135380 A1 | 5/2014 | Hadwiger et al. |
| 2014/0135381 A1 | 5/2014 | Hadwiger et al. |
| 2014/0141025 A1 | 5/2014 | Kudirka et al. |
| 2014/0141070 A1 | 5/2014 | Geall et al. |
| 2014/0141089 A1 | 5/2014 | Liang |
| 2014/0141483 A1 | 5/2014 | Bossard et al. |
| 2014/0142165 A1 | 5/2014 | Grayson et al. |
| 2014/0142254 A1 | 5/2014 | Fonnum et al. |
| 2014/0147432 A1 | 5/2014 | Bancel et al. |
| 2014/0147454 A1 | 5/2014 | Chakraborty et al. |
| 2014/0148502 A1 | 5/2014 | Bancel et al. |
| 2014/0148503 A1 | 5/2014 | Giangrande et al. |
| 2014/0206753 A1 | 7/2014 | Guild et al. |
| 2014/0275227 A1* | 9/2014 | Hoge ............... A61K 38/177 514/44 R |
| 2014/0308304 A1 | 10/2014 | Manoharan et al. |
| 2015/0005372 A1 | 1/2015 | Hoge et al. |
| 2015/0038558 A1 | 2/2015 | Kariko et al. |
| 2015/0111955 A1 | 4/2015 | High et al. |
| 2015/0140070 A1 | 5/2015 | Heartlein et al. |
| 2015/0157565 A1 | 6/2015 | Heartlein et al. |
| 2015/0174260 A1 | 6/2015 | Yang et al. |
| 2015/0174261 A1 | 6/2015 | Kuboyama et al. |
| 2015/0284317 A1 | 10/2015 | Colletti et al. |
| 2015/0343062 A1 | 12/2015 | Kuboyama et al. |
| 2015/0366997 A1 | 12/2015 | Guild et al. |
| 2015/0376115 A1 | 12/2015 | Ansell et al. |
| 2016/0002178 A1 | 1/2016 | Fenton et al. |
| 2016/0009657 A1 | 1/2016 | Anderson et al. |
| 2016/0031928 A1 | 2/2016 | Derosa et al. |
| 2016/0136236 A1 | 5/2016 | Hoge et al. |
| 2016/0151284 A1 | 6/2016 | Heyes et al. |
| 2018/0036369 A1 | 2/2018 | Hoge et al. |

FOREIGN PATENT DOCUMENTS

| | | |
|---|---|---|
| CA | 2473135 | 6/2003 |
| CA | 2795695 A1 | 10/2011 |
| CN | 102068701 A | 5/2011 |
| CN | 102204920 A | 10/2011 |
| CN | 102813929 A | 12/2012 |
| CN | 104644555 A | 5/2015 |
| EP | 204401 | 12/1986 |
| EP | 366400 B1 | 5/1990 |
| EP | 194809 B1 | 3/1991 |
| EP | 427073 | 5/1991 |
| EP | 427074 | 5/1991 |
| EP | 735144 B1 | 3/1996 |
| EP | 726319 | 8/1996 |
| EP | 737750 | 10/1996 |
| EP | 771873 A3 | 7/1997 |
| EP | 839912 | 5/1998 |
| EP | 969862 | 1/2000 |
| EP | 1026253 | 8/2000 |
| EP | 1083232 A1 | 3/2001 |
| EP | 1404860 B1 | 5/2002 |
| EP | 1224943 A1 | 7/2002 |
| EP | 1361277 | 11/2003 |
| EP | 1393745 | 3/2004 |
| EP | 1083232 B1 | 2/2005 |
| EP | 1301614 | 11/2006 |
| EP | 1873180 A1 | 1/2008 |
| EP | 1964922 A1 | 3/2008 |
| EP | 1905844 A2 | 4/2008 |
| EP | 2072618 | 6/2009 |
| EP | 1056873 | 3/2010 |
| EP | 2191840 A1 | 6/2010 |
| EP | 2092064 | 9/2010 |
| EP | 2246422 A1 | 11/2010 |
| EP | 1619254 | 12/2010 |
| EP | 2292771 | 3/2011 |
| EP | 2376091 A2 | 10/2011 |
| EP | 2377938 A1 | 10/2011 |
| EP | 2468290 A1 | 6/2012 |
| EP | 2476430 B1 | 7/2012 |
| EP | 2484770 A1 | 8/2012 |
| EP | 2535419 A2 | 12/2012 |
| EP | 2188379 B1 | 1/2013 |
| EP | 2548960 A1 | 1/2013 |
| EP | 2620161 A1 | 7/2013 |
| EP | 2073848 B1 | 8/2013 |
| EP | 2623121 A1 | 8/2013 |
| EP | 2695608 A2 | 2/2014 |
| EP | 2160464 B1 | 5/2014 |
| EP | 2607379 B1 | 5/2014 |
| EP | 2732825 A1 | 5/2014 |
| JP | 2002-508299 A | 3/2002 |
| JP | 2012-505250 A | 3/2012 |
| WO | WO 1987/005326 A1 | 9/1987 |
| WO | WO 1989/007947 A1 | 3/1989 |
| WO | WO 1989/006700 | 7/1989 |
| WO | WO 89/09622 A1 | 10/1989 |
| WO | WO 1990/011092 | 10/1990 |
| WO | WO 1992/001813 A1 | 2/1992 |
| WO | WO 1992/016553 A1 | 10/1992 |
| WO | WO 1993/009236 | 5/1993 |
| WO | WO 1993/014778 | 8/1993 |
| WO | WO 1995/012665 | 5/1995 |
| WO | WO 1995/024485 | 9/1995 |
| WO | WO 1995/026204 | 10/1995 |
| WO | WO 1995/029697 A1 | 11/1995 |
| WO | WO 1995/033835 | 12/1995 |
| WO | WO 1995/035375 A1 | 12/1995 |
| WO | WO 1996/017086 | 6/1996 |
| WO | WO 1997/011085 | 3/1997 |
| WO | WO 1997/012519 | 4/1997 |
| WO | WO 1997/030064 A1 | 8/1997 |
| WO | WO 1997/041210 | 11/1997 |
| WO | WO 1997/046680 | 12/1997 |
| WO | WO 1997/048370 | 12/1997 |
| WO | WO 1998/000547 | 1/1998 |
| WO | WO 1998/012207 | 3/1998 |
| WO | WO 1998/019710 A2 | 5/1998 |
| WO | WO 1998/034640 | 8/1998 |
| WO | WO 1998/047913 A2 | 10/1998 |
| WO | WO 1998/055495 | 12/1998 |
| WO | WO 1999/006073 A1 | 2/1999 |
| WO | WO 1999/014346 A2 | 3/1999 |
| WO | WO 1999/020766 | 4/1999 |
| WO | WO 1999/020774 | 4/1999 |

(56) References Cited

FOREIGN PATENT DOCUMENTS

| | | |
|---|---|---|
| WO | WO 1999/033982 | 7/1999 |
| WO | WO 1999/042618 | 8/1999 |
| WO | WO 1999/043835 | 9/1999 |
| WO | WO 1999/052503 | 10/1999 |
| WO | WO 1999/054457 | 10/1999 |
| WO | WO 2000/026226 A1 | 5/2000 |
| WO | WO 2000/027340 | 5/2000 |
| WO | WO 2000/029561 | 5/2000 |
| WO | WO 2000/039327 A1 | 7/2000 |
| WO | WO 2000/050586 | 8/2000 |
| WO | WO 2000/075304 | 12/2000 |
| WO | WO 2000/075356 | 12/2000 |
| WO | WO 2001/000650 | 1/2001 |
| WO | WO 2001/004313 | 1/2001 |
| WO | WO 2001/014424 A2 | 3/2001 |
| WO | WO 2001/021810 | 3/2001 |
| WO | WO 2001/055306 A2 | 8/2001 |
| WO | WO 2001/078779 A2 | 10/2001 |
| WO | WO 2001/092523 | 12/2001 |
| WO | WO 2001/093902 | 12/2001 |
| WO | WO 2002/008435 | 1/2002 |
| WO | WO 2002/024873 | 3/2002 |
| WO | WO 2002/046477 | 6/2002 |
| WO | WO 2002/064799 | 8/2002 |
| WO | WO 2002/065093 | 8/2002 |
| WO | WO 2002/102839 | 12/2002 |
| WO | WO 2003/002604 | 1/2003 |
| WO | WO 2003/018798 | 3/2003 |
| WO | WO 2003/028656 | 4/2003 |
| WO | WO 2003/046578 | 6/2003 |
| WO | WO 2003/050258 | 6/2003 |
| WO | WO 2003/051923 | 6/2003 |
| WO | WO 2003/059194 | 7/2003 |
| WO | WO 2003/059381 | 7/2003 |
| WO | WO 2003/066649 | 8/2003 |
| WO | WO 2003/086280 | 10/2003 |
| WO | WO 2003/087815 | 10/2003 |
| WO | WO 2003/101401 | 12/2003 |
| WO | WO 2004/005544 | 1/2004 |
| WO | WO 2004/010106 | 1/2004 |
| WO | WO 2005/017107 A2 | 2/2004 |
| WO | WO 2004/035607 A2 | 4/2004 |
| WO | WO 2004/037972 | 5/2004 |
| WO | WO 2004/058159 | 7/2004 |
| WO | WO 2004/065561 | 8/2004 |
| WO | WO 2004/067728 | 8/2004 |
| WO | WO 2004/076645 A1 | 9/2004 |
| WO | WO 2004/085474 | 10/2004 |
| WO | WO 2004/087868 A2 | 10/2004 |
| WO | WO 2004/092329 | 10/2004 |
| WO | WO 2005/005622 A2 | 1/2005 |
| WO | WO 2005/009346 | 2/2005 |
| WO | WO 2005/034979 A2 | 4/2005 |
| WO | WO 2005/040416 | 5/2005 |
| WO | WO 2005/044859 A2 | 5/2005 |
| WO | WO 2005/047536 | 5/2005 |
| WO | WO 2005/062967 A2 | 7/2005 |
| WO | WO 2005/098433 | 10/2005 |
| WO | WO 2005/103081 A2 | 11/2005 |
| WO | WO 2005/117557 A2 | 12/2005 |
| WO | WO 2005/118857 | 12/2005 |
| WO | WO 2006/008154 A1 | 1/2006 |
| WO | WO 2006/013107 A1 | 2/2006 |
| WO | WO 2006/022712 | 3/2006 |
| WO | WO 2006/044456 | 4/2006 |
| WO | WO 2006/044503 | 4/2006 |
| WO | WO 2006/044505 | 4/2006 |
| WO | WO 2006/044682 | 4/2006 |
| WO | WO 2006/046978 A2 | 5/2006 |
| WO | WO 2006/056027 A1 | 6/2006 |
| WO | WO 2006/058088 | 6/2006 |
| WO | WO 2006/063249 A2 | 6/2006 |
| WO | WO 2006/065479 | 6/2006 |
| WO | WO 2006/065480 | 6/2006 |
| WO | WO-2006067254 A2 | 6/2006 |
| WO | WO 2006/071903 | 7/2006 |
| WO | WO 2006/095259 | 9/2006 |
| WO | WO 2006/110581 | 10/2006 |
| WO | WO 2006/110585 | 10/2006 |
| WO | WO 2006/110599 | 10/2006 |
| WO | WO 2007/005645 A2 | 1/2007 |
| WO | WO 2007/024323 | 3/2007 |
| WO | WO 2007/024708 A2 | 3/2007 |
| WO | WO 2007/064952 A2 | 3/2007 |
| WO | WO 2007/059782 A2 | 5/2007 |
| WO | WO 2007/062495 | 6/2007 |
| WO | WO 2007/067968 | 6/2007 |
| WO | WO 2007/069068 A2 | 6/2007 |
| WO | WO 2007/095976 A2 | 8/2007 |
| WO | WO 2007/100699 A2 | 9/2007 |
| WO | WO 2007/100789 A2 | 9/2007 |
| WO | WO 2007/104537 | 9/2007 |
| WO | WO 2008/003319 A1 | 1/2008 |
| WO | WO 2008/011519 | 1/2008 |
| WO | WO 2008/014979 | 2/2008 |
| WO | WO 2008/019371 A1 | 2/2008 |
| WO | WO 2008/022046 A2 | 2/2008 |
| WO | WO 2008/042973 A2 | 4/2008 |
| WO | WO 2008/051245 A2 | 5/2008 |
| WO | WO-2008052770 A2 | 5/2008 |
| WO | WO 2008/068631 A2 | 6/2008 |
| WO | WO 2008/077592 A1 | 7/2008 |
| WO | WO 2008/078180 A2 | 7/2008 |
| WO | WO 2008/083949 A2 | 7/2008 |
| WO | WO 2008/091799 A2 | 7/2008 |
| WO | WO 2008/096370 A2 | 8/2008 |
| WO | WO 2008/107388 A1 | 9/2008 |
| WO | WO 2008/115504 A2 | 9/2008 |
| WO | WO 2008/134724 A2 | 11/2008 |
| WO | WO 2008/140615 A2 | 11/2008 |
| WO | WO 2008/143878 A2 | 11/2008 |
| WO | WO 2008/144365 | 11/2008 |
| WO | WO 2008/151049 A2 | 12/2008 |
| WO | WO 2008/151058 | 12/2008 |
| WO | WO 2008/153705 | 12/2008 |
| WO | WO 2008/157688 A2 | 12/2008 |
| WO | WO 2009/006438 | 1/2009 |
| WO | WO 2009/015071 A1 | 1/2009 |
| WO | WO 2009/024599 | 2/2009 |
| WO | WO 2009/030254 A1 | 3/2009 |
| WO | WO 2009/030481 A1 | 3/2009 |
| WO | WO 2009/042971 A2 | 4/2009 |
| WO | WO 2009/046738 A1 | 4/2009 |
| WO | WO 2009/046739 | 4/2009 |
| WO | WO 2009/046974 A2 | 4/2009 |
| WO | WO 2009/046975 | 4/2009 |
| WO | WO 2009/068649 A2 | 6/2009 |
| WO | WO 2009/077134 A2 | 6/2009 |
| WO | WO 2009/086558 A1 | 7/2009 |
| WO | WO 2009/095226 | 8/2009 |
| WO | WO 2009/101407 A2 | 8/2009 |
| WO | WO 2009/113083 A1 | 9/2009 |
| WO | WO 2009/120927 A2 | 10/2009 |
| WO | WO 2009/127060 A1 | 10/2009 |
| WO | WO 2009/127230 A1 | 10/2009 |
| WO | WO 2009/129385 A1 | 10/2009 |
| WO | WO 2009/129395 A1 | 10/2009 |
| WO | WO-2009131740 A2 | 10/2009 |
| WO | WO 2009/149253 A2 | 12/2009 |
| WO | WO 2010/009065 A9 | 1/2010 |
| WO | WO 2010/009277 A2 | 1/2010 |
| WO | WO 2010/027903 A2 | 3/2010 |
| WO | WO 2010/030739 A1 | 3/2010 |
| WO | WO 2010/033906 A2 | 3/2010 |
| WO | WO 2010/037408 A1 | 4/2010 |
| WO | WO 2010/037539 A1 | 4/2010 |
| WO | WO 2010/042490 A1 | 4/2010 |
| WO | WO 2010/042877 A1 | 4/2010 |
| WO | WO 2010/053572 A2 | 5/2010 |
| WO | WO 2010/054406 A1 | 5/2010 |
| WO | WO-2010068918 A2 | 6/2010 |
| WO | WO 2010/084371 A1 | 7/2010 |
| WO | WO 2010/088537 A2 | 8/2010 |
| WO | WO 2010/088927 A1 | 8/2010 |

(56) References Cited

FOREIGN PATENT DOCUMENTS

| | | |
|---|---|---|
| WO | WO 2010/098861 A1 | 9/2010 |
| WO | WO 2010/111290 A1 | 9/2010 |
| WO | WO 2010/120266 A1 | 10/2010 |
| WO | WO 2010/129709 A1 | 11/2010 |
| WO | WO 2010/141135 A2 | 12/2010 |
| WO | WO 2010/144740 A1 | 12/2010 |
| WO | WO 2011/005341 A2 | 1/2011 |
| WO | WO 2011/005799 A2 | 1/2011 |
| WO | WO 2011/026641 A9 | 3/2011 |
| WO | WO 2011/032633 A1 | 3/2011 |
| WO | WO-2011028938 A1 | 3/2011 |
| WO | WO 2011/062965 A2 | 5/2011 |
| WO | WO 2011/068810 A1 | 6/2011 |
| WO | WO 2011/069164 A2 | 6/2011 |
| WO | WO 2011/069528 A1 | 6/2011 |
| WO | WO 2011/069529 A1 | 6/2011 |
| WO | WO 2011/069586 A1 | 6/2011 |
| WO | WO 2011/069587 A1 | 6/2011 |
| WO | WO 2011/071931 A2 | 6/2011 |
| WO | WO 2011/071936 A2 | 6/2011 |
| WO | WO 2011/076807 A2 | 6/2011 |
| WO | WO 2011/025566 A1 | 7/2011 |
| WO | WO 2011/088309 A1 | 7/2011 |
| WO | WO 2011/120053 A1 | 9/2011 |
| WO | WO-2011117401 A1 | 9/2011 |
| WO | WO 2011/127032 A1 | 10/2011 |
| WO | WO 2011/127255 A1 | 10/2011 |
| WO | WO 2011/127933 A1 | 10/2011 |
| WO | WO 2011/128444 A2 | 10/2011 |
| WO | WO 2011/130624 A2 | 10/2011 |
| WO | WO 2011/133868 A2 | 10/2011 |
| WO | WO 2011/137206 A1 | 11/2011 |
| WO | WO 2011/144358 A1 | 11/2011 |
| WO | WO 2011/161653 A1 | 12/2011 |
| WO | WO 2012/000104 A1 | 1/2012 |
| WO | WO 2012/003474 A2 | 1/2012 |
| WO | WO 2012/006359 A1 | 1/2012 |
| WO | WO 2012/006369 A2 | 1/2012 |
| WO | WO 2012/006372 A1 | 1/2012 |
| WO | WO 2012/006376 A2 | 1/2012 |
| WO | WO 2012/006377 A2 | 1/2012 |
| WO | WO 2012/006378 A1 | 1/2012 |
| WO | WO 2012/006380 A2 | 1/2012 |
| WO | WO 2012/010855 A1 | 1/2012 |
| WO | WO 2012/013326 A1 | 2/2012 |
| WO | WO 2012/019630 A1 | 2/2012 |
| WO | WO 2012/019780 A1 | 2/2012 |
| WO | WO 2012/023044 A1 | 2/2012 |
| WO | WO 2012/024526 A2 | 2/2012 |
| WO | WO-2012019168 A2 | 2/2012 |
| WO | WO 2012/030683 A2 | 3/2012 |
| WO | WO 2012/030901 A1 | 3/2012 |
| WO | WO 2012/030904 A2 | 3/2012 |
| WO | WO 2012/031043 A1 | 3/2012 |
| WO | WO 2012/031046 A2 | 3/2012 |
| WO | WO 2012/034067 A1 | 3/2012 |
| WO | WO 2012/034077 A2 | 3/2012 |
| WO | WO 2012/045082 A2 | 4/2012 |
| WO | WO 2012/050975 A2 | 4/2012 |
| WO | WO 2012/054365 A2 | 4/2012 |
| WO | WO 2012/064429 A2 | 5/2012 |
| WO | WO 2012/065164 A2 | 5/2012 |
| WO | WO 2012/068295 A1 | 5/2012 |
| WO | WO 2012/068360 A1 | 5/2012 |
| WO | WO 2012/068470 A2 | 5/2012 |
| WO | WO-2012058693 A2 | 5/2012 |
| WO | WO 2012/072269 A1 | 6/2012 |
| WO | WO 2012/075040 A2 | 6/2012 |
| WO | WO 2012/088381 A2 | 6/2012 |
| WO | WO 2012/089225 A1 | 7/2012 |
| WO | WO 2012/089338 A1 | 7/2012 |
| WO | WO 2012/094304 A1 | 7/2012 |
| WO | WO 2012/094574 A2 | 7/2012 |
| WO | WO 2012/099755 A1 | 7/2012 |
| WO | WO 2012/099805 A2 | 7/2012 |
| WO | WO 2012/103985 A2 | 8/2012 |
| WO | WO 2012/110636 A2 | 8/2012 |
| WO | WO 2012/112582 A2 | 8/2012 |
| WO | WO 2012/113413 A1 | 8/2012 |
| WO | WO 2012/113513 A1 | 8/2012 |
| WO | WO-2012109530 A1 | 8/2012 |
| WO | WO 2012/116714 A1 | 9/2012 |
| WO | WO 2012/116715 A1 | 9/2012 |
| WO | WO 2012/116810 A1 | 9/2012 |
| WO | WO 2012/116811 A1 | 9/2012 |
| WO | WO 2012/117377 A1 | 9/2012 |
| WO | WO 2012/122318 A2 | 9/2012 |
| WO | WO 2012/125680 A1 | 9/2012 |
| WO | WO 2012/125812 A1 | 9/2012 |
| WO | WO 2012/125987 A2 | 9/2012 |
| WO | WO 2012/129483 A1 | 9/2012 |
| WO | WO 2012/131594 A1 | 10/2012 |
| WO | WO 2012/135025 A2 | 10/2012 |
| WO | WO 2012/135805 A2 | 10/2012 |
| WO | WO 2012/138453 A1 | 10/2012 |
| WO | WO 2012/138530 A1 | 10/2012 |
| WO | WO 2012/142240 A1 | 10/2012 |
| WO | WO 2012/143407 A1 | 10/2012 |
| WO | WO 2012/149045 A2 | 11/2012 |
| WO | WO 2012/149246 A1 | 11/2012 |
| WO | WO 2012/149252 A2 | 11/2012 |
| WO | WO 2012/149255 A2 | 11/2012 |
| WO | WO 2012/149259 A1 | 11/2012 |
| WO | WO 2012/149265 A2 | 11/2012 |
| WO | WO 2012/149282 A2 | 11/2012 |
| WO | WO 2012/149301 A2 | 11/2012 |
| WO | WO 2012/149376 A2 | 11/2012 |
| WO | WO 2012/149393 A2 | 11/2012 |
| WO | WO 2012/149536 A1 | 11/2012 |
| WO | WO 2012/151234 A2 | 11/2012 |
| WO | WO 2012/152910 A1 | 11/2012 |
| WO | WO 2012/153297 A1 | 11/2012 |
| WO | WO 2012/153338 A2 | 11/2012 |
| WO | WO 2012/154202 A1 | 11/2012 |
| WO | WO 2012/158613 A1 | 11/2012 |
| WO | WO 2012/160177 A1 | 11/2012 |
| WO | WO 2012/162174 A1 | 12/2012 |
| WO | WO 2012/166241 A1 | 12/2012 |
| WO | WO 2012/166923 A2 | 12/2012 |
| WO | WO 2012/168259 A1 | 12/2012 |
| WO | WO 2012/168491 A1 | 12/2012 |
| WO | WO 2012/170607 A2 | 12/2012 |
| WO | WO 2012/170889 A1 | 12/2012 |
| WO | WO 2012/170930 A1 | 12/2012 |
| WO | WO 2012/172495 A1 | 12/2012 |
| WO | WO 2012/172521 A1 | 12/2012 |
| WO | WO 2012/177760 A1 | 12/2012 |
| WO | WO-2012172313 A2 | 12/2012 |
| WO | WO 2013/003475 A1 | 1/2013 |
| WO | WO 2013/003887 A1 | 1/2013 |
| WO | WO 2013/006437 A1 | 1/2013 |
| WO | WO 2013/006824 A2 | 1/2013 |
| WO | WO 2013/006825 A1 | 1/2013 |
| WO | WO 2013/006834 A1 | 1/2013 |
| WO | WO 2013/006837 A1 | 1/2013 |
| WO | WO 2013/006838 A1 | 1/2013 |
| WO | WO 2013/006842 A2 | 1/2013 |
| WO | WO 2013/009717 A1 | 1/2013 |
| WO | WO 2013/009736 A2 | 1/2013 |
| WO | WO 2013/011325 A2 | 1/2013 |
| WO | WO 2013/012476 A2 | 1/2013 |
| WO | WO 2013/016058 A1 | 1/2013 |
| WO | WO 2013/016460 A1 | 1/2013 |
| WO | WO 2013/019669 A2 | 2/2013 |
| WO | WO 2013/025834 A2 | 2/2013 |
| WO | WO 2013/030778 A2 | 3/2013 |
| WO | WO 2013/032829 A1 | 3/2013 |
| WO | WO 2013/033438 A2 | 3/2013 |
| WO | WO 2013/033563 A1 | 3/2013 |
| WO | WO 2013/033620 A1 | 3/2013 |
| WO | WO 2013/038375 A2 | 3/2013 |
| WO | WO 2013/039857 A2 | 3/2013 |
| WO | WO 2013/039861 A2 | 3/2013 |
| WO | WO 2013/044219 A1 | 3/2013 |

(56) References Cited

FOREIGN PATENT DOCUMENTS

| | | |
|---|---|---|
| WO | WO 2003/029401 A2 | 4/2013 |
| WO | WO 2012/045075 A1 | 4/2013 |
| WO | WO 2013/045505 A1 | 4/2013 |
| WO | WO 2013/049234 A2 | 4/2013 |
| WO | WO 2013/049247 A1 | 4/2013 |
| WO | WO 2013/049328 A1 | 4/2013 |
| WO | WO 2013/052167 A2 | 4/2013 |
| WO | WO 2013/052523 A1 | 4/2013 |
| WO | WO 2013/054307 A2 | 4/2013 |
| WO | WO 2013/055331 A1 | 4/2013 |
| WO | WO 2013/055905 A1 | 4/2013 |
| WO | WO 2013/055971 A1 | 4/2013 |
| WO | WO 2013/056132 A2 | 4/2013 |
| WO | WO 2013/057687 A2 | 4/2013 |
| WO | WO 2013/057715 A1 | 4/2013 |
| WO | WO 2013/059496 A1 | 4/2013 |
| WO | WO 2013/059509 A1 | 4/2013 |
| WO | WO 2013/059922 A1 | 5/2013 |
| WO | WO 2013/061208 A1 | 5/2013 |
| WO | WO 2013/062140 A1 | 5/2013 |
| WO | WO 2013/063468 A1 | 5/2013 |
| WO | WO 2013/063530 A2 | 5/2013 |
| WO | WO 2013/064911 A2 | 5/2013 |
| WO | WO 2013/066274 A1 | 5/2013 |
| WO | WO 2013/066427 A1 | 5/2013 |
| WO | WO 2013/066866 A1 | 5/2013 |
| WO | WO 2013/066903 A1 | 5/2013 |
| WO | WO 2013/067355 A1 | 5/2013 |
| WO | WO 2013/067530 A2 | 5/2013 |
| WO | WO 2013/067537 A1 | 5/2013 |
| WO | WO 2013/068413 A1 | 5/2013 |
| WO | WO 2013/068431 A1 | 5/2013 |
| WO | WO 2013/068432 A1 | 5/2013 |
| WO | WO 2013/068847 A2 | 5/2013 |
| WO | WO 2013/070653 A1 | 5/2013 |
| WO | WO 2013/070872 A2 | 5/2013 |
| WO | WO 2013/071047 A1 | 5/2013 |
| WO | WO 2013/072392 A1 | 5/2013 |
| WO | WO 2013/072929 A2 | 5/2013 |
| WO | WO 2013/074696 A1 | 5/2013 |
| WO | WO 2013/075068 A2 | 5/2013 |
| WO | WO 2013/077907 A1 | 5/2013 |
| WO | WO 2013/078199 A2 | 5/2013 |
| WO | WO 2013/079604 A1 | 6/2013 |
| WO | WO 2013/082111 A2 | 6/2013 |
| WO | WO 2013/082418 A1 | 6/2013 |
| WO | WO 2013/082427 A1 | 6/2013 |
| WO | WO 2013/082470 A1 | 6/2013 |
| WO | WO 2013/082529 A1 | 6/2013 |
| WO | WO 2013/082590 A1 | 6/2013 |
| WO | WO 2013/084000 A2 | 6/2013 |
| WO | WO 2013/085951 A1 | 6/2013 |
| WO | WO 2013/086008 A1 | 6/2013 |
| WO | WO 2013/086322 A1 | 6/2013 |
| WO | WO 2013/086354 A1 | 6/2013 |
| WO | WO 2013/086373 A1 | 6/2013 |
| WO | WO 2013/086486 A1 | 6/2013 |
| WO | WO 2013/086502 A1 | 6/2013 |
| WO | WO 2013/086505 A1 | 6/2013 |
| WO | WO 2013/086526 A1 | 6/2013 |
| WO | WO 2013/087083 A1 | 6/2013 |
| WO | WO 2013/087791 A1 | 6/2013 |
| WO | WO 2013/087911 A1 | 6/2013 |
| WO | WO 2013/087912 A1 | 6/2013 |
| WO | WO 2013/088250 A1 | 6/2013 |
| WO | WO 2013/090186 A1 | 6/2013 |
| WO | WO 2013/090294 A1 | 6/2013 |
| WO | WO 2013/090601 A2 | 6/2013 |
| WO | WO 2013/090648 A1 | 6/2013 |
| WO | WO 2013/090841 A2 | 6/2013 |
| WO | WO 2013/090861 A1 | 6/2013 |
| WO | WO 2013/090897 A1 | 6/2013 |
| WO | WO 2013/091001 A1 | 6/2013 |
| WO | WO 2013/093648 A2 | 6/2013 |
| WO | WO 2013/096626 A1 | 6/2013 |
| WO | WO 2013/096812 A1 | 6/2013 |
| WO | WO 2013/098589 A1 | 7/2013 |
| WO | WO 2013/102203 A1 | 7/2013 |
| WO | WO 2013/103659 A1 | 7/2013 |
| WO | WO 2013/103842 A1 | 7/2013 |
| WO | WO 2013/109713 A1 | 7/2013 |
| WO | WO 2013/112778 A1 | 8/2013 |
| WO | WO 2013/112780 A1 | 8/2013 |
| WO | WO 2013/113326 A1 | 8/2013 |
| WO | WO 2013/113501 A1 | 8/2013 |
| WO | WO 2013/113502 A1 | 8/2013 |
| WO | WO 2013/113736 A1 | 8/2013 |
| WO | WO 2013/120497 A1 | 8/2013 |
| WO | WO 2013/120629 A1 | 8/2013 |
| WO | WO 2013/128027 A1 | 9/2013 |
| WO | WO 2013/130161 A1 | 9/2013 |
| WO | WO 2013/130535 A1 | 9/2013 |
| WO | WO 2013/135359 A1 | 9/2013 |
| WO | WO 2013/136234 A1 | 9/2013 |
| WO | WO 2013/138343 A1 | 9/2013 |
| WO | WO 2013/138346 A1 | 9/2013 |
| WO | WO 2013/142349 A1 | 9/2013 |
| WO | WO 2013/143555 A1 | 10/2013 |
| WO | WO 2013/143683 A1 | 10/2013 |
| WO | WO 2013/143698 A1 | 10/2013 |
| WO | WO 2013/143699 A1 | 10/2013 |
| WO | WO 2013/143700 A2 | 10/2013 |
| WO | WO 2013/148186 A1 | 10/2013 |
| WO | WO 2013/148541 A1 | 10/2013 |
| WO | WO 2013/149141 A1 | 10/2013 |
| WO | WO 2013/151650 A1 | 10/2013 |
| WO | WO 2013/151669 A1 | 10/2013 |
| WO | WO 2013/151672 A2 | 10/2013 |
| WO | WO 2013/151771 A1 | 10/2013 |
| WO | WO 2013/152351 A2 | 10/2013 |
| WO | WO 2013/153550 A2 | 10/2013 |
| WO | WO 2013/154766 A1 | 10/2013 |
| WO | WO 2013/154774 A1 | 10/2013 |
| WO | WO 2013/155487 A1 | 10/2013 |
| WO | WO 2013/155493 A9 | 10/2013 |
| WO | WO 2013/155513 A1 | 10/2013 |
| WO | WO 2013/158127 A1 | 10/2013 |
| WO | WO 2013/158141 A1 | 10/2013 |
| WO | WO 2013/158579 A1 | 10/2013 |
| WO | WO-2013151666 A2 | 10/2013 |
| WO | WO-2013151736 A2 | 10/2013 |
| WO | WO 2013/166385 A1 | 11/2013 |
| WO | WO 2013/166498 A1 | 11/2013 |
| WO | WO 2013/173582 A1 | 11/2013 |
| WO | WO 2013/173657 A1 | 11/2013 |
| WO | WO 2013/173693 A1 | 11/2013 |
| WO | WO 2013/174409 A1 | 11/2013 |
| WO | WO 2013/177421 A2 | 11/2013 |
| WO | WO 2013/182683 A1 | 12/2013 |
| WO | WO 2013/184945 A1 | 12/2013 |
| WO | WO 2013/185069 A1 | 12/2013 |
| WO | WO 2013/188979 A1 | 12/2013 |
| WO | WO 2014/004436 A2 | 1/2014 |
| WO | WO 2014/007398 | 1/2014 |
| WO | WO 2014/012479 A1 | 1/2014 |
| WO | WO 2014/012994 A1 | 1/2014 |
| WO | WO 2014/012996 A1 | 1/2014 |
| WO | WO 2014/014613 A2 | 1/2014 |
| WO | WO 2014/014890 A1 | 1/2014 |
| WO | WO 2014/015334 A1 | 1/2014 |
| WO | WO 2014/015422 A1 | 1/2014 |
| WO | WO 2014/016439 A1 | 1/2014 |
| WO | WO 2014/018675 A1 | 1/2014 |
| WO | WO 2014/024193 A1 | 2/2014 |
| WO | WO 2014/025312 A1 | 2/2014 |
| WO | WO 2014/025795 A1 | 2/2014 |
| WO | WO 2014/025890 A1 | 2/2014 |
| WO | WO 2014/026044 A2 | 2/2014 |
| WO | WO 2014/026284 A1 | 2/2014 |
| WO | WO 2014/027006 A1 | 2/2014 |
| WO | WO 2014/028209 A1 | 2/2014 |
| WO | WO 2014/028487 A1 | 2/2014 |
| WO | WO 2014/028763 A1 | 2/2014 |
| WO | WO 2014/039185 A1 | 3/2014 |

(56) References Cited

FOREIGN PATENT DOCUMENTS

| | | |
|---|---|---|
| WO | WO 2014/042920 A1 | 3/2014 |
| WO | WO 2014/043618 A1 | 3/2014 |
| WO | WO 2014/047649 A1 | 3/2014 |
| WO | WO 2014/052634 A1 | 4/2014 |
| WO | WO 2014/053622 A1 | 4/2014 |
| WO | WO 2014/053624 A1 | 4/2014 |
| WO | WO 2014/053628 A1 | 4/2014 |
| WO | WO 2014/053629 A1 | 4/2014 |
| WO | WO 2014/053634 A1 | 4/2014 |
| WO | WO 2014/053654 A1 | 4/2014 |
| WO | WO 2014/053879 A1 | 4/2014 |
| WO | WO 2014/053880 A1 | 4/2014 |
| WO | WO 2014/053881 A1 | 4/2014 |
| WO | WO 2014/053882 A1 | 4/2014 |
| WO | WO 2014/054026 A1 | 4/2014 |
| WO | WO 2014/059022 A1 | 4/2014 |
| WO | WO 2014/062697 A2 | 4/2014 |
| WO | WO 2014/063059 A1 | 4/2014 |
| WO | WO 2014/064258 A1 | 5/2014 |
| WO | WO 2014/064534 A2 | 5/2014 |
| WO | WO 2014/064543 A1 | 5/2014 |
| WO | WO 2014/064687 A1 | 5/2014 |
| WO | WO 2014/066811 A1 | 5/2014 |
| WO | WO 2014/066898 A9 | 5/2014 |
| WO | WO 2014/066912 A1 | 5/2014 |
| WO | WO 2014/067551 A1 | 5/2014 |
| WO | WO 2014/068542 A1 | 5/2014 |
| WO | WO 2014/071072 A2 | 5/2014 |
| WO | WO 2014/071219 A1 | 5/2014 |
| WO | WO 2014/071963 A1 | 5/2014 |
| WO | WO 2014/072061 A1 | 5/2014 |
| WO | WO 2014/072468 A1 | 5/2014 |
| WO | WO 2014/072481 A1 | 5/2014 |
| WO | WO 2014/072747 A1 | 5/2014 |
| WO | WO 2014/072997 A1 | 5/2014 |
| WO | WO 2014/072999 A1 | 5/2014 |
| WO | WO 2014/074218 A1 | 5/2014 |
| WO | WO 2014/074289 A1 | 5/2014 |
| WO | WO 2014/074299 A1 | 5/2014 |
| WO | WO 2014/074597 A1 | 5/2014 |
| WO | WO 2014/074823 A1 | 5/2014 |
| WO | WO 2014/074905 A1 | 5/2014 |
| WO | WO 2014/074912 A1 | 5/2014 |
| WO | WO 2014/075047 A2 | 5/2014 |
| WO | WO 2014/076709 A1 | 5/2014 |
| WO | WO 2014/078399 A1 | 5/2014 |
| WO | WO 2014/078636 A1 | 5/2014 |
| WO | WO 2014/081299 A1 | 5/2014 |
| WO | WO 2014/081300 A1 | 5/2014 |
| WO | WO 2014/081303 A1 | 5/2014 |
| WO | WO 2014/081507 A1 | 5/2014 |
| WO | WO 2014/081849 A1 | 5/2014 |
| WO | WO 2014/089486 A1 | 6/2014 |
| WO | WO 2014/108515 A1 | 7/2014 |
| WO | WO 2014/127917 A1 | 8/2014 |
| WO | WO 2014/140211 A1 | 9/2014 |
| WO | WO 2014/144196 A1 | 9/2014 |
| WO | WO 2014/152774 A1 | 9/2014 |
| WO | WO 2014/152940 A1 | 9/2014 |
| WO | WO-2014152513 A1 | 9/2014 |
| WO | WO-2014152540 A1 | 9/2014 |
| WO | WO 2014/172045 A1 | 10/2014 |
| WO | WO 2011/136368 | 11/2014 |
| WO | WO 2014/182661 A2 | 11/2014 |
| WO | WO 2014/210356 A1 | 12/2014 |
| WO | WO 2015/011633 A1 | 1/2015 |
| WO | WO 2015/023461 A1 | 2/2015 |
| WO | WO 2015/024668 A2 | 2/2015 |
| WO | WO 2015/024669 A1 | 2/2015 |
| WO | WO-2015051214 A1 | 4/2015 |
| WO | WO 2015/148247 A1 | 10/2015 |
| WO | WO 2015/154002 A1 | 10/2015 |
| WO | WO-2015164778 A1 | 10/2015 |
| WO | WO 2015/199952 A1 | 12/2015 |
| WO | WO 2016/004202 A1 | 1/2016 |
| WO | WO 2016/004318 A1 | 1/2016 |
| WO | WO 2016/118697 A1 | 7/2016 |
| WO | WO 2016/118724 A1 | 7/2016 |
| WO | WO 2016/164762 A1 | 10/2016 |
| WO | WO 2016/176330 A1 | 11/2016 |
| WO | WO 2017/015630 A2 | 1/2017 |
| WO | WO 2017/031232 A1 | 2/2017 |
| WO | WO 2017/049245 A2 | 3/2017 |
| WO | WO 2017/099823 A1 | 6/2017 |
| WO | WO 2017/112865 A1 | 6/2017 |
| WO | WO 2017/127750 A1 | 7/2017 |
| WO | WO 2017/180917 A2 | 10/2017 |
| WO | WO 2017/192470 A1 | 11/2017 |
| WO | WO 2017/201317 A1 | 11/2017 |
| WO | WO 2017/201325 A1 | 11/2017 |
| WO | WO 2017/201333 A1 | 11/2017 |
| WO | WO 2017/201340 A2 | 11/2017 |
| WO | WO 2017/201347 A1 | 11/2017 |
| WO | WO 2017/201350 A1 | 11/2017 |
| WO | WO 2017/218704 A1 | 12/2017 |
| WO | WO 2018/170306 A1 | 9/2018 |
| WO | WO 2018/170336 A1 | 9/2018 |

OTHER PUBLICATIONS

Brookes, L., "Antisense Drug ISIS 301012 Lowers LDL Cholesterol Alone and in Combination with Statins," in Medscape on Jun. 12, 2007, 4 pages.

Calkin, A.C., et al., "FERM-Dependent E3 Ligase Recognition is a Conserved Mechanism for Targeted Degradation of Lipoprotein Receptors," Proceedings of the National Academy of Sciences of the USA 108(50):20107-20112, National Academy of Sciences, United States (2011).

Canuel, M., et al., "Proprotein Convertase Subtilisin/Kexin Type 9 (PCSK9) Can Mediate Degradation of the Low Density Lipoprotein Receptor-Related Protein 1 (LRP-1)," PLoS ONE 8(5):e64145, Public Library of Science, United States (2013).

Chen, Y., et al., "Role of ubiquitination in PCSK9-mediated low-density lipoprotein receptor degradation," Biochemical and Biophysical Research Communications 415(3):515-518, Elsevier, United States (2011).

Corder, E.H., et al., "Protective Effect of Apolipoprotein E Type 2 Allele for Late Onset Alzheimer Disease," Nature Genetics 7(2):180-184, Nature Pub. Co, United States (1994).

Daniels, T.F., et al., "Lipoproteins, Cholesterol Homeostasis and Cardiac Health," International Journal of Biological Sciences 5(5):474-488, Ivyspring International, Australia (2009).

Degoma, E.M. and Rader, D.J., "Novel HDL-Directed Pharmacotherapeutic Strategies," Nature Reviews. Cardiology 8(5):266-277, Nature Publishing Group, England (2011).

European Nucleotide Archive "*Homo sapiens* cDNA FLJ50622 complete cds, highlight similar to Low-density lipoprotein receptor precursor," Database Accession No. AK299038.1, last updated Jul. 24, 2008, 2 pages.

Fotin-Mleczek, M., et al., "Messenger RNA-Based Vaccines with Dual Activity Induce Balanced TLR-7 Dependent Adaptive Immune Responses and Provide Antitumor Activity," Journal of Immunotherapy 34(1):1-15, Informa Healthcare, England (2011).

Frank-Kamenetsky, M., et al., "Therapeutic RNAi Targeting PCSK9 Acutely Lowers Plasma Cholesterol in Rodents and LDL Cholesterol in Nonhuman Primates," Proceedings of the National Academy of Sciences USA 105(33):11915-11920, National Academy of Sciences, United States (2008) with Supporting Information.

Gu, H.M., et al, "Characterization of the Role of EGF-A of Low Density Lipoprotein Receptor in PCSK9 Binding," Journal of Lipid Research 54(12):3345-3357, American Society for Biochemistry and Molecular Biology, United States (2013).

Hu, Z., "Hormonal Regulation of MicroRNA Expression in Steroid Producing Cells of the Ovary, Testis and Adrenal Gland," PLoS One 8(10):e78040, Public Library of Science, United States (2013).

International Search Report for International Application No. PCT/US2014/058967, European Patent Office, Netherlands, dated Feb. 3, 2015, 8 pages.

(56) References Cited

OTHER PUBLICATIONS

Kandimalla, E.R., et al., "Design, Synthesis and Biological Evaluation of Novel Antagonist Compounds of Toll-Like Receptors 7, 8 and 9," Nucleic Acids Research 41(6):3947-3961, Oxford University Press, England (2013).
Kassim, S.H., et al., "Gene Therapy in a Humanized Mouse Model of Familial Hypercholesterolemia Leads to Marked Regression of Atherosclerosis," PLoS One 5(10):e13424,Public Library of Science, United States (2010).
Kormann, M.S., et al., "Expression of therapeutic proteins after delivery of chemically modified mRNA in mice," Nature Biotechnology 29(2):154-157, Nature America Publishing, United States (2011).
Kosenko, T., et al., "Low Density Lipoprotein Binds to Proprotein Convertase Subtilisin/kexin Type-25139 (PCSK9) in Human Plasma and Inhibits PCSK9-mediated Low Density Lipoprotein Receptor Degradation," The Journal of Biological Chemistry 288(12):8279-8288, American Society for Biochemistry and Molecular Biology, United States (2013).
Kwon, H.J., et al., "Molecular Basis for LDL Receptor Recognition by PCSK9," Proceedings of the National Academy of Sciences of the United States of America 105(6):1820-1825, National Academy of Sciences, United States (2008).
Liu, C.C., et al., "Apolipoprotein E and Alzheimer disease: Risk, Mechanisms and Therapy," Nature reviews. Neurology 9(2):106-118, Nature Publishing Group, England (2013).
Matsui, M., et al., "Activation of LDL Receptor Expression by Small RNAs Complementary to a Noncoding Transcript That Overlaps the LDLR Promoter," Chemistry & Biology 17(12):1344-1355, Elsevier, United States (2010).
Maxwell, K.N. and Breslow, J.L., "Adenoviral-mediated Expression of Pcsk9 in Mice Results in a Low-density Lipoprotein Receptor Knockout Phenotype," Proceedings of the National Academy of Sciences of the United States of America 101(18):7100-7105, National Academy of Sciences, United States (2004).
Mcnutt, M.C., et al., "Antagonism of Secreted PCSK9 Increases Low Density Lipoprotein Receptor Expression in HepG2 Cells," The Journal of biological chemistry 284(16):10561-10570, American Society for Biochemistry and Molecular Biology, United States (2009) with Supplemental Data.
Musacchio, T. and Torchilin, V.P., "Recent Developments in Lipid-Based Pharmaceutical Nanocarriers," Frontiers in Bioscience 16:1388-1412, Frontiers in Bioscience, United States (2011).
Musunuru, K., et al., "From Noncoding Variant to Phenotype Via SORT1 at the 1p13 Cholesterol Locus," Nature 466(7307):714-719, Nature Publishing Group, England (2010).
NCBI Blast, Accession No. 6E136127.1, Retrieved from https://www.ncbi.nlm.nih.gov/nucest/8598627, 2007.
Ni, Y.G., et al., "A PCSK9-Binding Antibody that Structurally Mimics the Egf(A) Domain of LDL-Receptor Reduces LDL Cholesterol in Vivo," Journal of Lipid Research 52(1):78-86, American Society for Biochemistry and Molecular Biology, United States (2011).
Nissen, S.E., et al., "Effect of Recombinant ApoA-I Milano on Coronary Atherosclerosis in Patients With Acute Coronary Syndromes: a Randomized Controlled Trial," JAMA 290(17):2292-2300, American Medical Association, United States (2003).
Office Action dated Aug. 18, 2014, in U.S. Appl. No. 14/135,887, Hoge, S.G., et al., filed Dec. 20, 2013.
Office Action dated Feb. 16, 2016, in U.S. Appl. No. 14/454,977, Hoge, S.G., et al., filed Aug. 8, 2014.
Office Action dated Mar. 2, 2015, in U.S. Appl. No. 14/454,977, Hoge, S.G., et al., filed Aug. 8, 2014.
Office Action dated Mar. 6, 2014, in U.S. Appl. No. 14/135,887, Hoge, S.G., et al., filed Dec. 20, 2013.
Santi, D.V., "Mechanistic Studies of RNA Modifying Enzymes RNA Pseudouridine Synthase and m5Cytosine Methyl Transferase," Nucleic Acids Symposium Series 44:147-148, Oxford University Press, England (2000).
Semple, S.C., et al., "Rational Design of Cationic Lipids for siRNA Delivery," Nature Biotechnology 28(2):172-176, Nature America Publishing, United States (2010).
Seripa, D., et al., "The Genetics of the Human APOE Polymorphism," Rejuvenation Research 14(5):491-500, Mary Ann Liebert Inc, United States (2011).
Somanathan, S., et al., "AAV Vectors Expressing LDLR Gain-of-Function Variants Demonstrate Increased Efficacy in Mouse Models of Familial Hypercholesterolemia," Circulation Research 115(6):591-599, Lippincott Williams & Wilkins, United States (2014) and including Supplemental Methods.
Song, K.H., et al., "A Putative Role of Micro RNA in Regulation of Cholesterol 7Alpha-Hydroxylase Expression in Human Hepatocytes," Journal of Lipid Research 51(8):2223-2233, American Society for Biochemistry and Molecular Biology, United States (2010).
Sorrentino, V., et al., "Distinct Functional Domains Contribute to Degradation of the Low Density Lipoprotein Receptor (LDLR) by the E3 Ubiquitin Ligase Inducible Degrader of the LDLR (IDOL)," The Journal of Biological Chemistry 286(34):30190-30199, American Society for Biochemistry and Molecular Biology, United States (2011).
Strom, T.B., et al., "Disrupted Recycling of the Low Density Lipoprotein Receptor by PCSK9 Is Not Mediated by Residues of the Cytoplasmic Domain," Molecular Genetics and Metabolism 101(1):76-80, Academic Press, United States (2010).
Supplemental Information in Zelcer, N., et al., "LXR Regulates Cholesterol Uptake through Idol-Dependent Ubiquitination of the LDL Receptor," Science 325(5936):100-104, American Association for the Advancement of Science, United States (2009).
Van Der Westhuyzen, D.R., "Deletion of Two Growth-factor Repeats from the Low-density-lipoprotein Receptor Accelerates its Degradation," Biochemical Journal 277(Pt 3):677-682, Portland Press on behalf of the Biochemical Society (1991).
Wasan, K.M., et al., "Impact of Lipoproteins on the Biological Activity and Disposition of Hydrophobic Drugs: Implications for Drug Discovery," Nature Reviews. Drug discovery 7(1):84-99, Nature Publishing Group, England (2008).
Wheeler, J.J., et al., "Stabilized Plasmid-Lipid Particles: Construction and Characterization," Gene Therapy 6(2):271-281, Nature Publishing Group, England (1999).
Wolff, J.A., et al., "Direct Gene Transfer into Mouse Muscle in Vivo," Science 247(4949Pt1):1465-1468, American Association for the Advancement of Science, United States (1990).
Wyatt, G.R., "Occurrence of 5-methylcytosine in nucleic acids," Nature 166(4214):237-238, Nature Publishing Group, England (1950).
Yamamoto, T., et al., "A Two-step Binding Model of PCSK9 Interaction with the Low Density Lipoprotein Receptor," The Journal of Biological Chemistry 286(7):5464-5470, American Society for Biochemistry and Molecular Biology, United States (2011).
Zelcer, N., et al., "LXR Regulates Cholesterol Uptake through Idol-Dependent Ubiquitination of the LDL Receptor," Science 325(5936):100-104, American Association for the Advancement of Science, United States (2009).
Zhang, D.W., et al., "Binding of Proprotein Convertase Subtilisin/Kexin Type 9 to Epidermal Growth Factor-Like Repeat a of Low Density Lipoprotein Receptor Decreases Receptor Recycling and increases Degradation," The Journal of Biological Chemistry 282(25):18602-18612, American Society for Biochemistry and Molecular Biology, United States (2007) with Supplemental Material.
Zhang, D.W., et al., "Structural requirements for PCSK9-mediated degradation of the low-density lipoprotein receptor," Proceedings of the National Academy of Sciences of the United States of America 105(35):13045-13050, National Academy of Sciences, United States (2008).
Zhang, L., et al., "Self-Assembled Lipid—Polymer Hybrid Nanoparticles: a Robust Drug Delivery Platform," ACS Nano 2(8):1696-1702, Nature Publishing Group, England (2008).
Zhang, Y., et al., "Calcium-independent Inhibition of PCSK9 by Affinity-improved Variants of the LDL Receptor EGF(A) Domain," Journal of Molecular Biology 422(5):685-696, Elsevier, England (2012).

(56) References Cited

OTHER PUBLICATIONS

Zhang, Y.P., et al., "Stabilized Plasmid-Lipid Particles for Regional Gene Therapy: Formulation and Transfection Properties," Gene Therapy 6(8):1438-1447, Nature Publishing Group, England (1999).
Zhi, Y.F., "Hypermethylation in Promoter Area of LDLR Gene in Atherosclerosis Patients," Fen Zi Xi Bao Sheng Wu Xue Bao 40(6):419-427, Shanghai ke xue ji shu chu ban she, China (2007).
[no. Author Listed], "Messenger Rna", Internet: Wikipedia. 19 Jun. 2013, XP002699196, Retrieved from the Internet: Url: http://en.wikipedia.org/wiki/Messenger Rna.
[no. Author Listed], GenBank: Homo sapiens 15 kDa selenoprotein (Sep 15), transcript variant 1, mRNA. NCBI
Argininosuccinate synthetase; argininosuccinate synthetase, isoform CRA_b {Homo sapiens} NCBI, Dec. 18, 2006, No vol., pp. 1-3, http://www.ncbi.nlm.nih.gov/protein/119608339.
Aasen, T. et al., Efficient and rapid generation of induced pluripotent stem cells from human keratinocytes. Nat Biotechnol. Nov. 2008; 26(11 ): 1276-1284.
Abramova, Tatyana, Frontiers and Approaches to Chemical Synthesis of Oligodeoxyribonucleotides, Molecules 2013, vol. 57, No. 18, 1063-1075.
Abuchowski, A. et al., Immunosuppressive properties and circulating life of Achromobacter glutaminase-asparaginase covalently attached to polyethylene glycol in man. Cancer Treat Rep. Nov.-Dec. 1981;65(11-12):1077-81.
Abuchowski, A. et al., Reduction of plasma urate levels in the cockerel with polyethylene glycol-uricase. J Pharmacol Exp Ther. Nov. 1981;219(2):352-4.
Agadjanyan, M., Prototype Alzheimer's Disease Vaccine Using the Immunodominant B Cell Type from Beta-Amyloid and Promiscuous T Cell Epitope Pan HLA DR-Binding Peptide, J Immunol, 2005, vol. 174, No. 3, pp. 1580-1586.
Agaisse, H. et al., STAB-SD: a Shine-Dalgarno sequence in the 5' untranslated region is a determinant of mRNA stability. Mol Microbiol. May 1996;20(3):633-43.
Aissani, B. et al., CpG islands, genes and isochores in the genomes of vertebrates. Gene. Oct. 15, 1991;106 (2):185-95.
Akashi, H., Gene expression and molecular evolution. Curr Opin Genet Dev. Dec. 2001;11(6):660-666.
Akinc et al., Targeted Delivery of RNAi Therapeutics With Endogenous and Exogenous Ligand-Based Mechanisms, Mol Ther. 2009 17:872-879.
Alberts, et al., Molecular Biology of the Cell, 3rd ed. Garland Publishing, Inc. New York, NY, 1994, pp. 368-9.
Aleku, M., et al., Atu027, a liposomal small interfering RNA formulation targeting protein kinase N3, inhibits cancer progression. Cancer Res. 2008; 68: 9788-9798.
Alfonso, Mauro et al., An Anti-Idiotype Vaccine Elicits a Specific Response to N-Glycolyl Sialic Acid Residues of Glycoconjugates in Melanoma Patients, The Journal of Immunology, 2002, vol. 168, No#, pp. 3523-2529.
Alten, Rieke et al., The Human Anti-IL-1β Monoclonal Antibody ACZ885 is Effective in Joint Inflammation Models in Mice and in a Proof-of-Concept Study in Patients with Rheumatoid Arthritis, Arthritis Research & Therapy, 2008, vol. 10, No. 3, pp. 1-9.
Alonso, Ruby et al., Towards the Definition of a Chimpanzee and Human Conserved CD6 Domain 1 Epitope Recognized by T1 Monoclonal Antibody, Hybridoma, 2008, vol. 27, No. 4, pp. 291-301.
Anderson, B.R., et al., Incorporation of pseudouridine into mRNA enhances translation by diminishing PKR activation, Nucleic Acids Res. vol. 38, No. 17, Sep. 1, 2010, pp. 5884-5892.
Anderson, B.R., et al., Nucleoside modifications in RNA limit activation of 2'-5'oligoadenylate synthetase and increase resistance to cleavage by Rnase L. Nucleic Acids Res. 2011; No vol., 1-10.
Anderson, D.M. et al., Stability of mRNA/cationic lipid lipoplexes in human and rat cerebrospinal fluid: methods and evidence for nonviral mRNA gene delivery to the central nervous system. Hum Gene Ther. Feb. 10, 2003;14(3):191-202.
Anderson, et al. The Bridge, National Academy of Engineering of the National Academies, Fall 2006, vol. 36., No. 3, pp. 1-55.
Andrews-Pfannkoch, C. et al., Hydroxyapatite-mediated separation of double-stranded DNA, single-stranded DNA, and RNA genomes from natural viral assemblages. Appl Environ Microbiol. Aug. 2010;76(15):5039-45. Epub Jun. 11, 2010.
Andries, O., et al., Comparison of the gene transfer efficiency of mRNA/GL67 and pDNA/GL67 complexes in respiratory cells. Mol Pharmaceutics. 2012; 9: 2136-2145.
Angevin, Eric et al., A Phase 1/11, Multiple-Dose, Dose-Escalation Study of Siltuximab, an Anti-Interleukin-6 Monoclonal Antibody, in Patients with Advanced Solid Tumors, Clinical Cancer Research, 2014, vol. 20, No. 8, pp. 1-14.
Anichini, A. et al., Cytotoxic T cells directed to tumor antigens not expressed on normal melanocytes dominate HLA- A2.1-restricted immune repertoire to melanoma. J Immunol. Jan. 1, 1996;156(1):208-17.
AO1' T. et al., Generation of pluripotent stem cells from adult mouse liver and stomach cells. Science. Aug. 1, 2008; 321 (5889): 699-702.
Aota, S. et al., Diversity in G + C content at the third position of codons in vertebrate genes and its cause. Nucleic Acids Res. Aug. 26, 1986;14(16):6345-55.
Apostolopoulos, V. et al., Cellular mucins: targets for immunotherapy. Crit Rev Immunol. 1994;14(3&4):293-309.
Apostolopoulos, Vasso et al. , Targeting Antigens to Dendritic Cell Receptors for Vaccine Development, Hindawi Publishing Corporation Journal of Drug Delivery, 2013, vol. 201, Article ID 869718, pp. 1-22.
Arce-Fonseca, Minerva et al., Specific Humoral and Cellular Immunity Induced by Trypanosoma cruzi DNA Immunization in a Canine Model, Veterinary Research, 2013, vol. 44, No. 15, pp. 2-9.
Archer, S.J., Induction of a T-cell specific antigen on bone marrow lymphocytes with thymus RNA. Immunology. Jan. 1978;34(1):123-9.
Armstrong, Deborah, et al., Farletuzumab (MORAb-003) in platinum-sensitive ovarian cancer patients experiencing a first relapse, Community Oncology, 2010, vol. 7, No. 2, Supp 1., pp. 1-4.
Ashley, D.M. et al., Bone marrow-generated dendritic cells pulsed with tumor extracts or tumor RNA induce antitumor immunity against central nervous system tumors. J Exp Med. Oct. 6, 1997;186(7):1177-82.
Ast, G., How did alternative splicing evolve? Nat Rev Genet. Oct. 2004;5(10):773-82.
Aurup, H. et al., Translation of 2'-modified mRNA in vitro and in vivo. Nucleic Acids Res. Nov. 25, 1994;22(23):4963-8.
Austyn, J.M. et al., New insights into the mobilization and phagocytic activity of dendritic cells. J Exp Med. Apr. 1, 1996;183(4):1287-92.
Baars, A. et al., A Phase II Study of Active Specific Immunotherapy and 5-FU/Leucovorin as Adjuvant Therapy for Stage III Colon Carcinoma, British Journal of Cancer, 2002, vol. 86, No. 8, pp. 1230-1234.
Babich, F.R. et al., Cross-species transfer of learning: effect of ribonucleic acid from hamsters on rat behavior. Proc Natl Acad Sci U S A. Nov. 1965;54(5):1299-302.
Bachellerie, J.P. et al., Antisense snoRNAs: a family of nucleolar RNAs with long complementarities to rRNA. Trends Biochem Sci. Jul. 1995;20(7):261-4.
Badawi, Ahmed, et al. , Immune Modulating Peptide for the Treatment and Suppression of Multiple Sclerosis, Clin Immunol, 2012, vol. 144, No. 2, pp. 127-138.
Badis, G. et al., A snoRNA that guides the two most conserved pseudouridine modifications within rRNA confers a growth advantage in yeast. RNA. Jul. 2003; 9(7): 771-779.
Baeten, Dominique et al., Anti-interleukin-17 A monoclonal antibody secukinumab in treatment of ankylosing spondylitis: a randomised, double-blind, placebo-controlled trial, The Lancet, 2013, vol. 382, No#, pp. 1705-1713.
Bag, J., Recovery of normal protein synthesis in heat-shocked chicken myotubes by liposome-mediated transfer of mRNAs. Can. J. Biochem. Cell Biol. 1985; 63(3): 231235.
Bagnall, et al., Rat strain differences on performance in the Morris water maze. Animal Technology, 1999, 50 (2):69-77.

(56) References Cited

OTHER PUBLICATIONS

Bai, D.L. et al Huperzine A, A Potential Therapeutic Agent for Treatment of Alzheimer's Disease, Current Medicinal Chemistry, 2000, vol. 7, No. 3, pp. 355-374.
Bain, J.D. et al., Regioselective ligation of oligoribonucleotides using DNA Splints, Nucleic Acids Research, vol. 20, No. 16, p. 4372.
Baker, D.L. et al., RNA-guided RNA modification: functional organization of the archaeal H/ACA RNP. Genes Dev. May 15, 2005;19(10):1238-48. Epub May 3, 2005.
Baker, Kevin P. et al., Generation and Characterization of LymphoStat-B, a Human Monoclonal Antibody That Antagonizes the Bioactivities of B Lymphocyte Stimulator, Arthritis & Rheumatism, 2003, vol. 48, No. 11, pp. 3253-3265.
Bakker, J.M. et al, Therapeutic antibody gene transfer: an active approach to passive immunity. Mol Ther. Sep. 2004;10(3):411-6.
Balakin, A.G. et al., The RNA world of the nucleolus: two major families of small RNAs defined by different box elements with related functions. Cell. Sep. 6, 1996;86(5):823-34.
Balazs, Alejandro et al., Vectored Immunoprophylaxis Protects Humanized Mice from Mucosal HIV Transmission, Nature Medicine, 2014, vol. 3, pp. 296-300.
Ballatore, Carlo et al., Microtubule Stabilizing Agents as Potential Treatment for Alzheimer's Disease and Related Neurodegenerative Tauopathies, J. Med Chem., 2012, vol. 55, No. 21, pp. 8979-8996.
Batshaw, Mark L. et al., Risk of Serious Illness in Heterozygotes for Ornithine Transcarbamylase Deficiency, J. Pediatr, 1986, vol. 108, No. 2, pp. 236-241.
Batshaw, Mark L. et al., Treatment of Inborn Errors of Urea Synthesis, The New England Journal of Medicine, 1982, vol. 306, No. 23, pp. 1387-1392.
Bamias, Giorgos, et al., Leukocyte Traffic Blockage in inflammatory Bowel Disease, Current Drug Targets, 2013, vol. 14, No. 12, pp. 1490-1500.
Bandala-Sanchez, Esther et al., T cell Regulation Mediated by Interaction of Soluble CD52 with the Inhibitory Receptor Siglec-10, Nature Immunology, 2013, vol. 14, No. 7, pp. 741-751.
Bandbon Balenga, NA et al., Bicistronic expression plasmid encoding allergen and anti-IgE single chain variable fragment antibody as a novel DNA vaccine for allergy therapy and prevention. Med Hypotheses. 2006;67(1):71-4. Epub Mar. 2, 2006.
Banerjee, A.K., 5'-terminal cap structure in eukaryotic messenger ribonucleic acids. Microbiol Rev. Jun. 1980;44 (2):175-205.
Barber, R., The chromatographic separation of ribonucleic acids. Biochim Biophys Acta. Feb. 21, 1966;114(2):422-4.
Bargmann, C.I. et al., The neu oncogene encodes an epidermal growth factor receptor-related protein. Nature. Jan. 16-22, 1986;319(6050):226-30.
Barker, Edward, et al., Effect of a Chimeric Anti-Ganglioside GD2 Antibody on Cell-mediated Lysis of Human Neuroblastoma Cells, Cancer Research, 1991, vol. 51, No.#, pp. 144-149.
Barlow, P.G., et al., The human cathelicidin LL-37 preferentially promotes apoptosis of infected airway epithelium. Am J Respir Cell Mol Biol. Dec. 2010; 43(6): 692-702.
Barouch, Dan et al., Therapeutic Efficacy of Potent Neutralizing HIV-1-specific monoclonal Antibodies in SHIV-infected Rhesus Monkeys, Nature, 2013, vol. 503, No. 7475, pp. 224-8.
Barr, Ian et al., Epidemiological, Antigenic and Genetic Characteristics of Seasonal Influenza A(H1N1), A(H3N2) and B Influenza Virus: Basis for WHO Recommendation on the Competition of Influenza Vaccines for Using in the 2009-2010 Northern Hemisphere Season, Vaccine, 2010, vol. 28, pp. 1156-1167.
Basarkar, A. et al., Nanoparticulate systems for polynucleotide delivery. Int J Nanomedicine. 2007; 2(3): 353-360.
Basha, G, et al., Influence of cationic lipid composition on gene silencing properties of lipid nanoparticle formulations of siRNA in antigen-presenting cells. Mol Ther. Dec. 2011; 19(12): 2186-2200.
Bates et al., Detection of Familial Hypercholesterolaemia: A Major Treatment Gap in Preventative Cardiology, Heart, Lung and Circulation 2008;17:411-413.
Bechler, K., Influence of capping and polyadenylation on mRNA expression and on antisense RNA mediated inhibition of gene expression. Biochem Biophys Res Commun. Dec. 8, 1997;241(1):193-9.
Beigneux et al., Human CYP7A1 deficiency: progress and enigmas; The Journal of Clinical Investigation; Jul. 2002, vol. 110, No. 1, pp. 29-31.
Bekker, Pirow et al., The Effect of a Single Dose of Osteoprotegerin in Postmenopausal Women, Journal of Bone and Mineral Research, 2001, vol. 16, No. 2, pp. 348-360.
Bekker, Prow et al., A single-Dose Placebo-Controlled Study of AMG 162, a Fully Human Monoclonal Antibody to RANKL, in Postmenopausal Women, Journal of Bone and Mineral Research, 2004, vol. 19, No. 7, pp. 1059-1066.
Beljanski, et al., Iron stimulated RNA-dependent DNA polymerase activity from goldfish eggs. Cell Mol Biol. 1988;34 (1):17-25.
Bell et al., Predisposition to Cancer Caused by Genetic and Functional Defects of Mammalian Atad5, PLOS Genetics, Aug. 2011, vol. 7, Issue 8, e1002245 pp. 1-15.
Belliveau, N.M., et al., Microfluidic synthesis of highly potent limit-size lipid nanoparticles for in vivo delivery of siRNA. Mol Ther Nucleic Acids. Aug. 2012; 1(8): e37.
Bermudez et al., Treatment with Recombinant Granulocyte Colony-stimulating Factor (FilgrastinTM) Stimulates Neutrophils and Tissue macrophages and Induces an Effective non-specific Response Against Mycobacterium Avium in Mice, Immunology, 1998, vol. 94, No. 3, pp. 297-303.
Bernardi, G. et al.,The vertebrate genome: isochores and evolution. Mol Biol Evol. Jan. 1993;10(1):186-204.
Bernhard, H. et al., Generation of immunostimulatory dendritic cells from human CD34+ hematopoietic progenitor cells of the bone marrow and peripheral blood. Cancer Res. Mar. 1, 1995;55(5):1099-104.
Bernstein, E. et al., Role for a bidentate ribonuclease in the initiation step of RNA interference. Nature. Jan. 18, 2001;409(6818):363-6.
Bernstein, P. et al., Poly(A), poly(A) binding protein and the regulation of mRNA stability. Trends Biochem Sci. 198S Sep. ;14(9):373-7.
Bertolini, In vitro effect of 18S immune RNA on macrophage resistance to Trypanosoma cruzi. Cell Mol Biol. 1986;32(2):167-71.
Bertolini, M.C., et al., Fractionation of immune RNA isolated from the spleens of mice infected with Trypanosoma cruzi. J Infect Dis. Jun. 1981;143(6):827-31.
Bertolini, The protective effect of the 4-5S immune RNA against Trypanosoma cruzi infectionin mice. Trop Med Parasitol. Sep. 1985;36(3):131-4.
Bettinger, T. et al., Peptide-mediated RNA delivery: a novel approach for enhanced transfection of primary and post-mitotic cells. Nucleic Acids Res. Sep. 15, 2001;29(18):3882-91.
Bevan, M.J. et al., Antigen presentation to cytotoxic T lymphocytes in vivo. J Exp Med. Sep. 1, 1995;182(3):639-41.
Bevilacqua, A. et al., Post-transcriptional regulation of gene expression by degradation of messenger RNAs. J Cell Physiol. Jun. 2003;195(3):356-72.
Bieler, K. et al., Plasmids for Therapy and Vaccination. Wiley-VCH GmbH, Weinheim, Feb. 2001, pp. 1-24.
Bikard, David et al., Programmable repression and activation of bacterial gene expression using an engineered CRISPR-Cas system, Nucleic Acids Research Advance, 2013, pp. 1-9.
Binder, Mascha et al., The Epitope Recognized by Rituximab, Blood, 2006, vol. 108, No. 6, pp. 1975-1978.
Binder, R. et al., Evidence that the pathway of transferrin receptor mRNA degradation involves an endonucleolytic cleavage within the 3' UTR and does not involve poly(A) tail shortening. EMBO J. Apr. 15, 1994;13(8):1969-80.
Biocca, S., et al., Intracellular expression of anti-p21ras single chain Fv fragments inhibits meiotic maturation of xenopus oocytes. Biochem Biophys Res Comm. Dec. 15, 1993; 197(2): 422-427.
Bionaz, Massimo, et.al. ACSL 1, AGPAT6, FABP3, LPIN1, and SLC27A6 Are the Most Abundant Isoforms in Bovine Mammary Tissue and Their Expression Is Affected by Stage of Lactation. The Journal of Nutrition, 2008. pp. 1019-2024.

(56) References Cited

OTHER PUBLICATIONS

Biopharma, Sample Synagis, MedImmune, Inc., 2013, No vol. pp. 1-19.
Bird, A.P. et al., CpG-rich islands and the function of DNA methylation. Nature. May 15-21, 1986 ;321 (6067):209-13.
Black, D.D. et al., Similarity of the transfer factors in Novikoff ascites tumor and other amino acid-incorporating systems. Cancer Res. May 1970;30(5):1281-6.
Blelloch, Robert, et.al. Generation of Induced Pluripotent Stem Cells in the Absence of Drug Selection. Sep. 13, 2007. pp. 245-247.
Bloch, G. et al., Sequence-dependence of the conformational changes induced by the 5-methyl cytosine in synthetic RNA oligomers. Febs Lett. Jul. 27, 1987;219(2):464-8.
Blom, Dirk J. et al., A 52-Week Placebo-Controlled Trial of Evolocumab in Hyperlipidemia, The New England Journal of Medicine, 2014, 370(19), pp. 1-11.
Boczkowski, D. et al., Dendritic cells pulsed with RNA are potent antigen-presenting cells in vitro and in vivo. J Exp Med. Aug. 1, 1996;184(2):465-72.
Boczkowski, D. et al., Induction of tumor immunity and cytotoxic T lymphocyte responses using dendritic cells transfected with messenger RNA amplified from tumor cells. Cancer Res. Feb. 15, 2000;60(4)1 028-34.
Body, Jean-Jacques et al., A Study of the Biological Receptor Activator of nuclear Factor-KappaB Ligand inhibitor, Denosumab, in patients with multiple myeloma or bone metastases from Breast Cancer, Clinical Cancer Research, 2006, vol. 12, No. 4, pp. 1221-1228.
Bohrmann, Bernd et al., Gantenerumab:A Novel Human Anti-A— Antibody Demonstrates Sustained Cerebral Amyloid-beta Binding and Elicits Cell-Mediated Removal of Human Amyloid-beta. Journal of Alzheimer's Disease, 2012, vol. 28, pp. 49-69.
Bolhassani a., et al. , Improvement of Different Vaccine Delivery Systems for Cancer Therapy, Molecular Cancer, Biomed Central, London, GB, 2011, vol. 10, No. 3, pp. 1-20.
Bolukbasi, Mehmet Faith, et al., miR-1289 and "Zipcode"-like Sequence Enrich mRNAs in Microvesicles. Molecular Therapy-Nucleic Acids (2012) 1, e10: doi:10.1038/mtna.2011.2, pp. 1-10.
Bonehill, A., et al., Single-step antigen loading and activation of dendritic cells by mRNA electroporation for the purpose of therapeutic vaccination in melanoma patients. Clin Cancer Res. May 2009; 15(10): 3366-3375.
Bonham, Kevin S. et al., A Promiscuous Lipid-Binding Protein Diversifies the Subcellular Sites of Toll-like Receptor Signal Transduction, Cell, 2014, vol. 156, No.#, pp. 705-716.
Bonora, G. et al., HELP (High Efficiency Liquid Phase) new oligonucleotide synthesis on soluble polymeric support, Oxford Journals Life Sciences Nucleic Acids Research vol. 18, Issue 11 pp. 3155-3159. Abstract Only.
Boon, T. et al., Genes coding for tumor rejection antigens: perspectives for specific immunotherapy. Important Adv Oncol. 1994:53-69.
Borovkov, A. et al., High-Quality Gene Assembly Directly From Unpurified Mixtures of Microarray-Synthesized Oligonucleolides, Nucleic Acids Research, 2010, vol. 38, No. 19, pp. e180 1-10.
Bose, S. et al., Role of nucleolin in human parainfluenza virus type 3 infection of human lung epithelial cells. J Viral. Aug. 2004;78(15):8146-58.
Bosma, Piter Jabik et al., Inherited disorders of bilirubin metabolism, Journal of Hepatology, 2003, vol. 38, No. 1, pp. 107-117.
Bottero, Federica et al., GeneTransfection and Expression of the Ovarian Carcinoma Marker Folate Binding Protein on NIH/3T3 Cells Increases Cell Growth in Vitro and in Vivo, Cancer Research, 1993, vol. 53, No.#, pp. 5791-5796.
Bouloy, M., et al., Both the 7-methyl and the 2'-O-methyl groups in the cap of mRNA strongly influence its ability to act as primer for influenza virus RNA transcription. Proc. Natl. Acad. Sci. USA, vol. 77, No. 7, pp. 3952-3956, Jul. 1980.
Bousquet, Jean MD et al, Eosinophilic inflammation in Asthma, The New England Journal of Medicine, 1990, vol. 323, No. 15, pp. 1033-1039.
Bouxsein, N.F., et al., Structure and gene silencing activities of monovalent and pentavalent cationic lipid vectors complexed with siRNA. Biochem. 2007; 46(16): 4785-4792.
Bowen, Michael et al., Functional Effects of CD30 on a Large Granular Lymphoma Cell Line, Yt, The Journal of Immunology, 1993, vol. 151, No. 11, pp. 1-11.
Braissant, Olivier et al., Current concepts in the pathogenesis of urea cycle disorders, Molecular Genetics and Metabolism, 2010, vol. 100, pp. S3-S12.
Brandenburg, Boerries et al., Mechanisms of Hemagglutinin Targeted influenza Virus Neutralization, PLOS One, 2013, vol. 8, Issue 12, pp. 1-14.
Brandt, B. et al., Detection of the metastatic potential of blood-borne and immunomagnetically enriched epithelial cells by quantitative erbB-2 RT-PCR. Clin Exp Metastasis. Sep 1996;14(4):399-408.
Braun, Stephen et al., Preclinical Studies of Lymphocyte Gene Therapy for Mild Hunter Syndrome (Mucopolysaccharidosis Type II), Human Gene Therapy, 1996, vol. 7, pp. 283-290.
Brieba, L.G., et al., Role of T7 RNA polymerase His784 in start site selection and initial transcription. Biochem. 2002; 41: 5144-5149.
Brockton, NT et al, UGT1A1 polymorphisms and colorectal cancer susceptibility, Cancer, Gut, 2002; vol. 50, pp. 747-748.
Brossart, P. et al., Her-2/neu-derived peptides are tumor-associated antigens expressed by human renal cell and colon carcinoma lines and are recognized by in vitro induced specific cytotoxic T lymphocytes. Cancer Res. Feb. 15, 1998;58(4):732-6.
Brossart, P. et al., Identification of HLA-A2-restricted T-cell epitopes derived from the MUC1 tumor antigen for broadly applicable vaccine therapies. Blood. Jun. 15, 1999;93(12):4309-17.
Brossart, P. et al., Induction of cytotoxic T-lymphocyte responses in vivo after vaccinations with peptide-pulsed dendritic cells. Blood. Nov. 1, 2000; 96(9):3102-8.
Brossart, P. et al., Virus-mediated delivery of antigenic epitopes into dendritic cells as a means to induce CTL. J Immunol. Apr. 1, 1997;158(7):3270-6.
Brown, C.E., et al., Poly(A) Tail Length Control in Saccharomyces cerevisiae Occurs by Message-Specific Deadenylation. Molecular and Cellular Biology, Nov. 1998 pp. 6548-6559.
Broz, Petr et al., Newly described pattern recognition receptors team up against intracellular pathogens, Nature Reviews, Immunology, 2013, vol. 13, No.#, pp. 551-565.
Buccoliero, R. et al., Elevation of lung surfactant phosphatidylcholine in mouse models of Sandhoff and of Niemann-Pick a disease. J Inherit Metab Dis. 2004;27(5):641-8.
Burgess, Teresa et al., Biochemical Characterization of AMG 102: A Neutralizing, Fully Human Monoclonal Antibody to Human and Nonhuman Primate Hepatocyte Growth Factor, Molecular Cancer Therapeutics, 2010, vol. 9, No. 2, pp. 400-409.
Burke, B. et al., Microinjection of mRNA coding for an anti-Golgi antibody inhibits intracellular transport of a viral membrane protein. Cell. Apr. 1984;36(4):847-56.
Burks, EA et al., In vitro scanning saturation mutagenesis of an antibody binding pocket. Proc Natl Acad Sci SA. Jan. 21, 1997;94(2):412-7.
Burton, Dennis et al., A Large Array of Human Monoclonal Antibodies to Type 1 Human Immunodeficiency Virus From Combinatorial Libraries of Asymptomatic Seropositive Individuals, Proc. Natl Acad., USA, 1991, vol. 88, No Number, pp. 10134-10137.
Burton, Dennis et al., Efficient Neutralization of Primary Isolates of HIV-1 by a Recombinant Human Monoclonal Antibody, Science, 1994, vol. 266, No Number, pp. 1024-1027.
Busse, William W. et al., Safety profile, pharmacokinetics, and biologic activity of MEDI-563, an anti-IL-5 receptor a antibody, in a phase I study of subjects with mild asthma, J Allergy Clin Immunol, 2010, vol. 125, No. 6, pp. 1237-1244.
Butler, E.T. et al., Bacteriophage SP6-specific RNA polymerase. I. Isolation and characterization of the enzyme. J Biol Chem. May 25, 1982;257(10):5772-8.

(56) References Cited

OTHER PUBLICATIONS

Califf, Robert et al., Use of a Monoclonal Antibody Directed Against the Platelet Glycoprotein IIB/IIIa Receptor in High- Risk Coronary Angioplasty, 1994, The New England Journal of Medicine, vol. 330, No. 14, pp. 1-6.
Cannon, G. et al., RNA based vaccines. DNA Cell Biol. Dec. 2002;21(12):953-61.
Capoccia, B.J., et al., G-CSF and AMD3100 mobilize monocytes into the blood that stimulate angiogenesis in vivo through a paracrine mechanism. Blood. Oct. 1, 2006; 108(7): 2438-2445.
Caput, D. et al., Identification of a common nucleotide sequence in the 3'-untranslaled region of mRNA molecules specifying inflammatory mediators. Proc Natl Acad Sci USA. Mar. 1986;83(6):1670-4.
Caron, H. et al., The human transcriptome map: clustering of highly expressed genes in chromosomal domains. Science. Feb. 16, 2001;291(5507):1289-92.
Carralot, J.P. et al., Polarization of immunity induced by direct injection of naked sequence-stabilized mRNA vaccines. Cell Mal Life Sci. Sep. 2004;61(18):2418-24.
Carralot, J.P. et al., Production and characterization of amplified tumor-derived cRNA libraries to be used as vaccines against metastatic melanomas. Genet Vaccines Ther. Aug. 22, 2005;3:6.
Carrington, J.C. et al., Cap-independent enhancement of translation by a plant potyvirus 5' nontranslated region. J Virol. Apr. 1990; 64(4): 1590-1597.
Castro, Mario et al., Reslizumab for Poorly Controlled, Eosinophilic Asthma, A Randomized, Placebo-controlled Study, American Journal of Respiratory and Critical Care Medicine, 2011, vol. 184, No#, pp. 1125-1132.
Caudy, AA et al., Fragile X-related protein and VIG associate with the RNA interference machinery. Genes Dev. Oct. 1, 2002;16(19):2491-6.
Cavaille, J. et al., Identification of brain-specific and imprinted small nucleolar RNA genes exhibiting an unusual genomic organization. Proc Natl Acad Sci USA. Dec. 19, 2000;97(26):14311-6.
Cavaille, J. et al., Targeted ribose methylation of RNA in vivo directed by tailored antisense RNA guides. Nature. Nov. 24, 1996;383(6602):732-5.
Cavelti-Weder, Claudia et al., Effects of Gevokizumab on Glycemia and inflammatory Markers in Type 2 Diabetes, Diabetes Care, 2012, vol. 35, No Number, pp. 1654-1662.
Celluzzi, C.M. et al., Peptide-pulsed dendritic cells induce antigen-specific Ctl-mediated protective tumor immunity. J Exp Med. Jan. 1, 1996;183(1):283-7.
Chan, E., et al., Live cell imaging distinguishes bona fide human iPS cells from partially reprogrammed cells. Nat Biotech. Nov. 2009: 27(11): 1033-1037.
Chang, C et al., Tolerization of Dendritic Cells by Ts cells: the Crucial Role of Inhibitory Receptors IL T3 and ILT4, Nature Immunology, 2002, vol. 3, No. 3, pp. 237-243.
Chang, C. et al., Non-ionic amphiphilic biodegradable PEG-PLGA-PEG copolymer enhances gene delivery efficiency in rat skeletal muscle; Science Direct, Journal of Controlled Release 118 (2007) 245-253.
Chang, N. et al., Genome editing with RNA-guided Cas9 nuclease in Zebrafish embryos. Cell Res. Apr. 2013; 23(4): 465-472.
Chapman, Andrew et al., Therapeutic Antibody Fragments With Prolonged in Vivo Half-Lives, Nature America Inc., 1999, vol. 17, No Number, pp. 780-783.
Chappell, SA et al., Ribosomal tethering and clustering as mechanisms for translation initiation. Proc Natl Acad Sci USA. Nov. 28, 2006;103(48):18077-82. Epub Nov. 16, 2006.
Charette, M. et al., Pseudouridine in RNA: what, where, how, and why. IUBMB Life. May 2000;49(5):341-51.
Chelius, Dirk et al., Structural and functional characterization of the trifunctional antibody catumaxomab, mAbs, 2010, vol. 2 No. 3, pp. 309-319.

Chen XL, et al., Expression of human factor IX in retrovirus-transfected human umbilical cord tissue derived mesenchymal stem cells, PubMed, Feb. 2009; 17 (1): 184-87.
Chen, Chun et al., A Flexible RNA Backbone within the Polypyrimidine Tract Is Required for U2AF65 Binding and Pre- mRNA Splicing In Vivo, Molecular and Cellular Biology, 2010, vol. 30, No. 17, pp. 4108-4119.
Chen, D., et al., Rapid discovery of potent siRNA-containing lipid nanoparticles enabled by controlled microfluidic formulation. J Am Chem Soc. 2012; 134: 6948-6951.
Chen, H., et al., TGF-beta 1 attenuates myocardial ischemia-reperfusion injury via inhibition of upregulation of MMP-1. Am J Physiol Circ Physiol, May 2003, vol. 284, No. 5, pp. H1612-H1617.
Chen, Helen et al., Expanding the Clinical Development of Bevacizumab, The Oncologist, 2004, vol. 9, Supp 1, pp. 27-35.
Chen, Juine-Ruey, et al., Vaccination of Monoglycosylated Hemagglutinin Induces Cross-Strain Protection Against Influenza Virus Infection, Pnas, 2013, no. vol. Number, pp. 1-6.
Chen, Y., Self-assembled rosette nanotubes encapsulate and slowly release dexamethasone, International Journal of Nanomedicine, 2011 :6 pp. 1035-1044.
Chen, Z. et al., Enhanced protection against a lethal influenza virus challenge by immunization with both hemagglutinin- and neuraminidase-expressing DNAs. Vaccine. Feb. 26, 1999;17(7-8):653-9.
Cheng, C., et al., Multifunctional triblock copolymers for intracellular messenger RNA delivery. Biomaterials. Oct. 2012; 33(28): 6868-6876.
Cheng, Ee-chun et al., Repressing the Repressor: a lincRNA as a MicroRNA Sponge in Embryonic Stem Cell Self- Renewal, Developmental Cell, 2013, vol. 25, No number, pp. 1-2.
Cheng, Guotan et al., T Cell Tolerance and the Multi-Functional Role of IL-2R Signaling in T Regulatory Cells, Immunol Rev., 2011, vol. 241, No. 1, pp. 63-76.
Cheng, S. et al. Effective Amplification of Long Targets From Cloned Inserts and Human Genomic DNA, Proc. Natl. Acad. Sci. USA, 1994, vol. 91, pp. 5695-5699.
Cheng, W.F. et al., Enhancement of Sindbis virus self-replicating RNA vaccine potency by linkage of herpes simplex virus type 1 VP22 protein to antigen. J Virol. Mar. 2001;75(5):2368-76.
Cheng, W.F. et al., Enhancement of Sindbis virus self-replicating RNA vaccine potency by linkage of Mycobacterium tuberculosis heat shock protein 70 gene to an antigen gene. J Immunol. May 15, 2001;166(10):6218-26.
Cho, E.J. et al., mRNA capping enzyme is recruited to the transcription complex by phosphorylation of the RNA polymerase II carboxy-terminal domain. Genes Dev. Dec. 15, 1997; 11(24): 3319-3326.
Cho, J.H. et al., Enhanced cellular immunity to hepatitis C virus nonstructural proteins by codelivery of granulocyte macrophage-colony stimulating factor gene in intramuscular DNA immunization. Vaccine. Mar. 5, 1999;17(9-10):1136-44.
Chou, Hsun-Hua et al., A mutation in human CMP-sialic acid hydroxylase occurred after the Homo-Pan divergence, Proc. Natl. Acad. Sci. USA, 1998, vol. 95, No#, pp. 11751-11756.
Chowdhury, Jayanta R. et al., Bilirubin Mono- and Diglucuronide Formation by Human Liver In Vitro: Assay by High- Pressure Liquid Chromatography, Hepatology, 1981, vol. 1, No. 6, pp. 622-627.
Chowdhury, Namita et al., Isolation of Multiple Normal and Functionally Defective Forms of Uridine Diphosphate-Glucuronosyltransferase from Inbred Gunn Rats, J. Clin. Invest, 1987, vol. 79, No.#, pp. 327-334.
Choy et al, Efficacy of a Novel PEGylated Humanized Anti-TNF Fragment (CDP870) in patients with Rheumatoid Arthritis: A phase II double-blinded, randomized, Dose-Escalating Trial, Rheumatology 2002; vol. 41, No number, pp. 1133-1137.
Chui, H.M. et al., Synthesis of helix 69 of *Escherichia coli* 23S rRNA containing its natural modified nucleosides, m(3) Psi and Psi. J Org Chem. Dec. 13, 2002;67(25):8847-54.
Church, L et al., Canakinumab, a Fully Human mAb Against Il-113 for the Potential Treatment of inflammatory Disorder, Current Opinion in Molecular Therapeutics, 2009, vol. 11, No. 1, pp. 81-89.

(56) References Cited

OTHER PUBLICATIONS

Clawson, Ga et al., Increased amounts of double-stranded RNA in the cytoplasm of rat liver following treatment with carcinogens. Cancer Res. Aug. 1982;42(8):3228-31.
Cleary, Michele et al., Production of Complex nucleic acid libraries using highly parallel in situ oligonucleotide synthesis, 2004, Nature Methods vol. 1 No. 3, Dec. 2004, pp. 241-248.
Cohen, Idan et al., Differential release of chromatin-bound IL-1a Discriminates Between Necrotic and Apoptotic Cell Death by the Ability to Induce Sterile Inflammation, PNAS, 2010, vol. 107, No. 6, pp. 2574-2579.
Cohen, P.J. et al., Murine epidermal Langerhans cells and splenic dendritic cells present tumor-associated antigens to primed Tcells. Eur J Immunol. Feb 1994;24(2):315-9.
Collas, P. et al., Epigenetic reprogramming of nuclei using cell extracts. Stem Cell Rev. 2006;2(4):309-17.
Collas, P., Dedifferentiation of cells: new approaches. Cytotherapy. 2007;9(3):236-44.
Coller, Barry S. et al, A New Murine Monoclonal Antibody Reports an Activation-Dependent Change in the Confirmation and/or Microenvironment of the Platelet Glycoprotein Iib/IIIa Complex, The American Society for Clinical Investigation, Inc., 1985, vol. 76, No vol. number, pp. 101-108.
Coller, BS et al., Inhibition of Dog Platelet Function by Vivo Infusion of F (ab')2 Fragments of a Monoclonal Antibody to Platelet Glycoprotein Iib/IIIa Receptor, Blood, 1985, vol. 66, No. 6, pp. 1456-1459.
Colot, V. et al., Eukaryotic DNA methylation as an evolutionary device. Bioessays. May 1999;21(5):402-11.
Colter, J.S., et al., Infectivity of ribonucleic acid isolated from virus-infected tissues. Virology. 1957; 4(3): 522-532.
Compton, J., Nucleic Acid Sequence-Based Amplification, Nature, 1991, vol. 350, No#, pp. 91-92. (Abstract Only).
Conde, Francisco et al., The Aspergillus toxin restrictocin is a suitable cytotoxic agent for generation of immunoconjugates with monoclonal antibodies directed against human carcinoma cells, Eur. J. Biochem, 1989, vol. 178, No#, pp. 795-802.
Condon, C. et al., DNA-based immunization by in vivo transfection of dendritic cells. Nat Med. Oct. 1996;2 (10):1122-8.
Coney, Leslie et al., Cloning of Tumor-associated Antigen: MOv18 and MOv19 Antibodies Recognize a Folate-binding Protein, Cancer Research, 1991, vol. 51, No#, pp. 6125-6132.
Cong, L. et al., Multiplex genome engineering using CRISPR/Cas systems. Science. Feb. 15, 2013; 339(6121): 819-823.
Conry, R.M. et al., Characterization of a messenger RNA polynucleotide vaccine vector. Cancer Res. Apr. 1, 1995 ;55 (7):1397-1400.
Conry, R.M. et al., Immune response to a carcinoembryonic antigen polynucleotide vaccine. Cancer Res. Mar. 1, 1994; 54(5):1164-8.
Cools, Nathalie, et al., Balancing Between Immunity and Tolerance: an Interplay Between Dendritic Cells, Regulatory I Cells, and Effector T Cells, Journal of Leukocyte Biology, 2007, vol. 82, pp. 1365-1374.
Copreni, E. et al., Lentivirus-mediated gene transfer to the respiratory epithelium: a promising approach to gene therapy of cystic fibrosis. Gene Ther. Oct. 2004;11 Suppl 1 :S67-75.
Cornett, Jeff et al. Update of Clinical Trials to Cure Hemophilia, Hemophilia of Georgia, Dec. 12, 2013, No vol. pp. 1-2.
Corren, Jonathan et al., Lebrikizumab Treatment in Adults with Asthma, The New England Journal of Medicine, 2011, vol. 365, No. 12, pp. 1088-1098.
Cortes, J.J. et al., Mutations in the conserved loop of human U5 snRNA generate use of novel cryptic 5' splice sites in vivo. EMBO J. Dec. 15, 1993;12(13):5181-9.
Cosman, David et al., ULBPs, Novel MHC Class I-Related Molecules, Bind to CMV Glycoprotein UL 16 and Stimulate NK Cytotoxicity through the NKG2D Receptor, Immunity, 2001, vol. 14, No vol. pp. 123-133.
Coughlin, C.M. et al., Targeting adult and pediatric cancers via cell-based vaccines and the prospect of activated B lymphocytes as a novel modality. Cancer Biol Ther. Sep.-Oct. 2003;2(5):466-70.

Cousens, L. et al., In Vitro and In Vitro Studies of IgG-derived Treg Epitopes (Tregitopes): A Promising New Tool for Tolerance Induction and Treatment of Autoimmunity, J. Clin. Immunol, 2013, vol. 33, Supp 1, pp. 43-49.
Cousens, Leslie et al., Application of IgG-Derived Natural Treg Epitopes (IgG Tregitopes) to Antigen-Specific Tolerance Induction in a Murine Model of Type 1 Diabetes, Journal of Diabetes, vol. 2013, Article ID 621693, pp. 1-17.
Cousens, Leslie et al., Tregitope Update: Mechanism of Action Parallels IVIg, Autoimmunity Reviews, 2012, No Volume, pp. 1-8.
Cowling (Jan. 15, 2010, online Dec. 23, 2009, "Regulation of mRNA cap methylation," Biochemical Journal, 425 (Pt 2): 295-302.
Cox, G.J. et al Bovine herpesvirus 1: immune responses in mice and cattle injected with plasmid DNA. J Virol. Sep. 1993;67(9):5664-7.
Craig, J.M. et al., The distribution of CpG islands in mammalian chromosomes. Nat Genet. Jul. 1994;7(3):376-82.
Cramer, P. et al., Functional association between promoter structure and transcript alternative splicing. Proc Natl Acad Sci USA. Oct. 14, 1997;94(21):11456-60.
Cree, B. et al., Tolerability and effects of rituximab (anti CD20 antibody) in neuromyelitis optica (NMO) and rapidly worsening multiple sclerosis (MS). Neurology. 2004; 62(55):A492.
Cribbs, David H., Adjuvant-dependent Modulation of Th1 and Th2 Responses to Immunization with beta-amyloid, International Immunology, vol. 15, No. 4, pp. 505-514.
Crowe, J.S. et al., Humanized Monoclonal Antibody CAMPATH-1 H Myeloma Cell Expression of Genomic Constructs, Nucleotide Sequence of cDNA Constructs and Comparison of Effector Mechanisms of Myeloma and Chinese Hamster Ovary Cell-Derived Material, Clinical Exp. Immunol., 1992, vol. 87, No number, pp. 105-110.
Cuburu, N. et al., Intravaginal immunization with HPV vectors induces tissue-resident CDS+ T cell responses. J Clin Invest. Dec. 3, 2012; 122(12): 4606-4620.
Culver, K.W. et al., Gene Therapy, A Handbook for Physicians. Mary Ann Lieber, Inc, New York. 1994; 63-77.
Cun, Dongmei, et al., Preparation and characterization of poly(Dl-lactide-co-glycolide) nanoparticles for siRNA delivery. International Journal of Pharmaceutics 390 (2010) 70-75.
Cunningham, S., et al., AAV2/8-mediated correction of OTC deficiency is robust in adult but not neonatal Spf/\ash Mice. Mol Ther. Aug. 2009; 17(8): 1340-1346.
Daguer, J.P. et al., Increasing the stability of sacB transcript improves levansucrase production in Bacillus subtilis. Lett Appl Microbial. 2005;41 (2):221-6.
Dahlman, James E. et al., In vivo endothelial siRNA delivery using polymeric nanoparticles with low molecular weight, Nature Nanotechnology, 2014, No vol.#, pp. 1-8.
Dai, M.S. et al., Introduction of human erythropoietin receptor complementary DNA by retrovirus-mediated gene transfer into murine embryonic stem cells enhances erythropoiesis in developing embryoid bodies. Biol Blood Marrow Transplant. 2000;6(4):395-407.
Danke, Nancy et al., Comparative Study of GAD65-specific CD4+ T cells in healthy and Type 1 Diabetic Subjects, Journal of Autoimmunity, 2005, vol. 25, No Number, 303-311.
Daridon, Capucine et al., Epratuzumab Affects B Cells Trafficking in Systemic Lupus Erythematosus, Ann Rheum Dis, 2011, vol. 70, No#, pp. 1-2. Abstract Only.
Davidson, E.H., An Analysis of Niu Menchang's Research on Transformation by RNA. Biotechnology in China, 1989, 92-102.
Davis et al., Stabilization of RNA stacking by pseudouridine. Nucleic Acids Res. 1995, 23(24):5020-5026.
Davtyan, H. et al., Immunogenicity, Efficacy, Safety, and Mechanism of Action of Epitope Vaccine (Lu AF20513) for Alzheimer's Disease: Prelude to a Clinical Trial, The Journal of Neuroscience, Mar. 2013, vol. 33, No. 11, pp. 4923-4934.
De Carvalho, S. et al., Biologic properties of human leukemic and tumoral RNA. IV. Leukemia and neoplasms induced in mice with human leukemic RNA carried in tissue culture. J Lab Clin Med. May 1960;55:706-14.

(56) References Cited

OTHER PUBLICATIONS

De Carvalho, S. et al., Comparative effects of liver and tumour ribonucleic acids on the normal liver and the Novikoff hepatoma cells of the rat. Nature. Mar. 11, 1961;189:815-7.

De Carvalho, S. et al., Differences in information content of ribonucleic acids from malignant tissues and homologous organs as expressed by their biological activities. Exp Mol Pathol. Apr. 1962; 1:96-103.

De Carvalho, S., Angiokines, angiogenesis and angiolymphoproliferative syndromes (ALPS). Angiology. Apr. 1983;34(4):231-43.

De Carvalho, S., Biologic properties of human leukemic and tumoral RNA. III. The effect of different media on the cytopathogenicity in tissue culture. J Lab Clin Med. May 1960;55:694-705.

De Carvalho, S., Cancer 1974: an analytical vademecum of oncologic relevance. Oncology. 1973;28(4):289-98.

De Carvalho, S., Effect of RNA from normal human bone marrow on leukaemic marrow in vivo. Nature. Mar. 16, 1963;197:1077-80.

De Carvalho, S., Epigenetic transformation by RNA from human neoplastic cells. Oncology. 1973;27(1):3-29.

De Carvalho, S., In vitro angiogenic activity of RNA from leukemic lymphocytes. Angiology. Jul. 1978;29(7):497-505.

De Carvalho, S., Natural history of congenital leukemia. An experiment of nature revealing unexplored features of fetal-maternal isoimmunity, longest recorded survival following use of leukemostatic maternal isoantibody. Oncology. 1973;27(1):52-63.

De Lucca, FL et al., Effect of the calcium phosphate-mediated RNA uptake on the transfer of cellular immunity of a synthetic peptide of HIV-1 to human lymphocytes by exogenous RNA. Mol Cell Biochem. Dec. 2001;228(1-2):9-14.

Decatur, W. A. et al., RNA-guided nucleotide modification of ribosomal and other RNAs. J Biologic Chem. Jan. 10, 2003; 278(2): 695-698.

Deering, Raquel et al., Nucleic Acid Vaccines: Prospects for Non-Viral Delivery of mRNA Vaccines, Expert Opinion, 2014, vol. 11, No. 6, pp. 1-15.

DeGroot, Anne S. et al., Activation of Natural Regulatory T cells by IgG F-derived peptide "Tregitopes", 2008, vol. 112, No. 8, pp. 3303-3311.

Delafontaine, P. et al., Regulation of vascular smooth muscle cell insulin-like growth factor I receptors by phosphorothioate Oligonucleolides. Effects on cell growth and evidence that sense targeting at the ATG site increases receptor expression. J Biol Chem. Jun. 16, 1995;270(24):14383-8.

Delehanty, James B., Peptides for Specific Intracellular Delivery and Targeting of Nanoparticles: Implications for Developing Nanoparticle-Mediated Drug Delivery, Future Science, Therapeutic Delivery, 2010, vol. 1, No. 3, pp. 411-433.

DeMarco, et al., A Non-VH1-69 Heterosubtypic Neutralizing Human Monoclonal Antibody Protects Mice Against H1N1 and H5N1 Viruses, PLOS One, Apr. 2012, vol. 7, Issue 4, pp. 1-9.

Deres, K. et al., In vivo priming of virus-specific cytotoxic T lymphocytes with synthetic lipopeptide vaccine. Nature. Nov. 30, 1989;342(6249):561-4.

Desaulniers, J.P. et al., Synthesis of 15N-enriched pseudouridine derivatives. Org Lett. Oct. 30, 2003; 5(22): 4093-4096.

Desmond Padhi et al., Single-Dose, Placebo-Controlled, Randomized Study of AMG 785, a Sclerostin Monoclonal Antibody, Journal of Bone and Mineral Research, vol. 26, No. 1, 2011, pp. 19-26.

Desrosiers, R. et al., Identification of methylated nucleosides in messenger RNA from Novikoff hepatoma cells. Proc Natl Acad Sci USA. Oct. 1974;71(10):3971-5.

Devine, Peter L. et al., The Breast Tumor-associated Epitope Defined by Monoclonal Antibody 3E1 .2 Is an O-linked Mucin Carbohydrate Containing N-Glycolylneuraminic Acid, Cancer Research, 1991, vol. 51, No#, pp. 5826-5836.

Dharap, S.S., et al., Tumor-specific Targeting of an Anticancer Drug Delivery System by LHRH Peptide, PNAS, 2005, vol. 102, No. 36, pp. 12962-12967.

DiCaro, Valentina, et al., In Vivo Delivery of Nucleic Acid-Formulated Microparticles as a Potential Tolerogenic Vaccine for Type 1 Diabetes, 2012, vol. 9, No. 4, pp. 348-356.

Diebold, S.S. et al., Innate antiviral responses by means of TLR7-medialed recognition of single-stranded RNA. Science. Mar. 5, 2004;303(5663):1529-31. Epub Feb. 19, 2004.

DiJoseph, John F. et al., Antibody-targeted chemotherapy with CMC-544: a CD22-targeted immunoconjugate of calicheamicin for the treatment of B-lymphoid malignancies, Blood, 2004, vol. 103, No#, pp. 1807-1814.

Diken et al., Current Developments in Actively Personalized Cancer Vaccination with a Focus on RNA as the Drug Format. Prog Tumor Res. 2015;42:44-54. doi: 10.1159/000437184. Epub Sep. 4, 2015 Review.

Dimari, J.F. et al., Initiation of mRNA decay in Bacillus subtilis. Mol Microbiol. Mar. 1993;7(5):705-17.

Ding, Z., et al., State-of-the-art 2003 on PKU gene therapy. Mol Genet Metab. Jan. 2004; 81(1): 3-8.

Dingman et al., Molecular theories of memory. Science (1964)144:26-9.

Disbrow, G.L. et al., Codon optimization of the HPV-16 E5 gene enhances protein expression. Virology. Jun. 20, 2003;311(1):105-14.

Dodart, Jean-Cosme et al., Immunization reverses memory deficits without reducing brain a burden in Alzheimer's disease model, Nature Neuroscience, 2002, vol. 5, No. 5, pp. 452-457.

Doffek, Kara et al., Phosphalidyserine Inhibits NFkB and p38 Mapk Activation in Human Monocyte Derived Dendritic Cells, Molecular Immunology, 2011, vol. 48, No.#, pp. 1771-1777.

Dong, X.Y. et al., Identification of genes differentially expressed in human hepatocellular carcinoma by a modified suppression subtractive hybridization method. Int J Cancer. Nov. 1, 2004; 112(2): 239-248.

Dong, Y. et al Poly(d,1-laclide-co-glycolide)/montmorillonite nanoparticles for oral delivery of anticancer drugs. Biomaterials. Oct. 2005;26(30):6068-76.

Donnelly, J. et al., Technical and regulatory hurdles for Dna vaccines. Int J Parasitol. May 2003;33(5-6):457-67.

Dreyer Hans C., Leucine-enriched essential amino acid and carbohydrate ingestion following resistance exercise enhances mTOR signaling and protein synthesis in human muscle, Am J. Physiol Endocrinol Metab,; 294; E392-E400, 2008.

Du et al., Lysosomal Acid Lipase Deficiency: Correction of Lipid Storage by Adenovirus-Mediated Gene Transfer in Mice; Human Gene Therapy; vol. 13, No#, pp. 1361-1372.

Du, L. et al., Arginine-rich cell-penetrating peptide dramatically enhances Amo-mediated Atm Aberrant Splicing Correction and Enables Delivery to Brain and Cerebellum, Human Molecular Genetics, 2011, vol. 20, No. 16, pp. 3151-3160.

Dubes, G R and Klingler, Ea Jr. Facilitation of infection of monkey cells with poliovirus "ribonucleic acid." Science. Jan. 1961;133(3446): 99-100.

Dumont, Jennifer A. et al., Prolonged activity of a recombinant factor Viii-Fe fusion protein in hemophilia a mice and dogs, Blood, 2012, vol. 119, No. #, pp. 3024-3030.

Dunham, S.P. et al., The application of nucleic acid vaccines in veterinary medicine. Res Vet Sci. Aug. 2002;73 (1):9-16.

Dunn, J.J. et al., Different template specificities of phage T3 and T7 RNA polymerases. Nat New Biol. Mar. 17, 1971;230(11 ):94-6.

Duret, L. et al., Expression pattern and, surprisingly, gene length shape codon usage in Caenorhabditis, Drosophila, and Arabidopsis. Proc Natl Acad Sci USA. Apr. 13, 1999;96(8):4482-7.

Duret, L., Evolution of synonymous codon usage in metazoans. Curr Opin Genet Dev. Dec. 2002;12(6):640-9.

Earl, Ra, et al., A chemical synthesis of the nucleoside 1-Methylpseudouridine. A facile chemical synthesis of 1-methylpseudouridine has been accomplished by direct methylation of pseudouridine. J Heterocyclic Chem. Jun. 1977; 14:699-700.

Easton, Le. et al., Rapid, nondenaturing RNA purification using weak anion-exchange fast performance liquid chromatography. RNA. Mar. 2010;16(3):647-53. Epub Jan. 25, 2010.

(56) References Cited

OTHER PUBLICATIONS

Ebel, Wolfgang et al, Preclinical Evaluation of MORAb-003, a Humanized Monoclonal Antibody Antagonizing Folate Receptor-alpha, Cancer Immunity, 2007, vol. 7 No. #, pp. 1-8.
Ebert, A.D. et al., Induced pluripotent stem cells from a spinal muscular atrophy patient. Nature. Jan. 15, 2009; 457 (7227): 277-280.
Ebert, Margaret S., MicroRNA sponges: Competitive Inhibitors of Small RNAs in Mammalian Cells, Nature Methods, 2007, vol. 4, No. 9, pp. 721-726.
Eberwine, J. et al., Analysis of gene expression in single live neurons Proc Natl Acad Sci USA. Apr. 1, 1992 ;89 (7):3010-4.
Edelheit, S. et al., Transcriptome-Wide Mapping of 5-methylcytidine RNA. Modifications in Bacteria, Archaea, and Yeast Reveals m5C within Archaeal mRNAs. PLOS Genetics, Jun. 2013, vol. 9, Issue 6, pp. 1-14.
Edelstein, M. L. et al., Gene therapy clinical trials worldwide 1989-2004-an overview. J Gene Med. Jun. 2004;6 (6):597-602.
Edery, I. et al., An efficient strategy to isolate full-length cDNAs based on an mRNA cap retention procedure (CAPture). Mol Cell Biol. 1995; 15(6): 3363-3371.
Edmonds, M., Polyadenylate polymerases. Methods Enzymol. 1990;181:161-70.
Egeter, O. et al., Eradication of disseminated lymphomas with CpG-DNA activated T helper type 1 cells from nontransgenic mice. Cancer Res. Mar. 15, 2000;60(6):1515-20.
Eisen, Tim et al., Naptumomab Eslafenatox: Targeted Immunotherapy with a Novel Immunotoxin, Curr Oncol Rep, 2014, vol. 16, N. 370 pp. 2-6.
El Ouahabi, A., et al., Double long-chain amidine liposome-mediated self replicating RNA transfection. FEBS Letters. Feb. 1996; 380(1-2): 108-112.
Elango, N., et al., Optimized transfection of mRNA transcribed from a d(A/T)100 tail-containing vector. Biochem Biophys Res Commun. 2005; 330: 958-966.
Elbashir, S.M. et al., Duplexes of 21-nucleotide RNAs mediate RNA interference in cultured mammalian cells. Nature. May 24, 2001;411 (6836):494-8.
Ellem, Kao. and Colter, J.S. The interaction of infectious ribo-nucleic acid with a mammalian cell line: II. Kinetics of the formation of infectious centers. Virology. Dec. 1960; 12(4): 511-520.
Ellem, Kao. and Colter, J.S. The interaction of infectious ribo-nucleic acids with mammalian cells: III. Comparison of infection and RNA uptake in the HeLa cell-polio RNA and L cell-mengo RNA systems. Virology. Oct. 1961; 15(2): 113-126.
Ellem, Kao., and Colter, J.S. The interaction of infectious ribo-nucleic acid with a mammalian cell line: I. Relationship between the osmotic pressure of the medium and the production of infectious centers. Virology. Jun. 1960; 11 (2): 434-443.
Ellem, Kao., and Colter, J.S. The isolation of three variants of mengo virus differing in plaque morphology and hemagglutinating characteristics. Virology. Nov. 1961; 15(3): 340-347.
Ellis, SG et al., Safety and Antiplatelet Effect of Murine Monoclonal Antibody 7E3 Fab Directed Against Platelet Glycoprotein IIb/IIIA in Patients Undergoing Elective Coronary Angioplasty, Coron Artery Dis., 1993, vol. 4, No. 2, pp. 167-175.
El-Sagheer, Afaf H. et al., Click Nucleic Acid Ligation: Applications in Biology and Nanotechnology, Accounts of Chemical Research, 2012 'vol. 45, No. 8, pp. 1258-1267.
Endo, F., et al. A Nonsense Mutation in the 4-Hydroxyphenylpyruvic Acid Dioxygenase Gene (Hpd) Causes Skipping of the Constitutive Exon and Hypertyrosinemia in Mouse Strain III. Genomics 25, 164-169 (1995).
Epicentre Forum. Tools and Techniques for Genomics and RNA Research. 2006; 13(2): 1-8.
Epicentre Forum. Tools and Techniques for Genomics and RNA Research. 2007; 14(1): 1-24.
Erlandsson, Eva et al., Identification of the Antigenic Epitopes in Staphylococcal Enterotoxins A and E and Design of A Superantigen for Human Cancer Therapy, J. Mol. Biol., 2003, vol. 333, No#, pp. 893-905.
Esposito, S., Effect on Leukaemic Cells of Ribonucleic Acid Extracted from Calfs Spleen. Nature. Sep. 1964; 203: 1078-1079.
Esvelt, K., et al., A system for the continuous directed evolution of biomolecules. Nature. Apr. 2011; 472(7344): 499-503.
Evel-Kabler, Kevin et al., SOCS1 Restricts Dendritic Cells' Ability to Break Self Tolerance and Induce Antitumor Immunity by Regulating IL-12 Production and Signaling, The Journal of Clinical Investigation, 2006, vol. 116, No. 1, pp. 90-100.
Ezzat, Kariem et al. PepFect 14, a Novel Cell-penetrating Peptide for Oligonucleotide Deliver in Solution and As Solid Formulation, Nucleic Acids Research, 2011, vol. 39, No. 12, pp. 5284-5298.
Fahy, E. et al., Self-sustained sequence replication (3SR): an isothermal transcription-based amplification system alternative to PCR. PCR Methods Appl. Aug. 1991;1 (1 ):25- 33.
Faissner, A. et al., Analysis of polypeptides of the tree shrew (Tupaia) herpesvirus by gel electrophoresis. J Gen Viral. Jan. 1982;58P11:139-48.
Falugi, Fabiana et al., Role of Protein A in the Evasion of Host Adaptive Immune Responses by Staphylococcus Aureus, mBio, 2014, vol. 4, Issue 5, pp. 1-10.
Fan, X.C., et al., Overexpression of HuR, a nuclear-cytoplasmic shuttling protein, increases the in vivo stability of ARE-containing mRNAs. Embo J. 1998; 17(12): 3448-3460.
Fandrich, F. et al., Preimplantation-stage stem cells induce long term allogeneic graft acceptance without supplementary host conditioning. Nat Med. Feb. 2002;8(2):171-8.
Fang, S.H. et al., Functional measurement of hepatitis C virus core-specific COB(+) T-cell responses in the livers or peripheral blood of patients by using autologous peripheral blood mononuclear cells as targets or stimulators. J Clin Microbial. Nov. 2001;39(11):3895-901.
Fang, Shun-lung et al., A Novel Cell-Penetrating Peptide Derived from Human Eosinophil Cationic Protein, PLOS One, 2013, vol. 8, Issue 3, pp. 1-13.
Feagan, Brian et al., Vedolizumab as Induction and Maintenance Therapy for Ulcerative Colitis, The New England Journal of Medicine, 2013, vol. 369, No. 8, pp. 699-710.
Fearnley, D.B. et al., Monitoring human blood dendritic cell numbers in normal individuals and in stem cell transplantation. Blood. Jan. 15, 1999;93(2):728-36.
Felden, Brice et al., Presence and location of modified nucleotides in *Escherichia coli* mRNA: structural mimicry with tRNA acceptor branches, The EMBO Journal, 1998, vol. 17 No. 11 pp. 3188-3196.
Felgner, PL Cationic lipid/polynucleotide condensates for in vitro and in vivo polynucleotide delivery—the cytofectins J. Of Liposome Research. 1993; 3(1): 3-16.
Felgner, PL Particulate systems and polymers for in vitro and in vivo delivery of polynucleotides. Adv. Drug Delivery Rev. 1990; 5(3): 163-187.
Felgner, PL, et al., Lipofection: a highly efficient, lipid-mediated DNA-transfection procedure. Proc Natl Acad Sci USA. Nov. 1987;84(21):7413-7.
Fellner, Christopher et al., Ipilimumab (Yervoy) Prolongs Survival in Advanced Melanoma, Drug Forecast, 2012, vol. 37, No. 9, pp. 503-530.
Fernandez, I., et al. Unusual base pairing during the decoding of a stop codon by the ribosome. Volume 000, 2013. pp. 1-5.
Ferrara, Claudia et al., Unique carbohydrate-carbohydrate interactions are required for high affinity binding between FcγRIII and antibodies lacking core fucose, PNAS, 2011, No vol. #, pp. 1-6.
Ferrara, James et al., Graft-versus Host Disease, Lancet, 2009, vol. 373, No. 9674, pp. 1550-1561.
Ficz, Gabriella, et.al. Dynamic regulation of 5-hydroxymethylcytosine in mouse ES cells and during differentiation. Nature l vol. 473 l May 19, 2011. pp. 398-401. Macmillian Publishers.
Figini, M. et al., Reversion of transformed phenotype in ovarian cancer cells by intracellular expression of anti folate receptor antibodies, Gene Therapy, 2003 vol. 10, No#, pp. 1018-1025.

(56) References Cited

OTHER PUBLICATIONS

Finn, Jonathan et al., Eradication of Neutralizing Antibodies to Factor VIII in Canine Hemophilia A After liver Gene Therapy, Blood, 2010, vol. 116, No. 26, pp. 5842-5848.

Fisch, P. et al., Generation of antigen-presenting cells for soluble protein antigens ex vivo from peripheral blood CD34+ hematopoietic progenitor cells in cancer patients. Eur J Immunol. Mar. 1996;26(3):595-600.

Fisher, K.J. And Wilson, J.M. The transmembrane domain of diphtheria toxin improves molecular conjugate gene transfer. Biochem. J. Jan. 1997; 321(1): 49-58.

Fishman, M., et al., In vitro transfer of macrophage RNA to lymph node cells. Nature. May 11, 1963;198:549-51.

Fisk, B. et al., Identification of an immunodominant peptide of HER-2/neu protooncogene recognized by ovarian tumor-specific cytotoxic T lymphocyte lines. J Exp Med. Jun. 1, 1995; 181 (6):2109-17.

Forsberg, G. et al., Therapy of Human Non-Small-Cell Lung Carcinoma Using Antibody Targeting of A Modified Superantigen, British Journal of Cancer, 2001, vol. 85, No. 1, pp. 129-136.

Forsberg, G et al., Naptumomab Eslafenatoz, an Engineered Antibody-superantigen Fusion Protein with Low Toxicity and Reduced Antigenicity, J Immunother, 2010, vol. 33, No. 5, pp. 492-499.

Francisco, Joseph et al., cAc10-vcMMAE, an Anti-CD30-monomethyl Auristatin E Conjugate with Potent and Selective Antitumor Activity, Blood, 2003,vol. 102, No. 4, pp. 1458-1465.

Frank, B. et al., Interanimal "memory" transfer: results from brain and liver homogenates. Science. Jul. 24, 1970;169 (3943):399-402.

Franklin, R.M., Purification and properties of the replicative intermediate of the RNA bacteriophage R17. Proc Natl Acad Sci US A. Jun. 1966;55(6):1504-11.

Freeman, Willard M. et al., Quantitative RT-PCR: Pitfalls and Potential, BioTechniques, 1999, vol. 26, No. 1, pp. 112-125.

Freudenberg, M. Johannes, et.al. Acute depletion of Tet1-dependent 5-hydroxymethylcytosine levels impairs LIF/Stat3 signaling and results in loss of embryonic stem cell identity. Published online Dec. 30, 2011. 3364-3377 Nucleic Acids Research, 2012, vol. 40, No. 8 Published by Oxford University Press 2011.

Frey, M.R. et al., RNA-mediated interaction of Cajal bodies and U2 snRNA genes. J Cell Biol. Aug. 6, 2001;154 (3):499-509.

Friese, Manuel A. et al., MICA/NKG2D-Mediated Immunogene Therapy of Experimental Gliomas, Cancer Res, 2003, vol. 63, pp. 8996-9006.

Fuke, Hiroyuki et al., Role of poly (a) tail as an identity element for mRNA nuclear export, Nucleic Acids Research, 2008, vol. 36 No. 3, pp. 1037-1049.

Fukuda, I. et al., in vitro evolution of single-chain antibodies using mRNA display. Nucleic Acids Res. 2006;34(19): e127. Epub Sep. 29, 2006.

Furie, Richard et al., A Phase 111, Randomized, Placebo-Controlled Study of Belimumab, a Monoclonal Antibody That Inhibits B Lymphocyte Stimulator, in Patients With Systemic Lupus Erythematosus, Arthritis & Rheumatism, 2011, vol. 63, No. 12, pp. 3918-3930.

Fusaki, N., et al., Efficient induction of transgene-free human pluripotent stem cells using a vector based on Sendai virus, an RNA virus that does not integrate into the host genome. Proc JPN Acad Ser B Phys Biol Sci. 2009; 85(8):348-362.

Fynan E.F. et al., DNA vaccines: protective immunizations by parenteral, mucosal, and gene-gun inoculations. Proc Natl Acad Sci US A. Dec. 15, 1993;90(24):11478-82.

Gall, J.G. et al., A role for Cajal bodies in assembly of the nuclear transcription machinery. FEBS Lett. Jun. 8, 2001;498(2-3):164-7.

Gall, J.G. The centennial of the Cajal body. Nat Rev Mol Cell Biol. Dec. 2003;4(12):975-80.

Gallie, D. R. The 5'-leader of tobacco mosaic virus promotes translation through enhanced recruitment of elF4F. Nuc Acids Res. 2002; 30(15): 3401-3411.

Gallie, D.R., A tale of two termini: a functional interaction between the termini of an mRNA is a prerequisite for efficient translation initiation. Gene. Aug. 17, 1998;216(1):1-11.

Gallie, D.R., The cap and poly(A) tail function synergistically to regulate mRNA translational efficiency. Genes Dev. Nov. 1991;5(11):2108-16.

Ganot, P. et al., Site-specific pseudouridine formation in preribosomal RNA is guided by small nucleolar RNAs. Cell. May 30, 1997;89(5):799-809.

Gao, G., et al., Erythropoietin gene therapy leads to autoimmune anemia in macaques. 2004 103: 3300-3302.

Gao, M. et al., A novel mRNA-decapping activity in Hela cytoplasmic extracts is regulated by AU-rich elements. EMBO J. Mar. 1, 2001;20(5):1134-43.

Gao, X. et al., Nonviral gene delivery: what we know and what is next. AAPS J. Mar. 23, 2007;9(1):E92-104.

Garbe, C. et al., [Epidemiology of malignant melanoma in West Germany in an international comparison]. Onkologie. Dec. 12, 1989(6):253-62.

Garber et al.; A sensitive and convenient method for lipoprotein profile analysis of individual mouse plasma samples. Journal of Lipid Research. 2000. 14: 1020-1026.

Garcia, Gilles et al., Anti-interleukin-5 Therapy in Serve Asthma, Rare Diseases and Orphan Drugs, 2013, vol. 22, No. #,pp. 251-257.

Garcia, Maria et al., Patient Consideration in the Management of Rheumatoid Arthritis: Role of Once-A-Month Golimumab Injection, Clinical Medical Insights: Therapeutics, Libertas Academica, 2011, vol. 3, No#, pp. 415-423.

Gardiner-Garden, M. et al., CpG islands in vertebrate genomes. J Mol Biol. Jul. 20, 1987;196(2):261-82.

Garin-Chesa, Pilar et al., Trophoblast and Ovarian Cancer Antigen LK26, American Journal of Pathology, 1993, vol. 142, No. 2, pp. 557-567.

Gasche, C. et al., Sequential treatment of anemia in ulcerative colitis with intravenous iron and erythropoietin. Digestion. 1999;60(3):262-7.

Geall et al., Nonviral delivery of self-amplifying RNA vaccines. Proc Natl Acad Sci U S A. Sep. 4, 2012;109(36):14604-9. doi:10.1073/pnas.1209367109. Epub Aug. 20, 2012.

Geijtenbeek, Teunis et al., Identification of DC-SIGN, A Novel Dendritic Cell-Specific ICAM-3 Receptor That Supports Primary Immune Responses, Cell, 2000, vol. 100, pp. 575-585.

GenBank NP_000651.3, Transforming growth factor beta-1 precursor [Homo sapiens] Nov. 13, 2011 [online]. [Revrieved Jan. 24, 2013]. Available on the internet <URL:http://www.ncbi.nlm.nich.gov/protein/63025222?sat=15&satkey=2270109>.

Genovese, Mark C et al., A phase 2 dose-ranging study of subcutaneous labalumab for the treatment of patients with active rheumatoid arthritis and an inadequate response to methotrexate, Ann Rheum Dis 2013; vol. 72, No#, pp. 1453-1460.

Genovese, Mark C et al., Efficacy and safety of secukinumab in patients with rheumatoid arthritis: a phase 11, dose- finding, double-blind, randomised, placebo controlled study, Ann Rheum Dis, 2013; vol. 72, No#, pp. 863-869.

Genovese, Mark C et al., Ocrelizumab, a Humanized Anti-CD20 Monoclonal Antibody, in the Treatment of Patients With Rheumatoid Arthritis, Arthritis & Rheumatism, 2008, vol. 58, No. 9, pp. 2652-2661.

Gerbi, SA et al., All small nuclear RNAs (snRNAs) of the [U4/U6.U5] Tri-snRNP localize to nucleoli; Identification of the nucleolar localization element of U6 snRNA. Mol Biol Cell. Sep. 2002;13(9):3123-37.

Gershon, P.O., (A)-tail of two polymerase structures. Nat Struct Biol. Oct. 2000;7(10):819-21.

Gevaert, Philippe, et al., Mepolizumab, a humanized anti-Il-5 mAb, as a treatment option for severe nasal polyposis, Rhinitis, sinusitis, and upper airway disease, J Allergy Clin Immunol, 2011, vol. 128, No. 5, pp. 989-995.

Ghazi, Aasia et al., Benralizumab—a humanized mAb to IL-5Ra with enhanced antibody-dependent cell-mediated cytotoxicity—a novel approach for the treatment of asthma, Expert Opin Biol Ther. 2012, vol. 12, No. 1, pp. 113-118.

(56) References Cited

OTHER PUBLICATIONS

Giblin, M. et al., Selective Targeting of *E.coli* Heat-stable Enterotoxin Analogs to Human Colon Cancer Cells, Anticancer Research, 2006,vol. 26, No number, pp. 3243-3252.

Gibson, D. et al., Creation of a Bacterial Cell Controlled by a Chemically Synthesized Genome, Science, 2010, vol. 329, No. 52, pp. 51-56.

Gibson, Daniel G., Chemical Synthesis of the Mouse Mitochondrial Genome, Nature Methods, vol. 7., No. 11 Nov. 2010, pp. 901-905.

Gierer, A and Schramm, G. Infectivity of ribonucleic acid from tobacco mosaic virus. Nature. Apr. 1956; 177(4511 ): 702-703.

Gilboa, E. et al., Cancer immunotherapy with mRNA-transfected dendritic cells. Immunol Rev. Jun. 2004;199:251-63.

Giljohann, DA, et al., Gene regulation with polyvalent siRNA-nanoparticle conjugates. J Am Chem Soc. Feb. 2009; 131 (6): 2072-2073.

Gilkeson, G.S. et al., Induction of cross-reactive anti-dsDNA antibodies in preautoimmune NZB/NZW mice by immunization with bacterial DNA. J Clin Invest. Mar. 1995;95(3):1398-402.

Gillies, Stephen et al., Antibody-targeted interleukin 2 stimulates T-cell killing of Autologous Tumor Cells, Proc. Natl. Acad. Sci., 1992, vol. 89, No#, pp. 1428-1432.

Ginsberg, S.D. et al., Expression profile of transcripts in Alzheimer's disease tangle-bearing CA1 neurons. Ann Neural. Jul. 2000;48(1):77-87.

Ginsberg, S.D. et al., Predominance of neuronal mRNAs in individual Alzheimer's disease senile plaques. Ann Neural. Feb. 1999;45(2):174-81.

Goel, N. et al, Certolizumab pegol, mAbs, 2010, vol. 2, No. 2, pp. 137-147.

Goldberg, I.H. et al., Comparative utilization of pseudouridine triphosphate and uridine triphosphate by ribonucleic acid polymerase. J Biological Chem. May 1963; 238(5): 1793-1800.

Goldberg, I.H. et al., The incorporation of 5-ribosyluracil triphosphate into RNA in nuclear extracts of mammalian cells. Biochemical Biophysical Research Communications. 1961; 6(5): 394-398.

Goldstein et al., History of Discovery: The LDL Receptor, Arterioscler Thromb Vase Biol. Apr. 2009; 29(4): 431-438.

Gonzalez, F. et al., Generation of mouse-induced pluripotent stem cells by transient expression of a single nonviral polycistronic vector. Proc Natl Acad Sci USA. Jun. 2, 2009; 106(22): 8918-8922.

Goodchild, John et al., Conjugates of Oligonucleolides and Modified Oligonucleolides: A Review of Their Synthesis and Properties, Bioconjugate Chemistry, 1990, vol. 1., No. 3., pp. 165-187.

Gordon, F.H., A Pilot Study of Treatment of Active Ulcerative Colitis With Natalizumab, a Humanized Monoclonal Antibody to Alpha-4 Integrin, Aliment Pharmacol Ther, 2002, vol. 16, No#, pp. 699-705.

Gordon, S.N. et al., Targeting the vaginal mucosa with human papillomavirus pseudovirion vaccines delivering SIV DNA. J Immunol. Jan. 15, 2012; 188(2): 714-723.

Grabbe, S. et al., Dendritic cells as initiators of tumor immune responses: A possible strategy for tumor immunotherapy? Immunol Today. Mar. 1995; 16(3): 117-21.

Grabbe, S. et al., Tumor antigen presentation by epidermal antigen-presenting cells in the mouse: modulation by granulocyte-macrophage colony-stimulating factor, tumor necrosis factor alpha, and ultraviolet radiation. J Leukoc Biol. Aug. 1992;52(2):209-17.

Grabbe, S. et al., Tumor antigen presentation by murine epidermal cells. J Immunol. May 15, 1991;146(10):3656-61.

Graf, M. et al., Codon-optimized genes that enable increased heterologous expression in mammalian cells and elicit efficient immune responses in mice after vaccination of naked DNA. Methods Mol Med. 2004;94:197-210.

Graf, T and Enver T. Forcing cells to change lineages. Nature. Dec. 3, 2009; 462(7273): 587-594.

Graham, Fl, et al., A new technique for the assay of infectivity of human adenovirus 5 DNA. Virology. Apr. 1973;52 (2):456-67.

Gram, G.J. et al., Immunological analysis of a Lactococcus lactis-based DNA vaccine expressing HIV gp120. Genet Vaccines Ther. Jan. 29, 2007;5:3.

Granstein, R.D. et al., Induction of anti-tumor immunity with epidermal cells pulsed with tumor-derived RNA or intradermal administration of RNA. J Invest Dermatol. Apr. 2000;114(4):632-6.

Grant, Ryan W. et al., Mechanisms of disease: inflammasome activation and the development of type 2 diabetes, Frontiers in Immunology, 2013, vol. 4, Article 50, pp. 1-10.

Greenblatt, M.S. et al., Mutations in the p53 tumor suppressor gene: clues to cancer etiology and molecular pathogenesis. Cancer Res. Sep. 15, 1994;54(18):4855-78.

Greenfeder, Scott et al., Th2 cytokines and asthma the role of interleukin-5 in allergic eosinophilic disease, Respiratory Research, 2001, vol. 2, No. 2, pp. 71-79.

Grentzmann, G. et al., A dual-luciferase reporter system for studying recoding signals. RNA. Apr. 1998;4(4):479-86.

Grosjean, H., et al. Fine-Tuning of RNA Functions by Modification and Editing. Topics in Current Genetics, vol. 12, 2005, XXiV, p. 442.

Grosjean, H., Modification and editing of RNA: historical overview and important facts to remember. Fine-tuning of RNA functions by modification and editing. Topics Curr Gen. Jan. 2005; 12: 1-22.

Gross, G. et al., Heterologous expression as a tool for gene identification and analysis. J Biol Chem. Jul. 31, 1995;41(2):91-110.

Grundy, Scott et al., Promise of Low-Density Lipoprotein-Lowering Therapy for Primary and Secondary Prevention, Circulation Journal of the American Heart Association, 2008, vol. 117, No#, pp. 569-573.

Grunig, Gabriele et al., Interleukin 13 and the evolution of asthma therapy, Am J Clin Exp Immunol, 2012;vol. 1, No. 1, pp. 20-27.

Guagnozzi, Danila et al., Natalizumab in the Treatment of Crohn's Disease, Biologics: Targets & Therapy, 2008, vol. 2, No. 2, pp. 275-284.

Guerrero-Cazares, Hugo et al. Biodegradable Polymeric Nanoparticles Show High Efficacy and Specificity at DNA Delivery to Human Glioblastoma in Vitro and in Vivo, ACS Nano, 2014, No vol., No#, pp. 1-14. Epub Apr. 29, 2014.

Guhaniyogi, J. et al., Regulation of mRNA stability in mammalian cells. Gene. Mar. 7, 2001;265(1-2):11-23.

Gunn, Charles, Hereditary Acholuric Jaundice in the Rat, Can M.J., 1944, vol. 50, pp. 230-237.

Guo, L. et al., Structure and function of a cap-independent translation element that functions in either the 3' or the 5' untranslated region. RNA. Dec. 2000;6(12):1808-20.

Guo, Z Sheng et al., Life after death: targeting high mobility group box 1 in emergent cancer therapies, Am J Cancer Res, 2013;vol. 3, No. 1 pp. 1-20.

Gupta et al., Project Report Codon Optimization, 2003, pp. 1-13.

Gupta, Shivali et al., TcVac3 Induced Control of Trypanosoma Cruzi Infection and Chronic Myocarditis in Mice, PLOS One, 2013, vol. 8, Issue 3, pp. 1-16.

Haas, J. et al., Codon usage limitation in the expression of HIV-1 envelope glycoprotein. Curr Biol. Mar. 1, 1996;6 (3):315-24.

Haft, D.H. et al., A guild of 45 CRISPR-associated (Cas) protein families and multiple CRISPR/Cas subtypes exist in prokaryotic genomes. PLoS Comput Biol. Nov. 2005; 1( 6): e60. Epub Nov. 11, 2005.

Hainsworth, John, Monoclonal Antibody Therapy in Lymphoid Malignancies, The Oncologist, 2000, vol. 5, No#, pp. 376-384.

Hakelien, A.M., et al., Novel approaches to transdifferentiation. Cloning Stem Cells. 2002;4(4):379-87.

Hakelien, A.M., Reprogramming fibroblasts to express T-cell functions using cell extracts. Nat Biotechnol. May 2002;20(5):460-6.

Hambraeus, G. et al., A 5' stem-loop and ribosome binding but not translation are important for the stability of Bacillus subtilis aprE leader mRNA. Microbiology. Jun. 2002;148(Pt 6):1795-803.

Hamid, Omid et al., Safety and Tumor Responses with Lambrolizumab (Anti-PD-1) in Melanoma, the New England Journal of Medicine, 2013, vol. 369, No. 2, pp. 134-144.

Hamrick, Mark W. et al., The skeletal muscle secretome: an emerging player in muscle—bone crosstalk, BoneKEy Reports, 2012, vol. 1, Article number: 60, pp. 1-5.

(56) References Cited

OTHER PUBLICATIONS

Han, Shuhong et al., Novel Autoantigens in Type 1 Diabetes, Am J Transl Res, 2013, vol. 5, No. 4, pp. 379-392.
Hancock, J.F., Reticulocyte lysate assay for in vitro translation and posttranslational modification of Ras proteins. Methods Enzymol. 1995;255:60-5.
Hanessian, S. et al., A highly stereocontrolled and efficient synthesis of alpha- and beta-pseudouridines. Tetrahedron Letters. 2003; 44: 8321-8323.
Hank, Jacquelyn, et al., Immunogenicity of the Hu14.18-IL2 Immunocytokine Molecule in Adults With Melanoma and Children With Neuroblastoma, Clinical Cancer Research, 2009, vol. 15, No. 18, pp. 5923-5930.
Hannon, G.J. et al., Trans splicing of nematode pre-messenger RNA in vitro. Cell. Jun. 29, 1990;61(7):1247-55.
Hansen, Thomas et al., Natural RNA Circles Function As Efficient MicroRNA Sponges, Nature, 2013, vol. 495, no number, pp. 384-390.
Harel, J., Action of polyribonucleotides, extracted by the phenol method, on the growth of mouse tumor cells. C.R. Hebd Seances Acad. Sci., 1962, 254:4390-2.
Harris, J. et al., An improved RNA amplification procedure results in increased yield of autologous RNA transfected dendritic cell-based vaccine. Biochim Biophys Acta. Jun. 20, 2005;1724(1-2):127-36. Epub Apr. 7, 2005.
Hart, Timothy K. et al., Preclinical efficacy and safety of mepolizumab (SB-240563), a humanized monoclonal antibody to IL-5, in cynomolgus monkeys, J Allergy Clin Immunol, 2001, vol. 108, No. 2, pp. 250-257.
Hausmann, R., Bacteriophage T7 genetics. Curr Top Microbiol Immunol. 1976;75:77- 110.
Hays, E.F. et al., Induction of mouse leukaemia with purified nucleic acid preparations. Nature. Dec. 21, 1957;180 (4599):1419-20.
He, K. et al., Synthesis and Separation of Diastereomers of Ribonucleoside 5'-(alpha-P-Borano)triphosphates. J Org Chem. Aug. 21, 1998;63(17):5769-5773.
Hecker, J.G. et al., Non-Viral DNA and mRNA Gene Delivery to the CNS Pre-Operatively for Neuroprotection and Following Neurotrauma. Molecular Therapy. 2004; 9, S258-S258.
Hedlund, Gunnar et al., The Tumor Targeted Superantigen ABR-217620 Selectively Engages TRBV7-9 and Exploits TCR-pMHC Affinity Mimicry in Mediating T Cell Cytotoxicity, PLOS One, 2013, vol. 8, Issue 10, pp. 1-17.
Hedman, M, et al., Safety and feasibility of catheter-based local intracoronary vascular endothelial growth factor gene transfer in the prevention of postangioplasty and in-stent restenosis and in the treatment of chronic myocardial ischemia: phase II results of the Kuopio Angiogenesis Trial (KAT). Circulation. Jun. 3, 2003; 107(21): 2677-83. Epub May 12, 2003.
Heidenreich, O. et al., Chemically modified RNA: approaches and applications. Faseb J. Jan. 1993;7(1):90-6.
Heidenreich, O. et al., High activity and stability of hammerhead ribozymes containing 2'-modified pyrimidine nucleosides and phosphorothioates. J Biol Chem. Jan. 21, 1994;269(3):2131-8.
Heil, F. et al., Species-specific recognition of single-stranded RNA via toll-like receptor 7 and 8. Science. Mar. 5, 2004;303(5663):1526-9. Epub Feb. 19, 2004.
Heilman, KL et al., Internal 6-methyladenine residues increase the in vitro translation efficiency of dihydrofolate reductase messenger RNA. Int J Biochem Cell Biol. Jul. 1996; 28(7): 823-829.
Heiser, A. et al., Autologous dendritic cells transfected with prostate-specific antigen RNA stimulate CTL responses against metastatic prostate tumors. J Clin Invest. Feb. 2002;109(3):409-17.
Heiser, A. et al., Human dendritic cells transfected with renal tumor RNA stimulate polyclonal T-cell responses against antigens expressed by primary and metastatic tumors. Cancer Res. Apr. 15, 2001;61(8):3388-93.
Heiser, A. et al., Human dendritic cells transfected with RNA encoding prostate-specific antigen stimulate prostate- specific CTL responses in vitro. J Immunol. May 15, 2000;164(10):5508-14.
Heiser, A. et al., Induction of polyclonal prostate cancer-specific CTL using dendritic cells transfected with amplified tumor RNA. J Immunol. Mar. 1, 2001;166(5):2953-60.
Helbock, H.J. et al. N2-methyl-8-oxoguanine: a tRNA urinary metabolite—role of xanthine oxidase. Free Radic Biol Med. 1996;20(3):475-81.
Helm, M., "Post-transcriptional nucleotide modification and alternative folding of RNA." Nucleic Acids Research, 2006, vol. 34, No. 2, pp. 721-733.
Hemmi, H. et al, A Toll-like receptor recognizes bacterial DNA. Nature. Dec. 7, 2000;408(6813):740-5.
Hentze, M., Circular RNAs: Splicing's Enigma Variations, The EMBO Journal, 2013, vol. 32, no number, pp. 923-925.
Herbst, Roy et al., Non-Small Cell Lung Cancer and Antiangiogenic Therapy: What Can Be Expected of Bevacizumab?, The Oncologist, 2004, vol. 9 Supp. 1, pp. 19-26.
Hernandez, Ana Maria et al., Anti-NeuGcGM3 Antibodies, Actively Elicited by Idiotypic Vaccination in Nonsmall Cell Lung Cancer Patients, Induce Tumor Cell Death by an Oncosis-Like Mechanism, The Journal of Immunology, 2011, vol. 186, No#, pp. 3735-3744.
Herweijer, H. et al., Gene therapy progress and prospects: hydrodynamic gene delivery. Gene Ther. Jan. 2007;14 (2):99-107. Epub Nov. 30, 2006.
Hess, M. et al., The effects of nucleic acids on pituitary ACTH content. Endocrinology. Mar. 1961;68:548-52.
High, Katherine, et al. The Gene Therapy Journey for Hemophilia: Are We There Yet?, Blood, 2012, vol. 120, No. 23, pp. 4482-4487.
Higman, Ma et al., The vaccinia virus mRNA (guanine-N7-)-methyltransferase requires both subunits of the mRNA capping enzyme for activity. J Biol Chem. Aug. 15, 1992;267(23):16430-7.
Hilleren, P. et al., Mechanisms of mRNA surveillance in eukaryotes. Annu Rev Genet. 1999;33:229-60.
Hillman, N.W. et al., Chick Cephalogenesis, I. The Effect of RNA on Early Cephalic Development. PNAS, 1963, 50:486-93.
Hillmen, Peter et al., Effect of Eculizumab on Hemolysis and Transfusion Requirements in Patients with Paroxysmal Nocturnal Hemoglobinuria,The New England Journal of Medicine, 2004, vol. 350, No. 6, pp. 552-559.
Ho, Cs., et al., Electrospray ionisation mass spectrometry: Principles and clinical applications. Clin Biochem Rev. Feb. 2003; 24: 3-12.
Hoath, S.B. et al., the organization of human epidermis: functional epidermal units and phi proportionality. J Invest Dermatol. Dec. 2003;121(6):1440-6.
Hochreiter-Hufford, Amelia et al., and Digestion Clearing the Dead: Apoptotic Cell Sensing, Recognition, Engulfment, Cold Spring Harb Perspect Biol, 2013, No Vol#, pp. 1-20.
Hodges, Peter E. et al., The spfash mouse: A missense mutation in the ornithine transcarbamylase gene also causes aberrant mRNA splicing, Genetics, Proc. Natl. Acad. Sci. USA, 1989,vol. 86, pp. 4142-4146.
Hoerr, I. et al., In vivo application of RNA leads to induction of specific cytotoxic T lymphocytes and antibodies. EurJ Immunol. Jan. 2000;30(1):1-7.
Hoerr, I. et al., Stabilized Messenger RNA (RNActiveTM) as a Tool for Innovative Gene Delivery. Tissue Engineering. Apr. 2007; 13(4): 865-925.
Hoerr, More than a messenger: A new class of drugs-mRNA-based therapeutics. Genetic Engineering & Biotechnology News. Jun. 18, 2013. http://www.genengnews.com/gen-articles/more-than-a-messenger-a-new-class-of-drugs-mrna-based-therapeutics/4916/ [last accessed Mar. 25, 2016].
Hoffman, Brad et al., Nonredundant Roles of IL-10 and TGF-beta in Suppression of Immune Responses to Hepatic AAV- Factor IX Gene Transfer, The American Society of Gene and Cell Therapy, 2011, vol. 19, No. 7, pp. 1263-1272.
Hofman et al., CYP7A1 A-278C Polymorphism Affects the Response of Plasma Lipids after Dietary Cholesterol or Cafestol Interventions in Humans, The Journal of Nutrition, 2004, pp. 2200-2204.
Holcik, M. et al., Four highly stable eukaryotic mRNAs assemble 3' untranslated region RNA-protein complexes sharing cis and trans components. Proc Natl Acad Sci U S A. Mar. 18, 1997;94(6):2410-4.

(56) References Cited

OTHER PUBLICATIONS

Hole, N. et al., A 72 kD trophoblast glycoprotein defined by a monoclonal antibody, Br. J. Cancer 1988, vol. 57, No. #, pp. 239-246.
Holmes, D. et al., Cell positioning and sorting using dielectrophoresis. Eur Cell Mater. 2002; 4(2):120-2.
Holtkamp, S. et al., Modification of antigen-encoding RNA increases stability, translational efficacy, and T-cell stimulatory capacity of dendritic cells. Blood. Dec. 15, 2006;108(13):4009-17.
Hooks, Michael et al., Muromonab CD-3: A Review of Its Pharmacology, Pharmacokinetics, and Clinical Use in Transplantation, Pharmacotherapy, 1991, vol. 11, No. 1, pp. 26-37.
Hopkins, Benjamin et al., A Secreted PTEN Phosphatase That Enters Cells to Alter Signaling and Survival, Science, 2013,vol. 341, No. 399, pp. 399-341.
Hornung, V. et al., 5'-triphosphate RNA is the ligand for RIG-I. Science. Nov. 10, 2006; 314(5801): 994-997.
Houghton, A.N. et al., Cancer antigens: immune recognition of self and altered self. J Exp Med. Jul. 1, 1994;180 (1):1-4.
Hovingh et al., Diagnosis and treatment of familial hypercholesterolaemia, European Heart Journal (2013) 34, 962-971.
Hsu, F.J. et al., Vaccination of patients with B-cell lymphoma using autologous antigen-pulsed dendritic cells. Nat Med. Jan. 1996;2(1):52-8.
Hu, B., et al., Neural differentiation of human induced pluripotent stem cells follows developmental principles but with variable potency. Natl Acad Sci. Mar. 2010; 107(9): 4335-4340.
Hu, S. et al., Codon optimization, expression, and characterization of an internalizing anti-ErbB2 single-chain antibody in Pichia pastoris. Protein Expr Purif. May 2006;47(1):249-57. Epub Dec. 13, 2005.
Huang, Kelly et al., Respiratory Syncytial Virus-Neutralizing Monoclonal Antibodies Motavizumab and Palivizumab Inhibit Fusion, Journal of Virology, Aug. 2010, vol. 84, No. 16, pp. 8132-8140.
Huangfu, D. et al., Induction of pluripotent stem cells from primary human fibroblasts with only Oct. 4 and Sox2. Nat Biotechnol. Nov. 2008; 26(11): 1269-1275.
Huangfu, D., et al., Induction of pluripotent stem cells by defined factors is greatly improved by small-molecule compounds. Nat Biotech. Jul. 2008; 26(7) 795-797.
Huddleston, J.A. et al., The sequence of the nucleoprotein gene of human influenza A virus, strain A/NT/60/68. Nucleic Acids Res. Feb. 11, 1982;10(3):1029-38.
Hue, K.K. et al., A polypurine sequence that acts as a 5' mRNA stabilizer in Bacillus subtilis. J Bacterial. Jun. 1995;177 (12):3465-71.
Huizinga, Tom W Jet al., Sarilumab, a fully human monoclonal antibody against IL-6Ra in patients with rheumatoid arthritis and an inadequate response to methotrexate: efficacy and safety results from the randomized SARIL-RA-MOBILITY Part A trial, Ann Rheum Dis, 2013; No vol. pp. 1-9.
Humbert, Marc et al., Relationship between IL-4 and IL-5 mRNA Expression and Disease Severity in Atopic Asthma, Am J Respir Crit Care Med, 1997, vol. 156, No#, pp. 704-708.
Hung, C.F. et al., Ovarian cancer gene therapy using Hpv-16 pseudovirion carrying the HSV-tk gene. PLoS One. 2012 Jul.; 7(7): e40983.
Hunt, D.M., et al., the L Protein of Vesicular Stomatitis Cirus Modulates the Response of the Polyadenylic Acid Polymerase to S-Adenosylhomocysteine. J. gen. Virol. (1988), 69, 2555-2561.
Hutas, Ocrelizumab, a humanized monoclonal antibody against CD20 for inflammatory disorders and B-cell malignancies, Curr Opin Investig Drugs, 2008, vol. 11, Nov, pp. 1206-16. (Abstract Only).
Hwang, Woong Yet al., Efficient genome editing in zebrafish using a Crispr-Cas system, Nature Biotechnology, 2013, No vol. pages 1-3.
Ieda, M. et al., Direct reprogramming of fibroblasts into functional cardiomyocytes by defined factors. Cell. Aug. 6, 2010; 142(3): 375-386.
Imbimbo, Bruno Pet al., Solanezumab for the treatment of mild-lo-moderate Alzheimer's disease, Expert Rev. Clin. Immunol., 2012, vol. 8, No. 2, pp. 135-149.
Inaba, K. et al., Dendritic cells pulsed with protein antigens in vitro can prime antigen-specific, Mhc-restricted T cells in situ. J Exp Med. Aug. 1, 1990;172(2):631-40.
Inaba, K. et al., Direct activation of Cob+ cytotoxic T lymphocytes by dendritic cells. J Exp Med. Jul. 1, 1987;166 (1):182-94.
Inaba, K. et al., Generation of large Nos. Of dendritic cells from mouse bone marrow cultures supplemented with granulocyte/macrophage colony-stimulating factor. J Exp Med. Dec. 1, 1992;176(6): 1693-702.
Innis, M., Dna Sequencing with Thermus Aquaticus Dna Polymerase and Direct Sequencing of Polymerase Chain Reaction-Amplified Dna, Proc. Natl. Acad. Sci. Usa, 1988, vol. 85, pp. 9436-9440.
International Search Report from International Application no. PCT/US10/059305 dated Aug. 23, 2011.
International Search Report from International Application No. PCT/US10/059317 dated Aug. 22, 2011.
International Search Report from International Application No. PCT/US2012/068714, dated Aug. 6, 2013.
International Preliminary Report on Patentability for related application PCT/US2012/031781, dated Oct. 1, 2013.
International Search Report and Written Opinion from International Application No. PCT/US13/030067 dated Dec. 20, 2013.
International Search Report and Written Opinion from International Application No. PCT/US13/062943 dated Jan. 7, 2014.
International Search Report and Written Opinion from International Application No. PCT/US2011/54636 dated Apr. 17, 2013.
International Search Report from International Application No. PCT/US11/54617 dated Feb. 1, 2012.
International Search Report from International Application No. PCT/US12/054574, dated Jul. 1, 2013.
International Search Report from International Application No. PCT/US12/38028 dated Aug. 14, 2012.
International Search Report from International Application No. PCT/US12/54561 dated Feb. 26, 2013.
International Search Report from International Application No. PCT/US12/58519 dated Feb. 28, 2013.
International Search Report from International Application No. PCT/US12/68732 dated Feb. 22, 2013.
International Search Report from International Application No. PCT/US12/69610 dated Feb. 27, 2013.
International Search Report from International Application No. PCT/US12/71105 dated Mar. 5, 2013.
International Search Report from International Application No. PCT/US12/71118 dated Apr. 5, 2013.
International Search Report from International Application No. PCT/US13/030070 dated Dec. 23, 2013.
International Search Report from International Application No. PCT/US13/20921 dated Mar. 26, 2013.
International Search Report from International Application No. PCT/US13/54635 dated Mar. 3, 2014.
International Search Report from International Application No. PCT/US2012/031781 dated Jan. 11, 2013.
International Search Report from International Application No. PCT/US2013/030062 dated Oct. 21, 2013.
International Search Report from International Application No. PCT/US2013/030064 dated Oct. 21, 2013.
International Search Report, PCT/US2013/75177, dated May 5, 2014, pp. 1-20.
International Search Report, PCT/US2014/020206, dated May 23, 2014, pp. 1-9, Inventor Stephane Bancel, Title: Diagnosis and Treatment of Fibrosis, Filing Date: Mar. 4, 2014.
Issa Ghayas et al., Novel Agents in Waldenstrom Macroglobulinemia, Clin Investig, 2011, vol. 1, No. 6, pp. 815-824.
Ito, Asahi et al., Defucosylated anti-CCR4 monoclonal antibody exercises potent ADCC-mediated antitumor effect in the novel tumor-bearing humanized NOD/Shi-scid, IL-2Rynull mouse model, Cancer Immunol Immunother, 2009, vol. 58, No#, pp. 1195-1206.

(56) References Cited

OTHER PUBLICATIONS

Ito, M.K. ISIS 301012 gene therapy for hypercholesterolemia: sense, antisense, or nonsense? Ann Pharmacother. Oct. 2007; 41(10): 1669-78.
International Preliminary Report on Patentability for International Application No. PCT/US2014/027453, dated Sep. 15, 2015, 7 pages.
International Preliminary Report on Patentability for International Application No. PCT/US2014/058967, dated Apr. 5, 2016, 10 pages.
International Search Report and Written Opinion for International Application No. PCT/US2014/027453, dated Jul. 16, 2014, 13 pages.
International Search Report for related application PCT/US2011/46861, dated Apr. 13, 2012.
Written Opinion for International Application No. PCT/US2014/058967, dated Feb. 3, 2015, 9 pages.
Ito, Shinsuke, et.al. Role of Tel proteins in 5mC to 5hmC conversion, ES-cell self-renewal and inner cell mass specification. vol. 466 | Aug. 26, 2010 | Macmillan Publishers Limited. pp. 1129-1133.
Ivanovska, N. et al., Immunization with a DNA chimeric molecule encoding a hemagglutinin peptide and a scFv CD21-specific antibody fragment induces long-lasting IgM and CTL responses to influenza virus. Vaccine. Mar. 10, 2006;24(11):1830-7. Epub Nov. 2, 2005.
Iwasaki, A. et al., Enhanced CTL responses mediated by plasmid DNA immunogens encoding costimulatory molecules and cytokines. J Immunol. May 15, 1997;158(10):4591-601.
lyanagi, Takashi et al., Molecular Basis of Multiple UDP-Glucuronosyltransferase Isoenzyme Deficiencies in the Hyperbilirubinemic Rat (Gunn Rat), 1991, vol. 266, No. 35, pp. 24048-24052.
Jachertz, D. et al., Treatment of P815 mastocytoma in DBA/2 mice with RNA. J Immunogen. 1974; 1: 355-362.
Jacobsen, Lars et al., Allergen-specific Immunotherapy Provide Immediate, Long-Term and Preventive Clinical Effects in Children and Adults: The Effects of Immunotherapy Can be Categorised by Level of Benefit-the centenary of Allergen Specific Subcutaneous Immunotherapy, Clinical and Translational Allergen, 2012, vol. 2, No. 8, pp. 1-11.
Jady, B.E. et al., A small nucleolar guide RNA functions both in 2'-O-ribose methylation and pseudouridylation of the U5 spliceosomal RNA. EMBO J. Feb. 1, 2001;20(3):541-51.
Jaffers, Gregory et al., Monoclonal Antibody Therapy, Transplantation, 1986, vol. 41, No. 5, pp. 572-578.
Jaglowski, Samantha et al., The clinical application of monoclonal antibodies in chronic lymphocytic leukemia, Blood, 2010, vol. 116, No#, pp. 3705-3714.
Janeway, C. et al., Immunobiology: the immune system in health and disease. Garland Publishing, Inc, London. 1997; 13:12-13:21.
Jansen, P.L.M., Diagnosis and management of Crigler-Najjar syndrome. Eur J Pediatr. Dec. 1999;158 [Suppl 2]:S89-S94.
Janssens, S. et al., Role of Toll-like receptors in pathogen recognition. Clin Microbial Rev. Oct. 2003;16(4):637-46.
Jeck, William et al. Circular RNAs Are Abundant, Conserved, and Associated with ALU Repeats, RNA, 2013, vol. 19, pp. 141-157.
Jemielity, J. et al., Novel "anti-reverse" cap analogs with superior translational properties. RNA. 2003 Sep;9 (9):1108-22.
Jia, F., et al., A nonviral minicircle vector for deriving human iPS Cells. Nat Methods. Mar. 2010; 7(3): 197-199.
Jia, Guiquan et al., Periostin is a systemic biomarker of eosinophilic airway inflammation in asthmatic in asthmatic patients, J Allergy Clin Immunol, 2012, vol. 130, No. 3, pp. 647-654.
Jia, Z., et al., Long-term correction of hyperbilirubinemia in the Gunn Rat by repealed intravenous delivery of naked plasmid DNA into muscle. Mol Ther. Nov. 2005; 12(5): 860-866.
Jiang, J. et al., Topical application of ketoconazole stimulates hair growth in C3H/HeN mice. J Dermatol. Apr. 2005;32 (4):243-7.
Jin, Wei et al., IL-17 cytokines in immunity and inflammation, Emerging Microbes and Infections, 2013, vol. 2, No.#, pp. 1-5.

Jinek, M. et al., A programmable dual-RNA-guided DNA endonuclease in adaptive bacterial immunity. Science. Aug. 17, 2012; 337(6096): 816-821.
Jirikowski, G.F., et al., Reversal of diabetes insipidus in Brattleboro Rats: Intrahypothalamic injection of vasopressin mRNA. Science. Feb. 1992; 255(5047): 996-998.
Johnson, K.M. et al., Role of heparan sulfate in attachment to and infection of the murine female genital tract by human papillomavirus. J Virol. Mar. 2009; 83(5): 2067-2074.
Jones, P.C.T., An Alteration in Cell Morphology under the influence of a Tumor RNA. Nature, 1964,202:1226-7.
Juliano, R.L., et al., Cell-targeting and cell-penetrating peptides for delivery of therapeutic and imaging agents. Wiley Interdisciplinary Reviews: Nanomedicine and Nanobiotechnology. May/Jun. 2009; 1(3): 324-335.
Julien, Jean-Philippe et al., Broadly Neutralizing Antibody PGT121 Allosterically Modulates CD4 Binding via Recognition of the HIV-1 gp120 V3 Base and Multiple Surrounding Glycans, PLOS Pathogens, 2013, vol. 9, Issue 5, pp. 1-15.
Kabanov, A.V. et al., A new class of antivirals: antisense oligonucleotides combined with a hydrophobic substituent effectively inhibit influenza virus reproduction and synthesis of virus-specific proteins in MDCK cells. FEBS Lett. Jan. 1, 1990;259(2):32730.
Kadakol, Ajil et al., Genetic Lesions of Bilirubine-diphosphoglucuronate Glucuronosyltransferase (UGT1A1) Causing Crigler-Najjar and Gilbert Syndromes: Correlation of Genotype to Phenotype, Human Mutation, 2000, vol. 16, No#, pp. 297-306.
Kahan, F.M. et al., The role of deoxyribonucleic acid in ribonucleic acid synthesis*. J Biological Chem. Dec. 1962; 287 (12): 3778-3785.
Kaji, K., et al., Virus free induction of pluripotency and subsequent excision of reprogramming factors. Nature. Apr. 2009; 458(7239): 771-775.
Kallen et al., A novel, disruptive vaccination technology: self-adjuvanted RNActive(®) vaccines. Hum Vaccin Immunother. Oct. 2013;9(10):2263-76. doi: 10.4161/hv.25181. Epub Jun. 4, 2013. Review.
Kalnins, A. et al., Sequence of the lacZ gene of *Escherichia coli*. EMBO J. 1983;2(4):593-7.
Kanaya, S. et al., Codon usage and tRNA genes in eukaryotes: correlation of codon usage diversity with translation efficiency and with CG-dinucleotide usage as assessed by multivariate analysis. J Mol Evol. Oct.-Nov. 2001;53(4-5):290-8.
Kandimalla, E.R. et al., Divergent synthetic nucleotide motif recognition pattern: design and development of potent immunomodulatory oligodeoxyribonucleotide agents with distinct cytokine induction profiles. Nucleic Acids Res. May 1, 2003;31(9):2393-400.
Kandimalla, E.R. et al., Immunomodulatory oligonucleotides containing a cytosine-phosphate-2'-deoxy-7-deazaguanosine motif as potent toll-like receptor 9 agonists. Proc Natl Acad Sci U S A. May 10, 2005;102(19):6925-30. Epub Apr. 28, 2005.
Kane, Lawrence P. et al., Tim Proteins and Immunity, J Immunol., 2010; vol. 184, No. (6): 2743-2749.
Kang, Hyunmin, Inhibition of MDR1 Gene Expression by Chimeric HNA Antisense Oligonucleotides, Nucleic Acids Research, 2004, vol. 32, No. 14, pp. 4411-4419.
Kappos, Ludwig, et al., Ocrelizumab in relapsing-remitting multiple sclerosis: A phase 2, randomised, placebo- controlled, multicentre trial, The Lancet, 2011, vol. 378, Issue 9805, pp. 1779-1787. Abstract Only.
Karande, AA,et al., In vitro induction of chronic myeloid leukemia associated immune reactivity in normal human lymphocytes by xenogeneic immune RNA. Neoplasma, 1983, 30(4):403-9.
Kariko et al., Phosphate-enhanced transfection of cationic lipid-complexed mRNA and plasmid DNA. Biochimica et Biophysica Acta. 1998. 1369:320-34.
Kariko, K. et al., Generating the optimal mRNA for therapy: HPLC purification eliminates immune activation and improves translation of nucleoside-modified, protein-encoding mRNA. Nucleic Acids Res. vol. 39, No. 21, Nov. 2011, pp. e142-1, XP002696190.

(56) References Cited

OTHER PUBLICATIONS

Kariko, K. et al., Incorporation of pseudouridine into mRNA yields superior nonimmunogenic vector with increased translational capacity and biological stability. Mol Ther. Nov. 2008; 16(11):1833-40. Epub Sep. 16, 2008.
Kariko, K. et al., mRNA is an endogenous ligand for Toll-like receptor 3. J Biol Chem. Mar. 26, 2004;279 (13):12542-50. Epub Jan. 16, 2004.
Kariko, K. et al., Suppression of RNA recognition by Toll-like receptors: the impact of nucleoside modification and the evolutionary origin of RNA. Immunity. Aug. 2005;23(2):165-75.
Kariko, Katalin, et al., Impacts of Nucleoside Modification on RNA-mediated activation of toll-like receptors, 2008, Nucleic Acides in Innate Immunity, No vol., pp. 171-188.
Kariko, K., et al., In vivo protein expression from mRNA delivered into adult rat brain. J. of Neuroscience Methods. Jan. 2001; 105(1): 77-86.
Kariko, K., et al., Increased erythropoiesis in mice injected with submicrogram quantities of pseudouridine-containing mRNA encoding erythropoietin. Mol Ther. May 2012; 20(5): 948-953.
Kariko, Katalin, et.al. Naturally occurring nucleoside modifications suppress the immunostimulatory activity of RNA: Implication for therapeutic RNA development. Current Opinion in Drug Discovery & Development 2007 10(5) 523-532; The Thomson Corporation ISSN 1367-6733.
Karlin, S. et al., Applications and statistics for multiple high-scoring segments in molecular sequences. Proc Natl Acad Sci U S A. Jun. 15, 1993;90(12):5873-7.
Katre, Nv. et al., Chemical modification of recombinant interleukin 2 by polyethylene glycol increases its potency in the murine Meth A sarcoma model. Proc Natl Acad Sci U S A. Mar. 1987;84(6):1487-91.
Katz, N., et al., Rapid onset of cutaneous anesthesia with EMLA cream after pretreatment with a new ultrasound- emitting device. Anesth Analg. 2004; 98: 371-376.
Kaur, Sukhwinder et al., Mucins in pancreatic cancer and its microenvironment, Nature Reviews, 2013, No vol., pp. 1-14.
Kausar, Fariha et al., Ocrelizumab: A Step Forward in the Evolution of B-Cell Therapy, Expert Opinion Biol. Ther., 2009, vol. 9, No. 7, pp. 889-895.
Kawai, T., et al., Antiviral signaling through pattern recognition receptors. J. Biochem. 2007; 141(2): 137-145.
Kawamura, T., et al., Linking the p53 tumor suppressor pathway to somatic cell reprogramming. Nature. Aug. 2009; 460(7259): 1140-1144.
Kazmierczak, K.M. et al., The phage N4 virion RNA polymerase catalytic domain is related to single-subunit RNA polymerases. Embo J. Nov. 1, 2002;21(21):5815-23.
Keegan, Liam P. et al., The Many Roles of an RNA Editor, Nature Reviews, Genetics, 2001, vol. 2, No#, pp. 869-878.
Keith, B., et al., HIF1a and HIf1a: sibling rivalry in hypoxic tumor growth and progression. Nat Rev Cancer. Jul. 2012; 12(1): 9-22.
Keller, E.B. et al., Intron splicing: a conserved internal signal in intrans of animal pre-mRNAs. Proc Natl Acad Sci U S A. Dec. 1984;81(23):7417-20.
Kelly, Kimberley et al. , Isolation of a Colon Tumor Specific Binding Peptide Using Phage Display Selection, Neoplasia, 2003, vol. 5, No. 5, pp. 437-444.
Kempeni, Joachim et al., Preliminary Results of Early Clinical Trials with the Fully Human Anti-TN Fa Monoclonal Antibody D2E7, Ann Rheum Dis, 1999, vol. 58, Supp I, pp. 170-172.
Kenneth Stanley, Design of Randomized Controlled Trials, Circulation, 2007; 115: pp. 1164-1169.
Keown, Wa, et al., [41] Methods for Introducing DNA into Mammalian Cells. Methods in Enzymology, 1990, 185:527-37.
Keshishian, H., et al., Quantification of cardiovascular biomarkers in patient plasma by targeted mass spectrometry and stable isotope dilution. Mol Cell Proteomics. Oct. 2009; 8(10): 2339-2349.
Kesselheim, A.S., An empirical review of major legislation affecting drug development: Past experiences, effects, and unintended consequences. The Milbank Quarterly. 2011; 89(3): 450-502.
Khare, P.D. et al., Tumor growth suppression by a retroviral vector displaying scFv antibody to CEA and carrying the iNOS gene. Anticancer Res. Jul.-Aug. 2002;22(4):2443-6.
Khullar, N. et al., Comparative evaluation of the protective effect of immune spleen cells and immune RNA against Plasmodium berghei. Ann. Trap. Med. Parasitol., 1988, 82(6):519-26.
Kim, Busun et al., The Interleukin-1a precursor is Biologically Active and Is Likely a Key Alarmin in the IL-1 Family of Cytokines, Frontiers in Immunology, 2013, vol. 4, Article 391, pp. 1-9.
Kim, C.H. et al., Codon optimization for high-level expression of human erythropoietin (EPO) in mammalian cells. Gene. Oct. 15, 1997;199(1-2):293-301.
Kim, D., et al., Generation of human induced pluripotent stem cells by direct delivery of reprogramming proteins. Cell Stem Cell. Jun. 2009; 4(6): 472-476.
Kim, Hwan Keun et al., Nontoxigenic Protein A Vaccine for Methicillin-Resistant Staphylococcus Aureus Infections In Mice, The Journal of Experimental Medicine, 2010, vol. 207, No. 9, pp. 1863-1870.
Kim, S.H. et al., Opsonized erythrocyte ghosts for liver-targeted delivery of antisense oligodeoxynucleotides. Biomaterials. Feb. 2009; 30(5): 959-967. Epub Nov. 22, 2008.
Kim, Sunjung et al, Transcriptional Suppression of Interleukin-12 Gene Expression following Phagocytosis of Apoptotic Cells, Immunity, 2004, vol. 21, No#, pp. 643-653.
Kines, Rc. et al., The initial steps leading to papillomavirus infection occur on the basement membrane prior to cell surface binding. PNAS. Dec. 1, 2009; 106(48): 20458-20463.
Kinjyo, Ichiko et al., SOCS1/JAB is a Negative Regulator of LPD-Induced Macrophage Activation, Immunity, 2002, vol. 17, No number, pp. 583-591.
Kinosita, K. Jr. et al., Formation and resealing of pores of controlled sizes in human erythrocyte membrane. Nature. Aug. 4, 1997;268(5619):438-41.
Kips, Johan et al., Effect of SCH55700, a Humanized Anti-Human Interleukin-5 Antibody, in Severe Persistent Asthma, American Journal of Respiratory and Critical Care Medicine, Safety of Anti-Il-5 in Asthma, vol. 167, pp. 1655-1659.
Kirby, K.S., A New Method for the Isolation of Ribonucleic Acids from Mammalian Tissues. J. Biochem., 1956, 64:405.
Kirpotin, D.B., et al., Antibody targeting of long-circulating lipidic nanoparticles does not increase tumor localization but does increase internalization in animal models. Cancer Res. 2006; 66: 6732-6740.
Kirshenbaum, et al., Designing polymers that mimic biomolecules. Curr Opin Struct Biol, 1999, 9:530-5.
Kiss, T., Small nucleolar RNA-guided post-transcriptional modification of cellular RNAs. EMBO J. Jul. 16, 2001;20 (14):3617-22.
Kiss, T., Small nucleolar RNAs: an abundant group of noncoding RNAs with diverse cellular functions. Cell. Apr. 19, 2002;109(2):145-8.
Kitaguchi, K. et al., Immune deficiency enhances expression of recombinant human antibody in mice after nonviral in vivo gene transfer. Int J Mol Med. Oct. 2005;16(4):683-8.
Kiwaki et al., Correction of Ornithine Transcarbamylase Deficiency in Adult splash Mice and in OTC-Deficient Human Hepatocytes with Recombinant Adenoviruses Bearing the CAG Promoter; Human Gene Therapy, 1996, vol. 7, pp. 821-830.
Klinman, D.M. et al., DNA vaccines: safety and efficacy issues. Springer Semin Immunopathol. 1997;19(2):245-56.
Knowles, Lynn et al., CLT1 Targets Angiogenic Endothelium through CLIC1 and Fibronectin, Angiogenesis, 2012, vol. 15, No. 1, pp. 115-129.
Koch, G. and Bishop, J.M. The effect of polycations on the interaction of viral RNA with mammalian cells: Studies on the infectivity of single- and double-stranded poliovirus RNA. Virology. May 1968; 35(1): 9-17.
Koch, G., et al., An agar cell-suspension plaque assay for isolated viral RNA. Biochem and Biophys Res Comm. 1966; 24(3): 304-309.

(56) References Cited

OTHER PUBLICATIONS

Koch, G., et al., Quantitative Studies on the Infectivity of ribonucleic acid from partially purified and highly purified poliovirus preparations. Virology. Mar. 1960; 10(3): 329343.

Koenigsknecht-Talboo, Jessica et al., Rapid Microglial Response Around Amyloid Pathology after Systemic Anti-Abeta Antibody Administration in PDAPP Mice, the Journal of Neuroscience, 2008, vol. 28, No. 52, pp. 14156-1414.

Koh, Peng Kian, et.al. Tell and Tel2 Regulate 5-Hydroxymethylcytosine Production and Cell Lineage Specification in Mouse Embryonic Stem Cells. 200-213, Feb. 4, 2011; *a* 2011 Elsevier Inc.

Kohler, G. et al., Continuous cultures of fused cells secreting antibody of predefined specificity. Nature. Aug. 7, 1975;256(5517):495-7.

Koide, Y. et al., DNA vaccines. Jpn J Pharmacol. Jul. 2000;83(3):167-74.

Koido, S. et al., Induction of antitumor immunity by vaccination of dendritic cells transfected with MUC1 RNA. J Immunol. Nov. 15, 2000;165(10):5713-9.

Kolb, A.F. et al., A virus-neutralising antibody is not cytotoxic in vitro. Mol Immunol. Feb. 2006;43(6):677-89.

Kolbeck, Roland et al., MEDI-563, a humanized anti-IL-5 receptor a mAb with enhanced antibody-dependent cell- mediated cytotoxicity function, J Allergy Clin Immunol, vol. 125, No. 6, pp. 1344-1353.

Komar, AA et al., Synonymous codon substitutions affect ribosome traffic and protein folding during in vitro translation. FEBS Lett. Dec. 3, 1999;462(3):387-91.

Kontermann, Re. et al., Recombinant bispecific antibodies for cancer therapy. Acta Pharmacol Sin. Jan. 2005;26 (1):1-9.

Kore, Anilkumar R., et al. Synthesis and biological validation of N7-(4chlorophenoxyethyl) substituted dinucleotide cap analogs for mRNA translation. Bioorganic Medicinal Chemistry 21 (2013), pp. 4570-4574.

Koren, Michel J. et al., Efficacy and Safety of Longer-Term Administration of Evolocumab (AMG 145) in Patients With Hypercholesterolemia: 52-Week Results From the Open-Label Study of Long-Term Evaluation Against LDL-C (Osler) Randomized Trial, Circulation, 2013, No vol., pp. 1-20.

Korsten, K.H. et al., The strategy of infection as a criterion for phylogenetic relationships of non-coli phages morphologically similar to phage T7. J Gen Virol. Apr. 1979;43(1):57-73.

Koski, G.K. et al., Cutting edge: innate immune system discriminates between RNA containing bacterial versus eukaryotic structural features that prime for high-level IL-12 secretion by dendritic cells. J Immunol. Apr. 1, 2004;172(7):3989-93.

Kozak, Marilyn, Regulation of translation via mRNA structure in prokaryotes and eukaryotes, Gene 361 (2005), pp. 13-37.

Kozielski, Kristen L. et al., Bioreducible Cationic Polymer-Based Nanoparticles for Efficient and Environmentally Triggered Cytoplasmic siRNA Delivery to Primary Human Brain Cancer Cells, ACS Nano, 2014, vol. 8,' No. 4 ',pp. 3232-3241.

Kreiter, S., et al., Intranodal vaccination with naked antigen-encoding RNA elicits potent prophylactic and therapeutic antitumoral immunity. Cancer Res. 2010; 70: 9031-9040.

Kreiter, S., et al., Tumor vaccination using messenger RNA: prospects of a future therapy. Curr Opinion in Immun. Jun. 2011; 23(3): 399-406.

Kreitman, Robert J. et al., Antibody Fusion Proteins: Anti-CD22 Recombinant Immunotoxin Moxetumomab Pasudotox, Clinical Cancer Research, 2011, vol. 17, No#, pp. 6398-6405.

Krieg, Pa et al., Functional messenger RNAs are produced by SP6 in vitro transcription of cloned cDNAs. Nucleic Acids Res. Sep. 25, 1984;12(18):7057-70.

Krieg, Pa et al., In vitro RNA synthesis with SP6 RNA polymerase. Methods Enzymol. 1987;155:397-415.

Kudla, G. et al., High guanine and cytosine content increases mRNA levels in mammalian cells. PLoS Biol. Jun. 2006;4(6):e180. Epub May 23, 2006.

Kuenen, Bart et al., A Phase I Pharmacologic Study of Necitumumab (IMC-11 F8), a Fully Human IgG 1 Monoclonal Antibody Directed Against EGFR in Patients with Advanced Solid Malignancies, Clinical Cancer Research, 2010, vol. 16, No#, pp. 1915-1923.

Kugelman et al., Evaluation of the potential impact of Ebola virus genomic drift on the efficacy of sequence-based candidate therapeutics. MBio. Jan. 20, 2015;6(1). pii: e02227-14.

Kugler, A. et al., Regression of human metastatic renal cell carcinoma after vaccination with tumor cell-dendritic cell hybrids. Nat Med. Mar. 2000;6(3):332-6.

Kuhn, A.N., et al., mRNA as a versatile tool for exogenous protein expression. Current Gene Therapy. Oct. 2012; 12 (5): 347-361.

Kuhn, E., et al., Developing multiplexed assays for Troponin I and Interleukin-33 in plasma by peptide immunoaffinity enrichment and targeted mass spectrometry. Clinical Chem. 2009; 55(6): 1108-1117.

Kundu, T.K. et al., CpG islands in chromatin organization and gene expression. J. Biochem. Feb. 1999;125(2):217-22.

Kurzrock, Razelle et al., a Phase I, Open-Label Study of Siltuximab, an Anti-IL-6 Monoclonal Antibody, in Patients with 44 B-cell Non-Hodgkin Lymphoma, Multiple Myeloma, or Castleman Disease. Clinical Cancer Research, 2013, vol. 19, No#, pp. 3659-3670.

Kusakabe, K. et al., the liming of Gm-Csf expression plasmid administration influences the Th1/Th2 response induced by an HIV-1-specific DNA vaccine. J Immunol. Mar. 15, 2000;164(6):3102-11.

Kvasnica, M. et al., Platinum(II) complexes with steroidal esters of L-methionine and L-histidine: synthesis, characterization and cytotoxic activity. Bioorg Med Chem. Apr. 1, 2008 ;16(7):3704-13. Epub Feb. 7, 2008.

Kwissa, M. et al., Cytokine-facilitated priming of CD8+ T cell responses by DNA vaccination. J Mol Med (Berl). Feb. 2003;81 (2):91-101. Epub Nov. 22, 2002.

Kwoh, Dy. et al., Transcription-based amplification system and detection of amplified human immunodeficiency virus type 1 with a bead-based sandwich hybridization formal. Proc Natl Acad Sci USA. Feb. 1989;86(4):1173-7.

Kwong, P. et al., Broadly Neutralizing Antibodies and the Search for an Hiv-1 Vaccine: The End of the Beginning, Nature Reviews, Immunology, vol. 13, Sep. 2013, pp. 693-701.

Laakkonen, Pirjo et al., Homing Peptides as Targeted Delivery Vehicles, Interactive Biology, 2010, vol. 2, No number, pp. 326-337.

Lachmann, Helen et al., In Vivo Regulation of Interleukin 1β in Patients With Cryopyrin-.Associated Periodic Syndromes, The Journal of Experimental Medicine, 2008, vol. 206, No. 5, pp. 1029-1036.

Lachmann, Helen et al., Use of Canakinumab in the Cryopyrin-Associated Periodic Syndrome, The New England Journal of Medicine, 2009, vol. 360, No. 23, pp. 2416-2425.

Lach-Trifilieff, Estelle et al., An Antibody Blocking Activin Type II Receptors Induces Strong Skeletal Muscle Hypertrophy and Protects from Atrophy, Molecular and Cellular Biology, 2004, vol. 34, No. 4, pp. 606-618.

Lacour, F. et al., Transplantable malignant tumors in mice induced by preparations containing ribonucleic acid extracted from human and mouse tumors. J. Natl Cancer Inst., 1960, 24(2):301-27.

Lai, C.J. et al., Patterning of the neural ectoderm of Xenopus laevis by the amino-terminal product of hedgehog autoproteolytic cleavage. Development. Aug. 1995;121 (8):2349-60.

Lia, S.K., et al., Mucus-penetrating nanoparticles for drug and gene delivery to mucosal tissues. Adv Drug Deliv Rev. Feb. 27, 2009; 61(2): 158-171.

Lai, S.K., et al., Rapid transport of large polymeric nanoparticles in fresh undiluted human mucus. PNAS. Jan. 30, 2007; 104(5): 1482-1487.

Lalatsa, Aikaterini, Amphiphilic poly (l-amino acids)- New materials for drug delivery, Journal of Controlled Release, 161 (2012) 523-536.

Lambert et al., Thematic Review Series: New Lipid and Lipoprotein Targets for the Treatment of Cardiometabolic Diseases the PCSK9 decade, Journal of Lipid Research vol. 53, 2012 pp. 2515-2524.

(56) References Cited

OTHER PUBLICATIONS

Lanca, Telma et al., The MHC class lb protein ULBP1 is a nonredundant determinant of leukemia/lymphoma susceptibility to gd T-cell cytotoxicity, Blood, 2010, vol. 115, No#, pp. 2407-2411.
Lange, T.S. et al., Transient nucleolar localization Of U6 small nuclear RNA in Xenopus Laevis oocytes. Mal Biol Cell. Jul. 2000;11(7):2419-28.
Langer, R., New methods of drug delivery. Science. Sep. 28, 1990;249(4976):1527-33.
Langford, C.J. et al., Evidence for an intron-contained sequence required for the splicing of yeast RNA polymerase II transcripts. Cell. Jun. 1983;33(2):519-27.
Larregina, A.T. et al., Changing paradigms in cutaneous immunology: adapting with dendritic cells. J Invest Dermatol. Jan. 2005;124(1):1-12.
Lathe, R., Synthetic oligonucleotide probes deduced from amino acid sequence data: Theoretical and practical considerations. J Mol Biol. May 5, 1985;183(1):1-12.
Laursen, N. et al., Broadly Neutralizing Antibodies Against Influenza Viruses, Antiviral Research, 2013, vol. 98, no number, pp. 476-483.
Lavrik, Inna N. et al., Translational Properties of mHNA, a Messenger RNA Containing Anhydrohexitol Nucleotides, Biochemistry 2001, vol. 40, No. 39, pp. 11777-11784.
LDLR Locus—Mutation List (retrieved bfrom http://www.ucl.ac.uk/fh-old/muttab.html on Dec. 8, 2017) 2017, 213 pages.
Le Cong et al., Multiplex Genome Engineering Using CRISPR/Cas Systems, Science, 2013, vol. 339, No. 819, pp. 819-823.
Leader B., et al., Protein therapeutics: a summary and pharmacological classification. Nat Rev Drug Discov. Jan. 2008; 7(1): 21-39.
Ledford, H., Supercharged Antibodies Fight HIV-Related Virus in Monkeys, Nature, 2013, No Volume, pp. 1-2.
Ledford, Heidi et al, Circular RNAs Throw Genetics for a Loop, in Focus News, Nature, 2013, vol. 494, pp. 291-292.
Lee et al., Hepatocyte Gene Therapy in a Large Animal: A Neonatal Bovine Model of Citrullinemia, PNAS, 1999, vol. 96, No#, pp. 3981-3986.
Lee, et al.; Thermosensitive Hydrogel as a Tgf-β 1 Gene Delivery Vehicle Enhances Diabetic Wound Healing, Pharmaceutical Research, vol. 20, No. 12, Dec. 2003, pp. 1995-2000.
Lee, G. et al., Modeling pathogenesis and treatment of familial dysautonomia using patient-specific iPSCs. Nature. Sep. 17, 2009;461(7262):402-6. Epub Aug. 19, 2009.
Lee, J. et al., Molecular basis for the immunostimulatory activity of guanine nucleoside analogs: activation of Toll-like receptor 7. Proc Natl Acad Sci USA. May 27, 2003;100(11):6646-51. Epub May 8, 2003.
Lee, J. T., et al., An arginine to glutamine mutation in residue 109 of human ornithine transcarbamylase completely abolishes enzymatic activity in Cos1 cells. J. Clin. Invest. Dec. 1989; 84: 1762-1766.
Lee, Judong et al., Tim Polymorphisms—Genetics and Function, Genes Immun. 2011, vol. 12, No. 8, pp. 595-604.
Lee, Justin B. et al., Lipid Nanoparticle siRNA Systems for Silencing the Androgen Receptor In Human Prostate Cancer in Vivo, International Journal of Cancer, 2012, vol. 131, pp. 781-790.
Lee Sylvia et al., Cytokines in Cancer Immunotherapy, Cancers, 2011, vol. 3, No.#, pp. 3856-3893.
Legleiter, Justin et al., Effect of Different Anti-Abeta Antibodies on Abeta Fibrillogenesis as Assessed by Atomic Force Microscopy, J. Mal. Biol, 2004, vol. 335, No#, pp. 997-1006.
Lehto, T., et al., Cell-penetrating peptides for the delivery of nucleic acids. Expert Opin. Drug Deilv. Jul. 2012; 9(7): 823-836.
Leitner, W.W. et al., DNA and RNA-based vaccines: principles, progress and prospects. Vaccine. Dec. 10, 1999;18 (9-10):765-77.
Lenz, A. et al., Human and murine dermis contain dendritic cells. Isolation by means of a novel method and phenotypical and functional characterization. J Clin Invest. Dec. 1993;92(6):2587-96.
Leonard, JP et al., Preclinical and clinical evaluation of epratuzumab (anti-CD22 IgG) in B-cell malignancies, Oncogene, 2007, vol. 26 No#, pp. 3704-3713.
Leonardi, Craig et al., Anti-Interleukin-17 Monoclonal Antibody Ixekizumab in Chronic Plaque Psoriasis, The New England Journal of Medicine, 2012, vol. 366, No. 13, pp. 1190-1199.
Lerner, M.R. et al., Are snRNPs involved in splicing? Nature. Jan. 10, 1980;283(5743):220-4.
Lesaffre, B. et al., Direct non-cell autonomous Pax6 activity regulates eye development in the zebrafish. Neural Dev. Jan. 17, 2007;2:2.
Leung W. David. The Structure and Functions of Human Lysophosphatidic Acid Acyltransferases. Frontiers in Bioscience 6. pp. 944-953, Aug. 1, 2001.
Lewandowski, L.J. et al., Separation of the infectious ribonucleic acid of potato spindle tuber virus from double- stranded ribonucleic acid of plant tissue extracts. J Virol. Nov. 1971;8(5):809-12.
Lewis, David, Dynamic Polyconjugates (DPC) Technology: An elegant solution to the siRNA delivery problem. Arrowhead Research Corp (NASDAQ: ARWR). Nov. 2011.
Lewis, J.D. et al., The influence of 5' and 3' end structures on pre-mRNA metabolism. J Cell Sci Suppl. 1995;19:13-9.
Li, Junjie, et al.; Methylation Protects miRNAs and siRNAs from a 3_'-End Uridylation Activity in Arabidopsis, Current Biology, 2005, vol. 15, (no number), pp. 1501-1507.
Li, L. L et al., Overcoming obstacles to develop effective and safe siRNA therapeutics. Expert Opin Biol Ther. May 2009; 9(5): 609-19.
Li, L. et al Preparation and gene delivery of alkaline amino acids-based cationic liposomes. Arch Pharm Res. Jul 2008;31(7):924-31. Epub Aug. 14, 2008.
Li, X. et al Generation of destabilized green fluorescent protein as a transcription reporter. J Biol Chem. Dec. 25, 1998;273(52):34970-5.
Li, Z et al., Controlled Gene Delivery System Based on Thermosensitive Biodegradable Hydrogel, Pharmaceutical Research, vol. 20, No. 6, Jun. 2003, pp. 884-888.
Li, Zhi Jie, et al., Peptides as Targeting Probes Against Tumor Vasculature for Diagnosis and Drug Delivery, Journal of Translational Medicine, 2012, vol. 10, Supp 1, No. s1, pp. 1-9.
Lian T. et al., Trends and developments in liposome drug delivery systems. J Pharm Sci. Jun. 2001;90(6):667-80.
Liang, X.H. et al., The spliced leader-associated RNA is a trypanosome-specific sn(o) RNA that has the potential to guide pseudouridine formation on the SL RNA. RNA. Feb. 2002;8(2):237-46.
Licatalosi, D.D. et al., Splicing regulation in neurologic disease. Neuron. Oct. 5, 2006;52(1):93-101.
Limbach, P.A., et al., "Summary: the modified nucleosides of Rna," Nucleic Acids Research, 1994 vol. 22, No. 12, pp. 2183-2196.
Limberis, M et al., Intranasal Antibody Gene Transfer in Mice and Ferrets Elicits Broad Protection Against Pandemic Influenza, Science Trans! Med vol. 5, Issue 187, 99. 1-8.
Lin, Jieru et al., Bacterial Heat-Stable Enterotoxins: Translation of Pathogenic Peptides into Novel Targeted Diagnostics and Therapeutics, Toxins, 2010, vol. 2, no. number, pp. 2028-2054.
Linden, Ola, et al., Dose-Fractionated Radioimmunotherapy in Non-Hodgkin's Lymphoma Using Dota-Conjugated, 90Y-Radiolabeled, Humanized Anti-CD22 Monoclonal Antibody, Epratuzumab, Clinical Cancer Research, 2005, vol. 11, No#, pp. 5215-5222.
Lindner, Heidrun et al., Peripheral Blood Mononuclear Cells Induce Programmed Cell Death in Human Endothelial Cells and May Prevent Repair: Role of Cytokines, 1997, vol. 89, No. 6, pp. 1931-1938.
Linehan, D.C. et al., Tumor-specific and Hla-A2-restricled cytolysis by tumor-associated lymphocytes in human metastatic breast cancer. J Immunol. Nov. 1, 1995; 155(9):4486-91.
Linke, Rolf et al., Catumazomab Clinical Development and Future Directions, Landes Bioscience, mAbs, vol. 2, No. 2, pp. 129-136.
Lipari et al., Furin-cleaved Proprotein Convertase Subtilisin/Kexin Type 9 (PCSK9) Is Active and Modulates Low Density Lipoprotein Receptor and Serum Cholesterol Levels. J Biol Chem. 2012, 287(52): 43482-43491.

(56) References Cited

OTHER PUBLICATIONS

Liu, C., et al., Peptidoglycan Recognition Proteins. A Novel Family of Four Human Innate Immunity Pattern Recognition Molecules. The Journal of Biological Chemistry. vol. 276, No. 37, Issue of Sep. 14, pp. 686-34694, 2001.

Lizardi, Pm., et al., Mutation Detection and Single-Molecule Counting Using Isothermal Rolling-Circle Amplification, Nat Genetics, 1998, vol. 19, No. 3, pp. 225-232.

Lo, Albert et al., Hepatocellular Carcinoma Cell-Specific Peptide Ligand for Targeted Drug Delivery, Molecular Cancer Therapeutics, 2008, vol. 7 , No. 3, pp. 579-589.

Lobenberg, R. et al., Improved body distribution of 14C-labelled AZT bound to nanoparticles in rats determined by radioluminography. J Drug Target. 1998;5(3):171-9.

LoDuca, Paul et al., Hepatic Gene Transfer as a Means of Tolerance Induction to Transgene Products, Curr Gene Ther. 2009, vol. 9, No. 2, pp. 104-114.

Loging, W.T. et al., Identifying potential tumor markers and antigens by database mining and rapid expression screening. Genome Res. Sep. 2000;10(9):1393-402.

Lopez, M.F., et al., Selected reaction monitoring-mass spectrometric immunoassay responsive to parathyroid hormone and related variants. Clinical Chem. 2010; 56(2): 281-290.

Lopez-Berestein, G. et al., Treatment of systemic fungal infections with liposomal amphotericin B. Arch Intern Med. Nov. 1989;149(11 ):2533-6.

Lorenzi, J.C., et al., Intranasal vaccination with messenger RNA as a new approach in gene therapy: Use against tuberculosis. BMC Biotechnol. Oct. 2010; 10(77): 1-11.

Lorenzi, J.C., et al., Protein expression from exogenous mRNA: Uptake by receptor-mediated endocytosis and trafficking via the lysosomal pathway. RNA Biology, vol. 8, No. 4, Jul. 1, 2011, pp. 252-258.

Love et al., Lipid-like materials for low-dose, in vivo gene silencing, PNAS vol. 107 No. 5, pp. 1864-1869, Feb. 2, 2010.

Lowe, T.M. M et al., A computational screen for methylation guide snoRNAs in yeast. Science. Feb. 19, 1999;283 (5405):1168-71.

Lowry, W.E., et al., Generation of human induced pluripotent stem cells from dermal fibroblasts. Proc Natl Acad Sci USA. Feb. 2008; 105(8): 2883-2888.

Lozier, Jay N , Factor IX Padua: them that have, give , Blood, 2012, vol. 120, No#, pp. 4452-4453.

Lu, Biao, et al. Cloning and characterization of murine 1-acyl-sn-glycerol 3-phosphate acyltransferases and their regulation by PPAR in murine heart. Biochem J. (2005) 385, 469-477 (printed in Great Britain).

Lu, Changming et al., miR-221 and miR-155 Regulate Human Dendritic Cell Development Apoptosis, and IL-12 Production Through Targeting of p27kip1, KPC1 and SOCS-1, BLOOD, 2011, vol. 117, No. 16, pp. 4293-4303.

Lu, Li-Fan et al., Foxp3-Dependent MicroRNA 155 Confers Competitive Fitness to Regulatory T Cells by Targeting SOCS1 Protein, CellPress, Immunity, 2008, No Volume Number, pp. 80-91.

Lu, Ruei-Min et al., Targeted Drug Delivery Systems Mediated by a Novel Peptide in Breast Cancer Therapy and Imaging, PLOS One, 2013, vol. 8, Issue 6, pp. 1-13.

Lu, X., Peptidoglycan Recognition Proteins Are a New Class of Human Bactericidal Proteins. The Journal of Biological Chemistry, Mar. 3, 2006, vol. 281, No. 9, pp. 5895-5907.

Luukkonen, B.G. et al., A conditional U5 snRNA mutation affecting pre-mRNA splicing and nuclear pre-mRNA retention identifies SSD1/SRK1 as a general splicing mutant suppressor. Nucleic Acids Res. Sep. 1, 1999 ;27(17):3455-3465.

Lund, P.E., et al., Pseudovirions as vehicles for the delivery of siRNA. Pharm Res. Mar. 2010; 27(3): 400-420. Epub Dec. 9, 2009.

Luo, D. et al., Synthetic DNA delivery systems. Nat Biotechnol. Jan. 2000;18(1):33-7.

Luo, Xunrong et al., Dendritic Cells with TGF-B1 Differentiate naive CD4=CD25-T Cells Into Islet-Protective Foxp3+ Regulatory T Cells, PNAS, 2007, vol. 104, No. 8, pp. 2821-2826.

Lutz, Riechmann et al., Reshaping Human Antibodies for Therapy, Nature, 1988, vol. 332, No. 24 , pp. 323-327.

Lysosomal Acid Lipase (lysosomal acid lipase/ cholesteryl ester hydrolase isoform 1 precursor [Homo sapiens]; NCBI, Dec. 5, 2010, No. vol., pp. 1-3, http://www.ncbi.nlm.nih.gov/protein/51317399.

Iwase, Reiko et al., Molecular design of a eukaryotic messenger RNA and its chemical synthesis, Nucleic Acids Research, 1991, vol. 20, No. 7, pp. 1643-1648.

M. Kanapathipillai, et al., Nanoparticle targeting of anti-cancer drugs that alter intracellular signaling or influence the tumor microenvironment, Adv. Drug Deliv. Rev. (2014), pp. 1-12.

Ma, B. et al., HPV pseudovirions as DNA delivery vehicles. Ther Deliv. Apr. 2011; 2(4): 427-430.

Ma., X. et al Pseudouridylation (ψ) of U2 snRNA in S. cerevisiae is catalyzed by an RNA-independent mechanism. EMBO J. Apr. 15, 2003;22(8):1889-97.

Maden, B.E.H. et al., Classical and novel approaches to the detection and localization of the numerous modified nucleotides in eukaryotic ribosomal RNA. Biochimie. 1995;77(1-2):22-9.

Maehr, R. et al., Generation of pluripotent stem cells from patients with type 1 diabetes. Proc Natl Acad Sci USA. Sep. 15, 2009; 106(37): 15768-15773.

Magee, W .E. et al., Marked stimulation of lymphocyte-mediated attack on tumor cells by target-directed liposomes containing immune RNA, Cancer Res., 1978, 38(4):1173-6.

Mali, P. et al., RNA-guided human genome engineering via Cas9. Science. Feb. 15, 2013; 339(6121): 823-826.

Malone, R.W. et al., Cationic liposome-mediated RNA transfection. Proc Natl Acad Sci U S A. Aug. 1989;86 (16):6077-81.

Mannick, JA et al., Transformation of Nonimmune Lymph Node Cells to a State of Transplantation Immunity by RNA. A Preliminary Report, Ann. Surg., 1962, 156:356-66.

Mansour, et al., Functional Studies with Uterine RNA. PNAS, 1965, 53:764-70.

Mansour, SL et al., Disruption of the proto-oncogene int-2 in mouse embryo-derived stem-cells: A general strategy for targeting mutations to non-selectable genes. Nature, 1988, 336:348-52.

Marini, Juan C et al., Phenylbutyrate improves nitrogen disposal via an alternative pathway without eliciting an increase in protein breakdown and catabolism in control and ornithine transcarbamylase-deficient patients, Am J Clin Nutr, 2011, vol. 93, No.#, pp. 1248-54.

Marson, A., et al., Wnt signaling promotes reprogramming of somatic cells to pluripotency. Cell Stem Cell. Aug. 2008; 3(2): 132-135.

Martin, SA et al., Purification of mRNA guanylyltransferase and mRNA (guanine-7-) methyltransferase from vaccinia virions. J Biol Chem. Dec. 25, 1975;250(24):9322-9.

Martinelli, Richard A., Chemiluminescent Hybridization-Ligation Assays for F508 and 1507 Cystic Fibrosis Mutations, Clinical Chemistry, 1996, vol. 42., No. 1, pp. 14-18.

Martinon, F. et al., Induction of virus-specific cytotoxic T lymphocytes in vivo by liposome-entrapped mRNA. Eur J Immunol. Jul. 1993;23(7):1719-22.

Massenet, S. et al., Pseudouridine mapping in the Saccharomyces cerevisiae spliceosomal U small nuclear RNAs (snRNAs) reveals that pseudouridine synthase pus1p exhibits a dual substrate specificity for U2 snRNA and tRNA. Mol Cell Biol. Mar. 1999;19(3):2142-54.

Mathers, A.R. et al., Professional antigen-presenting cells of the skin. Immunol Res. 2006;36(1-3):127-36.

Matray, T.J. et al., Synthesis and properties of RNA analogs-oligoribonucleotide N3'>P5' phosphoramidates. Nucleic Acids Res. Oct. 15, 1999;27(20):3976-85.

Matsuda, A. et al., Nucleosides. 120. Synthesis of 2'-Deoxy-?-isocytidine and 2'- Deoxy-1-methyl-?-uridine from ?- Uridinel. J Org Chem. 1981; 46:3603-3609.

Matsuda, A. et al., Synthesis of 3-Methylpseudouridine and 2'-Deoxy-3-Methyl-pseudouridine. Carbohydr Res. Mar. 1, 1982; 100: 297-302.

Matsuda, V. et al., Determinants of Initiation Codon Selection During Translation in Mammalian Cells, PLOS One, 2010, vol. 5, Issue 11, pp. 1-13.

(56) References Cited

OTHER PUBLICATIONS

Maurer, N., et al., Spontaneous entrapment of polynucleotides upon electrostatic interaction with ethanol- destabilized cationic liposomes. Biophys J. May 2001; 80(5): 2310-2326.

Mayfield, S.P. et al., Expression and assembly of a fully active antibody in algae. Proc Natl Acad Sci U S A. Jan. 21, 2003;100(2):438-42. Epub Jan. 8, 2003.

Mayo Clinic, Factor lx Complex (Intravenous Route, Injection Route) Description and Brand Names—Drugs and Supplements, http://www.mayoclinic.org/drugs-supplemenls/factor-ix-complex-intravenous-route-injection-route/descriplion/drg-20063804, Apr. 1, 2014, no vol., pp. 1-3.

Mazumdar, Sohini et al., Golimumab, mAbs, 2009, vol. 1, No. 5, pp. 422-431.

Mccafferty, J. et al., Phage antibodies: filamentous phage displaying antibody variable domains. Nature. Dec. 6, 1990;348(6301):552-4.

Mccormack, A.L., et al., a-Synuclein suppression by targeted small interfering RNA in the primate substantia nigra. PLoS ONE. Aug. 2010; 5(8): e12122.

Mccormack, M., et al., Activation of the T-cell oncogene LM02 after gene therapy for X-linked severe combined immunodeficiency. N Engl J Med. Feb, 2004; 350: 913-922.

McDonald, J.D., et al., Characterization of mutations at the mouse phenylalanine hydroxylase locus. Genomics. 1997; 39: 402-405.

McElwee, K.J. et al., Transfer of CDS(+) cells induces localized hair loss whereas CD4(+)/CD25(-) cells promote systemic alopecia areata and CD4(+)/CD25(+) cells blockade disease onset in the C3H/HeJ mouse model. J Invest Dermatol. May 2005;124(5):947-57.

McGary, E.C. et al., Post-transcriptional regulation of erythropoietin mRNA stability by erythropoietin mRNA-binding protein. J Biologic Chem. Mar. 28, 1997; 272(13): 86288634.

McGee, M., et al., The Quantitative determination of phenylalanine hydroxylase in rat tissues. Biochem. J. 1972; 127: 669-674.

McGlynn, R. et al., Differential subcellular localization of cholesterol, gangliosides, and glycosaminoglycans in murine models of mucopolysaccharide storage disorders. J Comp Neural. Dec. 20, 2004;480(4):415-26.

Mckenzie, B.S. et al., Nucleic acid vaccines: tasks and tactics. Immunol Res. 2001;24(3):225-44.

McLean, Leon et al., Vedolizumab for the treatment of ulcerative colitis and Crohn's disease, Immunotherapy, 2012, vol. 4, No. 9, pp. 883-898.

McLean, M.J., et al., Membrane differentiation of cardiac myoblasts induced in vitro by an RNA-enriched fraction from adult heart. Exp Cell Res. Nov. 1977;110(1):1-14.

Mease, PJ et al., Effect of certolizumab pegol on signs and symptoms in patients with psoriatic arthritis: 24-week results of a Phase 3 double-blind randomized placebo-controlled study (RAPID-PsA), Ann Rheum Dis, 2014, vol. 73, No#, pp. 48-55.

MEGAscript Kit Product Manual, Ambion/Invitrogen website: http://tools.invitrogen.com/content/sfs/manuals/cms_072987.pdf, Publication Date: Oct. 27, 2009 (last accessed Mar. 17, 2013)("Ambion"), Author Life Technologies.

Mellits, K.H. et al., Removal of double-stranded contaminants from RNA transcripts: synthesis of adenovirus VA RNAI from a T7 vector. Nucleic Acids Res. Sep 25, 1990;18(18):5401-6.

Memczak, Sebastian et al. , Circular RNAs are a large class of animal RNAs with Regulatory Potency, Nature, 2013, vol. 495, no number, pp. 333-343.

Mendelsohn, J. et al, Epidermal Growth Factor Receptor Inhibition by a Monoclonal Antibody As Anticancer Therapy, 1997, vol. 3 No#, pp. 2703-2707.

Messer, William B. et al., Dengue Virus Envelope Protein Domain I/Ii Hinge Determines long-livid Serotype-Specific Dengue Immunity, PNAS, 2014, vol. 111, No. 5, 1939-1944.

Metz, Bernard et al, Identification of Formaldehyde-induced Modifications in Proteins, The Journal of Biological Chemistry, 2004,vol. 279, No. 8, pp. 6235-6243.

Meunier, L. et al, Heterogeneous populations of class II MHC+ cells in human dermal cell suspensions. Identification of a small subset responsible for potent dermal antigen-presenting cell activity with features analogous to Langerhans cells. J Immunol. Oct. 15, 1993;151(8):4067-80.

Midoux et al., Lipid-based mRNA vaccine delivery systems. Expert Rev Vaccines. Feb. 2015;14(2):221-34. doi: 10.1586/14760584. 2015.986104. Epub Dec. 26, 2014 Review.

Mignone, F. et al., Untranslated regions of mRNAs. Genome Biol. 2002; 3(3): 1-10. Epub Feb. 28, 2002 pp. 1-10.

Minagar, Alireza et al., Current and Future Therapies for Multiple Sclerosis, Scientifica, 2012, vol. 2013, Article ID 249101, pp. 1-11.

Mingozzi, Federico, et al., Pharmacological Modulation of Humoral Immunity in A Nonhuman Primate Model AAV Gene Transfer for Hemophilia B, The American Society of Gene & Cell Therapy, 2012, vol. 20, No. 7, pp. 1410-1416.

Minks, MA et al., Structural requirements of double-stranded RNA for the activation of 2',5'-oligo(A) polymerase and protein kinase of interferon-treated HeLa cells. J Biol Chem. Oct. 25, 1979;254(20):10180-3.

Miotti, S. et al., Characterization of Human Ovarian Carcinoma-Associated Antigens Defined by Novel Monoclonal Antibodies with Tumor-Restricted Specificity, Intl. J. Cancer, 1987, vol. 39, No, pp. 297-303.

Miranda, Paula S. Montenegro et al., Towards Liver-Directed Gene Therapy for Crigler-Najjar. Syndrome, Current Gene Therapy, 2009, vol. 9, pp. 72-82.

Mishra, N.C. et al., Induction by RNA of inositol independence in Neurospora crassa. Proc. Natl Acad. Sci. U.S.A., 1975, 72(2):642-5.

Mishra, R.K. et al., Improved leishmanicidal effect of phosphorothioate antisense oligonucleotides by LDL-mediated delivery. Biochim Biophys Acta. Nov. 7, 1995;1264(2):229-37.

Mitchell, DA et al., RNA transfected dendritic cells as cancer vaccines. Curr Opin Mal Ther. Apr. 2000;2(2):176-81.

Mitchell, DA et al., RNA-transfected dendritic cells in cancer immunotherapy. J Clin Invest. Nov. 2000;106 (9):1065-9.

Mitchell, P. et al., mRNA turnover. Curr Opin Cell Biol. Jun. 2001;13(3):320-5.

Mitragotri, S.; Devices for Overcoming Biological Barriers: The use of physical forces to disrupt the barriers, Advance Drug Delivery Reviews 65 (2013) 100-103.

Miura, K., et al., Variation in the safety of induced pluripotent stem cell lines. Nat Biotechnology. Aug. 2009; 27(8): 743-745.

Miyagi, Shogo J. et al., the Development of UDP-Glucuronosyltransferases 1A1 and 1A6 in the Pediatric Liver, Drug Metabolism and Disposition, 2011, vol. 39, No. 5, pp. 912-919.

Mockey et al., mRNA-based cancer vaccine: prevention of B16 melanoma progression. and metastasis by systemic injection of MART1 mRNA histidylated lipopolyplexes, Cancer Gene Therapy, 2007, 14, pp. 802-814.

Monobe, M. et al., Beta-pseudouridine, a beer component, reduces radiation-induced chromosome aberrations in human lymphocytes. Mutat Res. Jul. 8, 2003; 538(1-2): 93-99.

Moore, J.E., el. al. The Corneal Epithelial Stem Cell. vol 21, Nos. 5/6, 2002. Mary Ann Liebert, Inc. pp. 443-451.

Moore, M., Site-Specific Modification of Pre-mRNA: The 2"-Hydroxyl Groups at the Splice Sites, Science, 1992, vol. 256, No#, pp. 992-997.

Morgan D. Hugh, et. al. Molecular Basis of Cell and Developmental Biology: Activation-induced Cytidine Deaminase Deaminates 5-Methylcytosine in DNA and Is Expressed in Pluripotent Tissues: Implications for Epigenetic Reprogramming. J. Biol. Chem. 2004, 279:52353-52360. published online Sep. 24, 2004.

Morinaga, T. et al., Primary structures of human alpha-fetoprotein and its mRNA. Proc Natl Acad Sci U S A. Aug. 1983;80(15):4604-8.

Morse, MA et al., Generation of dendritic cells in vitro from peripheral blood mononuclear cells with granulocyte-macrophage-colony-stimulating factor, interleukin-4, and tumor necrosis factor-alpha for use in cancer immunotherapy. Ann Surg. Jul. 1997;226(1):6-16.

(56) References Cited

OTHER PUBLICATIONS

Morton, S. Scalable Manufacture of Built-to-Order Nanomedicine: Spray-Assisted Layer-by-Layer Functionalization of Print Nanoparticles, Advanced Materials, 2013, 25, 4708-4712.

Mount, S.M. et al., A catalogue of splice junction sequences. Nucleic Acids Res. Jan. 22, 1982;10(2):459-72.

Mukherji, S. et al., MicroRNAs Can Generate Thresholds in Target Gene Expression, Nature Genetics, 2011, vol. 43, No. 9, pp. 854-860.

Muller, M.R. et al., Transfection of dendritic cells with RNA induces CD4- and CD8- mediated T cell immunity against breast carcinomas and reveals the immunodominance of presented T cell epitopes. J Immunol. Jun. 15, 2003;170 (12):5892-6.

Murakawa, G.J. et al., Direct detection of HIV-1 RNA from Aids and ARC patient samples. DNA. May 1988;7 (4):287-95.

Myette, J.R. et al., Domain structure of the vaccinia virus mRNA capping enzyme. Expression in *Escherichia coli* of a subdomain possessing the RNA 5'-triphosphatase and guanylyltransferase activities and a kinetic comparison to the full-size enzyme. J Biol Chem. May 17, 1996;271(20):11936-44.

Nagata, S., et al., Molecular cloning and expression of cDNA for human granulocyte colony-stimulating factor. Nature. Jan. 30-Feb. 5, 1986; 319(6052): 415-8.

Nagata, S., et al., The chromosomal gene structure and two mRNAs for human granulocyte colony-stimulating factor. EMBO J. Mar. 1986; 5(3): 575-81.

Nagata, S., Synthesis and Biological Activity of Artificial mRNA Prepared with Novel Phosphorylating Reagents, Nucleic Acids Research, 2010, vol. 38, No. 21, pp. 7845-7857.

Nagata, T. et al., Codon optimization effect on translational efficiency of DNA vaccine in mammalian cells: analysis of plasmid DNA encoding a CTL epitope derived from microorganisms. Biochem Biophys Res Commun. Aug. 2, 1999;261 (2):445-51.

Nair, S. et al., Soluble proteins delivered to dendritic cells via pH-sensitive liposomes induce primary cytotoxic T lymphocyte responses in vitro. J Exp Med. Feb. 1, 1992;175(2):609-12.

Nair, S.K. et al., Antigen-presenting cells pulsed with unfractionated tumor-derived peptides are potent tumor vaccines. Eur J Immunol. Mar 1997;27(3):589-97.

Nair, S.K. et al., Induction of cytotoxic T cell responses and tumor immunity against unrelated tumors using telomerase reverse transcriptase RNA transfected dendritic cells. Nat Med. Sep. 2000;6(9):1011-7.

Nair, S.K. et al., Induction of primary carcinoembryonic antigen (CEA)-specific cytotoxic T lymphocytes in vitro using human dendritic cells transfected with RNA. Nat Biotechnol. Apr. 1998;16(4):364-9.

Nakagawa, M. et al., Generation of induced pluripotent stem cells without Myc from mouse and human fibroblasts. Nat Biotechnol. Jan. 2008; 26(1): 101-106. Epub Nov. 30, 2007.

Nakamura, K. et al., A model for the autosensitization autoantibody production associated with xenogeneic thymic RNA. J Immunol. Aug. 1978;121(2):702-9.

Nakamura, K. et al., Antigen restricted hybridization between antigen primed macrophage and thymic RNA. Immunol Commun. 1981;10(4-5):367-82.

Nakamura, K. et al., Conversion of immune response patterns from high to low and low to high by an RNase- sensitive thymocyte extract. Immunology. Sep. 1980;41(1):25-35.

Nakamura, K. et al., Generation of anti-NZB red blood cell antibody-forming plasma cells from bone marrow cultures of syngeneic and allogeneic mice: functional modulation of helper T-cell subsets in autosensitization. Immunology. Mar. 1983;48(3):579-86.

Nakamura, K. et al., Intranuclear incorporation of thymic low molecular weight RNA by murine bone marrow immunoblasts and inhibition of plasma cell formation by a derivative of rifampicin. Microbiol Immunol. 1982;26 (1):41-57.

Nakamura, K. et al., Mechanism of anti-DNA antibody formation. The functional modulation of helper T-subset plays the key role in both murine and human B-cell autosensitization. Microbiol Immunol. 1986;30(7):703-15.

Nakamura, K. et al., The proliferation of plasma cells from mouse bone marrow in vitro. III. Primary and secondary immune responses associated with thymic RNA. Immunol Commun. 1979;8(5-6):511-29.

Nakamura, K., The proliferation of plasma cells from mouse bone marrow in vitro. II-Stimulation of IgG-producing cells by a RNase-sensitive thymocyte homogenate. Cell Immunol. Aug. 1976;25(2):163-77.

Nakamura, O. et al., Abstract: the Role of Immune RNA in the Immunotherapy of Malignant Brain Tumor. 1982, 34 (2):333-9.

Nallagatla, S.R. et al., A brilliant disguise for self RNA: 5'-end and internal modifications of primary transcripts suppress elements of innate immunity. RNA Biol. Jul.-Sep. 2008;5(3):140-4. Epub Jul. 20, 2008.

Narayanan, A. et al., Role of the box C/D motif in localization of small nucleolar RNAs to coiled bodies and nucleoli. Mol Biol Cell. Jul. 1999;10(7):2131-47.

Naz, R.K. et al., Novel human prostate-specific cDNA: molecular cloning, expression, and immunobiology of the recombinant protein. Biochem Biophys Res Commun. Oct. 11, 2002;297(5):1075-84.

NCBI Entrez, GenBank Report, Accession No. NM_004261.3, Bank, J., et al., Entry Date Jul. 10, 2015, 4 pages.

Needleman, S.B. et al., A general method applicable to the search for similarities in the amino acid sequence of two proteins. J Mol Biol. Mar. 1970;48(3):443-53.

Nelson, C. et al., Tunable Delivery of SiRNA from a Biodegradable Scaffold to Promote Angiogenesis in Vivo, Advanced Materials, 2013, pp. 1-8.

Nestle, F.O. et al., Vaccination of melanoma patients with peptide- or tumor lysate-pulsed dendritic cells. Nat Med. Mar. 1998;4(3):328-32.

Neumann, E. et al., Fundamentals of electroporative delivery of drugs and genes. Bioelectrochem Bioenerg. Feb. 1999;48(1):3-16.

Neve, S., et al. Tissue distribution, intracellular localization and proteolytic processing of rat 4-hydorxyphenylpyruvate dioxygenase. Cell Biology International 27 (2003) pp. 611-624.

Newby, M.I. et al., Sculpting of the spliceosomal branch site recognition motif by a conserved pseudouridine. Nat Struct Biol. Dec. 2002;9(12):958-65.

Newman, A. et al., Mutations in yeast U5 snRNA alter the specificity of 5' splice-site cleavage. Cell. Apr. 5, 1991;65 (1):115-23.

Newman, A.J. et al., U5 snRNA interacts with exon sequences at 5' and 3' splice sites. Cell. Feb. 21, 1992;68 (4):743-54.

Newmark, J. et al., Preparation and properties of adducts of streptokinase and streptokinase-plasmin complex with poly ethylene glycol and pluronic polyol F38. J Appl Biochem. 1982; 4:185-9.

Ngai, P.H.K., et al. Agrocybin, an antifungal peptide from the edible mushroom. Department of Biochemistry, the Chinese University of Hong Kong. Peptides 26 (2005) 191-196.

Nguyen, A. et al., Quantitative assessment of the use of modified nucleoside triphosphates in expression profiling: differential effects on signal intensities and impacts on expression ratios. BMC Biotechnol. Jul. 31, 2002; 2:14.

Nguyen, M. et al., Injectable Biodegradable Hydrogels, Macromolecular Bioscience, 2010, 10, 563-579.

Ni, J. et al., Small nucleolar RNAs direct site-specific synthesis of pseudouridine in ribosomal RNA. Cell. May 16, 1997;89{4):565-73.

Nicholas, J et al., New and Emerging Disease-Modifying Therapies for Relapsing-Remitting Multiple Sclerosis: What is New and What is to Come, Journal of Central Nervous System Disease, 2012, vol. 4, No#, pp. 81-103.

Nicholson, A.W. et al., Accurate in vitro cleavage by RNase III of phosphorothioate-substituted RNA processing signals in bacteriophage T7 early mRNA. Nucleic Acids Res. Feb. 25, 1998;16(4):1577-91.

Nielsen, DA et al., Preparation of capped RNA transcripts using T7 RNA polymerase. Nucleic Acids Res. Jul. 25, 1986;14(14):5936.

Nielsen, P.E., Peptide nucleic acids as therapeutic agents. Curr Opin Struct Biol. Jun. 1991;9(3):353-7.

(56) References Cited

OTHER PUBLICATIONS

Nikolin, V.P. et al., Resistance of Mice Exposed to Whole-Body Irradiation to Transplanted Hemopoietic Cells Modified with RNA Preparations. Bull. Exp. Biol. Med., 2000, 129:5571-4.
Nitin, N. et al., Peptide-linked molecular beacons for efficient delivery and rapid mRNA detection in living cells. Nuc Acids Res. 2004; 32(6): e58.
Niu, M.C. et al., Genetic Manipulation in Higher Organisms; III. Detection of Soya Protein in Seeds Derived from Soya mRNA-Treated Rice. Scientia Sinica, 1980, 23:11923.
Niu M.C. et al., Ribonucleic acid-induced changes in mammalian cells. Proc Natl Acad Sci USA. Oct. 15, 1961;47:1689-700.
Niu' M.C. et al., The Developmental Potentiality of the Liver-RNA-Treated Posterior Primitive Streakin the Chick Embryo. Biol. Bull, 1968, 135:200-7.
Niu, M.C. et al the Entrance of Exogenous RNA into the Mouse Ascites Cell. Proc. Soc. Exp. Biol. Med., 1968, 128 (2):550-5.
Niu, M.C. et al., Transfer of information from mRNA to chromosomes by reverse transcription in early development of goldfish eggs. Cellular and Molecular Biology, 1989, 35(3):333-45.
Niu, M.C. Antagonistic Action of Exogenous Histone and RNA in Mouse Ascites Cells. Proc. Soc. Exp. Biol. Med., 1972, 140:256-62.
Niu, M.C., Causal Analysis of Embryonic Differentiation; II. Dual Function of Exogenous RNA in differentiation of Presumptive Ectoderm. Exp. Cell Res., 1971, 64:65-76.
Niu, M.C., et al Poly(A)-attached RNA as activator in embryonic differentiation. Proc Soc Exp Biol Med. Oct. 1974;147 (1):318-22.
Niu, M.C., et al Presence of liver-forming fraction in fish egg mRNAs detected by its ability to encode albumin synthesis. Scientia Sinica, 1980, 23(4):510-6.
Niu M.C., et al Re-examination of the DNA-mediated transformation in goldfish. Scientia Sinica, 1983, 24(7):700-7.
Niu, M.C., Functional Potentiality of Ribonucleic Acid. Acta. Unio. Int. Contra. Cancrum, third meeting Philadelphia, 1964, 20:995-6.
Niu, M.C., Genetic manipulation in higher organisms; I. Goldfish ova as materials of operation, mRNA mediated alteration of the liver specific isozymes. Scientia Sinica, 1977, 20(6):803-8.
Niu, M.C. Glucose-6-Phosphate: Re-examination of the RNA-Induced Activity in Mouse Ascites Tumor Cells. Science. 1965, 148:513-6.
Niu, M.C., RNA-Induced Biosynthesis of Specific Enzymes. PNAS, 1962, 48:1964-9.
Niu, M.C. the Development of Tubular heart in RNA-Treated Post-Nodal pieces of Chick Blastoderm. J Embryol. Exp. Morphol., 1973, 29:485-501.
Niu, M.C. the role of Exogenous Heart-RNA in Development of the Chick Embryo Cultivated in Vitro. J Embryol. Exp. Morphol., 1970, 64:57-64.
Niu, M.C. Thymus Ribonucleic Acid and Embryonic Differentiation. PNAS, 1958, 44:1264-1274.
Nogueira, Raquel et al., Recombinant Yellow Fever Viruses Elicit CDA+ T Cell Responses and Protective Immunity Against Trypanosoma Cruzi, PLOS One, 2013, vol. 8, Issue 3, pp. 1-13.
Norbury, Chris J., Cytoplasmic RNA: A Case of the Tail Wagging The Dog, Nature Reviews, Molecular Cell Biology, 2013, Advanced Online Publication, No vol. Number, pp. 1-10.
Nwe, K. et al., Growing Applications of "Click Chemistry" for Bioconjugation in Contemporary Biomedical Research, Cancer Biotherapy and Radiopharmaceuticals, 2009, vol. 24., No. 3., pp. 289-301.
Oberg (Aquaporins, Production Optimization and Characterization, Thesis for the Degree of Doctor of Philosophy in Natural Science; University of Gothenburg, Department of Chemistry -Biochemistry; pp. 1-69, published May 27, 2011. No vol.
Oberhauser, B. et al., Effective incorporation of 2'-O-methyl-oligoribonucleotides into liposomes and enhanced cell association through modification with thiocholesterol. Nucleic Acids Res. Feb. 11, 1992;20(3):533-8.
Occhiogrosso, G., et al., Prolonged convection-enhanced delivery into the rat brainstem. Neurosurgery. Feb. 2003; 52(2): 388-394.

Ochman, H., Genetic Applications of an Inverse Polymerase Chain Reaction, Genetics, Washington University School of Medicine, 1988, vol. 120, No#, pp. 621-623.
Odens, M., Prolongation of the Life Span in Rats. Journal of the American Geriatrics Soc. Oct. 1973; 11(10):450-1.
O'Doherty, U. et al., Human blood contains two subsets of dendritic cells, one immunologically mature and the other immature. Immunology. Jul. 1994;82(3):487-93.
Ofengand, J. et al., The function of pseudouridylic acid in transfer ribonucleic acid: II. Inhibition of amino acyl transfer ribonucleic acid-ribosome complex formation by ribothymidylyl-pseudouridylyl-cytidylyl-guanosine 3'-phosphate. J Biol Chem. Nov. 25, 1969; 244(22): 6241-6253.
Ohashi, H. et al., Efficient protein selection based on ribosome display system with purified components. Biochem Biophys Res Commun. Jan. 5, 2007;352(1):270-6. Epub Nov. 13, 2006.
Ohmichi, T. et al., Efficient bacterial transcription of DNA nanocircle vectors with optimized single-stranded promoters. Ohmichi T, Maki a, Kool Et. Proc Natl Acad Sci U S A. Jan. 8, 2002;99(1):54-9. Epub Dec. 18, 2001.
Okita, K. et al., Generation of mouse induced pluripotent stem cells without viral vectors. Science. 2008; 322: 949-953.
Ornithine Carbamoyltransferase; ornithine carbamoyltransferase, mitochondrial precursor [Homo sapiens]; NCBI, 2010, No Vo., pp. 1-3.
Ortho Multicenter Transplant Study Group, A Randomized Clinical Trial of OKT3 Monoclonal Antibody for Acute Rejection of Cadaveric Renal Transplants, The New England Journal of Medicine, 1985, vol. 313, No. 6, pp. 337-342.
Oster, C.G., et al. Comparative study of DNA encapsulation into PLGA microparticles using modified double emulsion methods and spray drying techniques. Journal of Microencapsulation, May 2005; 22(3): 235-244.
Owen, M. et al., Stromal stem cells: marrow derived osteogenic precursors. CIBA Foundation Symposium, 1988, 136:42-60.
Ozawa, T. et al., Amplification and analysis of cDNA generated from a single cell by 5'Race: application to isolation of antibody heavy and light chain variable gene sequences from single B cells. Biotechniques. Apr. 2006;40(4):469-70.
Padilla, R. et al., a Y639F/H784A T7 RNA polymerase double mutant displays superior properties for synthesizing RNAs with non-canonical NTPs. Nucleic Acids Res. Dec. 15, 2002;30(24):e138.
Paglia, P. et al., Murine dendritic cells loaded in vitro with soluble protein prime cytotoxic T lymphocytes against tumor antigen in vivo. J Exp Med. Jan. 1, 1996;183(1):317-22.
Painter, H., et al., 494. Topical delivery of mRNA to the murine lung and nasal epithelium. Mol Ther. 2004; 9: S187.
Palese, P., Making Better influenza Virus Vaccines?, Emerging Infectious Diseases, vol. 12, No. 1 Jan. 2006, pp. 61-65.
Paul, G. et al in pursuit of new developments for gene therapy of human diseases. J . Biotechnol. Feb. 5, 1995;68 (1):1-13.
Palucka, A.K. et al., Taming cancer by inducing immunity via dendritic cells. Immunol Rev. Dec. 2007 ;220:129-50.
Pangburn, Todd et al., Peptide-and Aptamer-Functionalized Nanovectors for Targeted Delivery of Therapeutics, Journal of Biomedical Engineering, 2009, vol. 131, No number, pp. 1-20.
Papapetrou, E., et al., Stoichiometric and temporal requirements of Oct. 4, Sox2, Klf4, and c-Myc expression for efficient human iPSC induction and differentiation. Natl. Acad. Sci USA. Aug. 2009; 106: 12759-12764.
Paradi, E. et al., Changes in the content of modified nucleotides in wheat rRNA during greening. Biologia Plantarum. 2003/4; 47(1):33-8.
Park, I., et al., Reprogramming of human somatic cells to pluripotency with defined factors. Nature. Jan. 2008; 451 (10): 141-146.
Parker et al., Targeting of Polyelectrolyte RNA Complexes to Cell Surface Integrins as an Efficient, Cytoplasmic Transfection Mechanism, Journal of Bioactive and Compatible Polymers, Jul. 2002, pp. 1-10.
Parker, R. et al., Recognition of the TACTAAC box during mRNA splicing in yeast involves base pairing to the U2-like snRNA. Cell. Apr. 24, 1987;49(2):229-39.

(56) References Cited

OTHER PUBLICATIONS

Pascolo, S. Vaccination with messenger RNA (mRNA). Handb Exp Pharmacol. 2008; 183:221-235.
Passini, MA et al., AAV vector-mediated correction of brain pathology in a mouse model of Niemann-Pick a disease. Mol Ther. May 2005;11(5):754-62.
Passos, Ga et al., In vivo induction of immunological memory to human tumor extract with poly (A)-containing immune RNA. Cell Mol Biol. 1988;34(2):157-64.
Pastore, Nunzia et al., Sustained Reduction of Hyperbilirubinemia in Gunn Rats After Adeno-Associated Virus-Mediated Gene Transfer of Bilirubin UDP-Glucuronosyltransferase Isozyme 1A1 to Skeletal Muscle, Human Gene Therapy, 2012, vol. 23, No#, pp. 1082-1089.
Paul, S., et al., How to improve R&D productivity: the pharmaceutical industry's grand challenge. Nat Reviews Drug Discovery. Mar. 2010; 9: 203-214.
Pays, E., Characterization of double-stranded ribonucleic acid sequences present in the initial transcription products of rat liver chromatin. Biochem J. Aug. 1, 1977;165(2):237-45.
Peakman, Mark et al., Can We Vaccinate Against Type 1 Diabetes, F1000Reports Biology, 2012, No vol. no., pp. 1-8.
Pearson, W.R. et al., Improved tools for biological sequence comparison. Proc Natl Acad Sci U S A. Apr. 1988;85 (8):2444-8.
Peculis, B. RNA processing: pocket guides to ribosomal RNA. Curr Biol. Aug. 1, 1997;7(8):R480-2.
Peng, Z.H. et al., Synthesis and application of a chain-terminating dinucleotide mRNA cap analog. Org Lett. Jan. 24, 2002;4(2):161-4.
Penheiter et al., Type II Transforming Growth Factor-6 Receptor Recycling Is Dependent upon the Clathrin Adaptor Protein Dab2, Molecular Biology of the Cell, vol. 21, 4009-4019, Nov. 15, 2010.
Peoples, G.E. et al., Breast and ovarian cancer-specific cytotoxic T lymphocytes recognize the same HER2/neu- derived peptide. Proc Natl Acad Sci U S A. Jan. 17, 1995;92(2):432-6.
Perche, F., et al., Enhancement of dendritic cells transfection in vivo and of vaccination against B16F10 melanoma with mannosylated histidylated lipopolyplexes loaded with tumor antigen messenger RNA. Nanomed: Nanotech, Bio, and Med. Aug. 2011; 7(4): 445-453.
Perez-Velez, Mariel et al., Induction of Neutralization Antibodies in Mice by Dengue-2 Envelope DNA Vaccines, National Institutes of Health, PR Health Sci, 2009, vol. 28, No. 3, pp. 239-250.
Pesole, G. et al., Structural and functional features of eukaryotic mRNA untranslated regions. Gene. Oct. 3, 2001;276 (1-2):73-81.
Pesole, G. et al., UTRdb and UTRsite: specialized databases of sequences and functional elements of 5' and 3' untranslated regions of eukaryotic mRNAs. Update 2002. Nucleic Acids Res. Jan. 1, 2002;30(1):335-40.
Petit, I., et al., G-CSF induces stem cell mobilization by decreasing bone marrow SDF-I and up-regulating CXCR4. Nature Immunology. Jul. 2002; 3(7): 687-694.
Petsch et al., Protective efficacy of in vitro synthesized, specific mRNA vaccines against influenza a virus infection. Nat Biotechnol. Dec. 2012;30(12):1210-6. doi: 10.1038/nbt.2436. Epub Nov. 25, 2012.
Phelan, Anne et al., Intercellular Delivery of Functional p53 by the Herpesvirus Protein VP22, Nature Biotechnology, 1998, vol. 16, pp. 440-443.
Phillips, J. et al., Antisense RNA Amplification: A Linear Amplification Method for Analyzing the mRNA Population from Single Living Cells. Methods. Dec. 1996;10(3):283-8.
Phizicky, E.M. et al., [31] Biochemical genomics approach to map activities to genes. Methods Enzymol. 2002;350:546-59.
Piganis, R. et al., Suppressor of Cytokine Signaling (SOCS) 1 Inhibits Type 1 Interferon (IFN) Signaling via the Interferon a Receptor (IFNAR1)-associated Tyrosine Kinase Tyk2, the Journal of Biological Chemistry, vol. 286, No. 39, pp. 33811-33818.

Podbregar, Matej et al., Cytokine Response of Cultured Skeletal Muscle Cells Stimulated with Proinflammatory Factors Depends on Differentiation Stage, the Scientific World Journal, 2013, vol. 2013, Article Id 617170, pp. 1-8.
Polidoros, a. et al., Rolling Circle Amplification-Race: a method for Simultaneous Isolation of 5" and 3" cDNA ends from Amplified cDNA templates, Benchmarks, Biotechniques, 2006, vol. 41, No. 1, pp. 35-42.
Pollard, C., et al., Type I IFN counteracts the induction of antigen-specific immune responses by lipid-based delivery of mRNA vaccines. Mol Ther. Jan. 2013; 21(1): 251259.
Pon, R., Multiple Oligodeoxyribonucleotide Syntheses on a Reusable Solid-Phase CPG Support Via the Hydroquinone-O, O'-diacetic acid (Q-Linker) linker arm, Nucleic Acids Research, 1999, vol. 27, No. 6, pp. 1531-1538.
Ponsaerts, P. et al., Cancer immunotherapy using Rna-loaded dendritic cells. Clin Exp Immunol. Dec. 2003;134 (3):378-84.
Ponsaerts, P. et al., Messenger RNA electroporation is highly efficient in mouse embryonic stem cells: successful FLPe- and Cre-mediated recombination. Gene Ther. Nov. 5004;11(21):1 606-10.
Ponsaerts, P. et al., Messenger RNA electroporation of human monocytes, followed by rapid in vitro differentiation, leads to highly stimulatory antigen-loaded mature dendritic cells. J Immunol. Aug. 15, 2002;169(4):1669-75.
Ponsaerts, P., et al., Highly efficient mRNA-based gene transfer in feeder-free cultured H9 human embryonic stem cells. Cloning and Stem Cells. 2004; 6(3): 211-216.
Porgador, a. et al., Induction of antitumor immunity using bone marrow-generated dendritic cells. J Immunol. Apr. 15, 1996;156(8):2918-26.
Pradilla, G. et al., Prevention of vasospasm following subarachnoid hemorrhage in rabbits by anti-CD11/CD18 monoclonal antibody therapy. J Neurosurg. Jul. 2004;101 (1):88-92.
Preisler, H.D. et al., Sensitization in vitro to murine myeloblastic leukemia cells by xenogeneic immune RNA. J Natl Cancer Inst. Jan. 1979;62(1):133-7.
Preiss, T. et al., Dual function of the messenger RNA cap structure in poly(A)-tail-promoted translation in yeast. Nature. Apr. 2, 1998;392(6675):516-20.
Presta, Leonard G. et al., Humanization of Anti-Vascular Endothelial Growth Factor Monoclonal Antibody for the Therapy of Solid Tumors and Other Disorders, Cancer Research, 1997, vol. 57, pp. 4593-4599.
Pridgen, et al.; Transepithelial Transport of Fc-Targeted Nanoparticles by the Neonatal Fc Receptor for Oral Delivery, Sci Translation Med., vol. 5, Issue 213, Nov. 27, 2013, pp. 1-8.
Probst, J., et al., Spontaneous cellular uptake of exogenous messenger RNA in vivo is nucleic acid-specific, saturable and ion dependent. Gene Therapy. 2007; 14: 1175-1180.
Puga, A. et al., Difference between functional and structural integrity of messenger RNA. Proc Natl Acad Sci USA. Jul. 1973;70(7):2171-5.
Pulford, B., et al., Liposome-siRNA-peptide complexes cross the blood-brain barrier and significantly decrease PrPAC on neuronal cells and PrPARES in infected cell cultures. PLoS One. 2010; 5(6): e11085.
Pullinger et al., Human cholesterol 7a-hydroxylase (CYP7A1) deficiency has a hypercholesterolemic phenotype, J. Clin. Invest. 110:109-117 (2002).
Purchio, A.F. et al., [24] Methods for molecular cloning in eukaryotic cells. Methods Enzymol. 1979; 68:357-75.
Qi, L.S.- S et al Repurposing Crispr as an RNA-guided platform for sequence-specific control of gene expression. Cell. Feb. 28, 2013; 152(5): 1173-1183.
Queen, C et al., A humanized antibody that binds to the interleukin 2 receptor, Proc. Natl. Acad. Sci. USA, 1989, vol. 86, pp. 10029-10033.
Query, C.C. et al., Branch nucleophile selection in pre-mRNA splicing: evidence for the bulged duplex model. Genes Dev. Mar. 1, 1994; 8(5):587-97.
Raal, Frederick et al., Low-Density Lipoprotein Cholesterol-Lowering Effects of AMG 145, a Monoclonal Antibody to Proprotein

(56) References Cited

OTHER PUBLICATIONS

Convertase Subtilisin/Kexin Type 9 Serine Protease in Patients With Heterozygous Familial Hypercholesterolemia: The Reduction of LDL-C With PCSK9 Inhibition in Heterozygous Familial Hypercholesterolemia Disorder (Rutherford) Randomized Trial, Circulation, 2012, vol. 126, pp. 2408-2417.
Rabinovich, P.M., et al., Chimeric receptor mRNA transfection as a tool to generate Antineoplastic Lymphocytes. Hum. Gene Ther. Jan. 2009; 20: 51-61.
Rabinovich, P.M., et al., Synthetic messenger RNA as a tool for gene therapy. Hum. Gene Ther. Oct. 2006; 17: 1027-1035.
Racila, D. et al., Transient expression of OCT4 is sufficient to allow human keratinocytes to change their differentiation pathway. Gene Ther. Mar. 2011; 18(3): 294-303.
Rader et al., Monogenic hypercholesterolemia: new insights in pathogenesis and treatment, J. Clin. Invest. 111 :1795-1803 (2003).
Raff, M., Adult stem cell plasticity: fact or artifact? Annu Rev Cell Dev Biol. 2003;19:1- 2 2.
Raghavan, Malini et al., Calreticulin in the immune system: ins and outs, Cell Press, Trends in Immunology, 2013, vol. 34, No. 1, pp. 13-21.
Rajagopalan, Le. et al., Turnover and translation of in vitro synthesized messenger RNAs in transfected, normal cells. J Biol Chem. Aug. 16, 1996;271(33):19871-6.
Ramanathan, Mathura et al., Development of Novel DNA SynCon Tetravalent Dengue Vaccine That Elicits Immune Responses Against Four Serotypes, Vaccine, 2009, vol. 27, No Number, pp. 6444-6453.
Ramazeilles, C. et al., Antisense phosphorothioate oligonucleolides: selective killing of the intracellular parasite Leishmania amazonensis. Proc Natl Acad Sci U S A. Aug. 16, 1994;91(17):7859-63.
Rammensee, H.G. et al., Peptides naturally presented by MHC class I molecules. Annu Rev Immunol. 1993; 11:213-44.
Rascati, R.J. et al., Characterization of Fv-1 gene-product-mediated resistance transfer. Intervirology. 1981;15 (2):87-96.
Raschke, Silja et al., Adipo-Myokines: Two Sides of the Same Coin-Mediators of Inflammation and Mediators of Exercise, Mediators of Inflammation, 2013, vol. 2013, Article ID 320724, pp. 1-16.
Ratajczak, J. et al., Embryonic stem cell-derived microvesicles reprogram hematopoietic progenitors: evidence for horizontal transfer of mRNA and protein delivery. Leukemia. May 2006;20(5):847-56.
Ratajczak, J. et al., Membrane-derived microvesicles: important and underappreciated mediators of cell-to-cell communication. Leukemia. Sep. 2006;20(9):1487-95. Epub Jul. 20, 2006.
Ravichandran, Kodi S., Find-me and eat-me signals in apoptotic cell clearance: progress and conundrums, JEM, 2010, vol. 207, pp. 1807-1817.
Read, M.L., et al., A versatile reducible polycation-based system for efficient delivery of a broad range of nucleic acids. Nucleic Acids Res. 2005; 33(9): e86.
Reddy, A. et al., the effect of labour and placental separation on the shedding of syncytiotrophoblast microparticles, cell-free DNA and mRNA in normal pregnancy and pre-eclampsia. Placenta. Nov. 2008;29(11):942-9. Epub Oct. 1, 2008.
Reed, R. et al., Intron sequences involved in lariat formation during pre-mRNA splicing. Cell. May 1985;41(1):95-105.
Regberg, Jakob et al., Applications of Cell-Penetrating Peptides for Tumor Targeting and Future Cancer Therapies, Pharmaceuticals, 2012, vol. 5, No number, pp. 991-1007.
Regnier, P. et al., Degradation of mRNA in bacteria: emergence of ubiquitous features. Bioessays. Mar. 2000;22 (3):235-44.
Rejman, J., et al., mRNA transfection of cervical carcinoma and mesenchymal stem cells mediated by cationic carriers. J Controlled Rel. Nov. 2010; 147(3): 385-391.
Ren, W., et al. Molecular clang and characterization of 4-hydroxyphenylpyruvate dioxygenase gene from Lactuca saliva. Journal of Patent Physiology 168 (2011 pp. 1076-1083).
Renkvist, N. et al., A listing of human tumor antigens recognized by T cells. Cancer Immunol Immunother. Mar. 2001;50(1):3-15.

Reyes-Sandoval, A. et al., DNA Vaccines. Curr Mol Med. May 2001;1(2):217-43.
Reynolds, Ba et al., Generation of neurons and astrocytes from isolated cells of the adult mammalian central nervous system. Science. Mar. 27, 1992;255(5052):1707-10.
Richter, J.D., Cytoplasmic polyadenylation in development and beyond. Microbiol Mol Biol Rev. Jun. 1999;63 (2):446-56.
Rittig et al., Intradermal vaccinations with RNA coding for TAA generate CD8+ and CD4+ immune responses and induce clinical benefit in vaccinated patients. Mol Ther. May 2011;19(5):990-9. doi: 10.1038/mt.2010.289. Epub Dec. 28, 2011.
Robak, Tadeusz et al., Current and Emerging Treatments for Chronic Lymphocytic Leukaemia, Drugs, 2009, vol. 69, No. 17, pp. 2415-2449.
Robbins et al., Retroviral Vectors for Use in Human Gene Therapy for Cancer, Gaucher Disease, and Arthritis; Annals of the New York Academy of Sciences, 2006, vol. 716, No. 1, pp. 72-89.
Robbins, Majorie et al., 2'-0-methyl-modified RNAs Act as TLR7 Antagonists, Molecular Therapy, 2007, vol. 15, No. 9, pp. 1663-1669.
Robbins, P.F. et al., Human tumor antigens recognized by T cells. Curr Opin Immunol. Oct. 1996;8(5):628-36.
Roberts, J.N. et al., Genital transmission of HPV in a mouse model is potentiated by nonoxynol-9 and inhibited by carrageenan. Nat Med. Jul. 2007; 13(7): 857-861.
Robinson, F. et al., Expression of human nPTB is limited by extreme suboptimal codon content. PLoS One. Mar. 12, 2008;3(3):e1801.
Robinson, H.L. et al., Protection against a lethal influenza virus challenge by immunization with a haemagglutinin-expressing plasmid DNA. Vaccine. 1993;11(9):95760.
Robles, Al. et al., Reduced skin tumor development in cyclin D1-deficient mice . highlights the oncogenic ras pathway in vivo. Genes Dev. Aug. 15, 1998;12(16):2469-74.
Rock, KL et al., A new foreign policy: MHC class I molecules monitor the outside world. Immunol Today. Mar. 1996;17(3):131-7.
Rodriguez, Pl et al., Minimal "self" peptides that inhibit phagocytic clearance and enhance delivery of nanoparticles. Science. Feb. 22, 2013; 339(6122): 971-975.
Roep, Bart et al., Antigen Targets of Type 1 Diabetes Autoimmunity, Cold Spring Harbor Perspectives in Medicine, 2013, No vol., pp. 1-15.
Roger S. Riley, Md, Ph.D., Apr. 2005, http://www.pathology.vcu.edu/clinical/coag/Fiv/020Deficiency.pdf, No volume, no pages, no publisher, no journal, 2 pages.
Rohloff, C.M., et al., DU ROS® Technology delivers peptides and proteins at consistent rate continuously for 3 to 12 months. J Diabetes Sci Technol. May 2008; 2(3): 461-467.
Romani, N. et al., Generation of mature dendritic cells from human blood. An improved method with special regard to clinical applicability. J Immunol Methods. Sep. 27, 1996;196(2):137-51.
Romani, N. et al., Presentation of exogenous protein antigens by dendritic cells to T cell clones. Intact protein is presented best by immature, epidermal Langerhans cells. J Exp Med. Mar. 1, 1989;169(3):1169-78.
Rosa, A., et al., Synthetic mRNAs: Powerful tools for reprogramming and differentiation of human cells. Cell Stem Cell. Nov. 2010; 7: 549-550.
Rosenberg, Sa et al., Cancer immunotherapy: moving beyond current vaccines. Nat Med. Sep. 2004;10(9):909-15.
Rosman, Ziv et al., Biologic Therapy for Autoimmune Diseases: an update, BMC Medicine, 2013, vol. 11 No. 88 pp. 1-12.
Ross, J. Control of messenger RNA stability in higher eukaryotes. Trends Genet. May 1996;12(5):171-5.
Rozenski, J., "The RNA Modification Database: 1999 update," Nucleic Acids Research, 1999, vol. 27, No. 1, pp. 196-197.
Ruetschi, U., et al. Human 4-Hydroxyphenylpyruvate Dioxygenase Gene (HPD). Genomics 44, pp. 292-299 (1997).
Ruf, P. et al., Characterization of the New EpCAM-specific antibody H0-3: Implications for Trifunctional Antibody Immunotherapy of Cancer, British Journal of Cancer, 2007, vol. 97, No. 3, pp. 315-21.

(56) References Cited

OTHER PUBLICATIONS

Ruhnke, M. et al., Long-term culture and differentiation of rat embryonic stem cell-like cells into neuronal, glial, endothelial, and hepatic lineages. Stem Cells. 2003;21(4):42836.
Ryser, M., et al., S1 P1 overexpression stimulates S1P-dependent chemotaxis of human CD34+ hematopoietic progenitor cells but strongly inhibits SDF-1/CXCR4-dependent migration and in vivo homing. Mol Immunology. 2008;46: 166-171.
Saenz-Badillos, J. et al., RNA as a tumor vaccine: a review of the literature. Exp Dermatol. Jun. 2001;10(3):143-54.
Saison-Behmoaras, T. et al., Short modified antisense oligonucleotides directed against Ha-ras point mutation induce selective cleavage of the mRNA and inhibit T24 cells proliferation. EMBO J. May 1991;10(5):1111-8.
Saito, K. et al., Cell participation in immune response by immune ribonucleic acid. I. The role of T lymphocytes in immune response by immune Rna against T-dependent antigens. Immunology. Dec. 1980;41(4):937-45.
Saito, R., et al., Distribution of liposomes into brain and rat brain tumor models by convection-enhanced delivery monitored with magnetic resonance imaging. Cancer Res. Apr. 2004; 64: 2572-2579.
Sakuma, S. et al., Mucoadhesion of polystyrene nanoparticles having surface hydrophilic polymeric chains in the gastrointestinal tract. Int J Pharm. Jan. 25, 1999;177(2):161-72.
Sallusto, F. et al., Dendritic cells use macropinocytosis and the mannose receptor to concentrate macromolecules in the major histocompatibility complex class II compartment: downregulation by cytokines and bacterial products. J Exp Med. Aug. 1, 1995;182(2):389-400.
Sallusto, F. et al., Efficient presentation of soluble antigen by cultured human dendritic cells is maintained by granulocyte/macrophage colony-stimulating factor plus interleukin 4 and downregulated by tumor necrosis factor alpha. J Exp Med. Apr. 1, 1994;179(4):1109-18.
Salzman, Julia et al., Circular RNAs Are the Predominant Transcript Isoform From Hundreds of Human Genes in Diverse Cell Types, Plos One, 2012, vol. 7, Issue 2, pp. 1-12.
Samarsky, DA et al., The snoRNA box CID motif directs nucleolar targeting and also couples snoRNA synthesis and localization. Embo J. Jul. 1, 1998;17(13):3747-57.
Santini, S.M. et al., Type I interferon as a powerful adjuvant for monocyte-derived dendritic cell development and activity in vitro and in Hu-PBL-SCID mice. J Exp Med. May 15, 2000;191(10):1777-88.
Sanyal, S. et al., Effects of RNA on the developmental potentiality of the posterior primitive streak of the chick blastoderm. Proc Natl Acad Sci U S A. Apr. 1966;55(4):743-50.
Saponara, A.G. et al., The isolation from ribonucleic acid of substituted uridines containing alpha-aminobutyrate moieties derived from methionine. Biochim Biophys Acta. Apr. 27, 1974;349(1):61-77.
Satoh, M. et al., X-linked immunodeficient mice spontaneously produce lupus-related anti-RNA helicase A autoantibodies, but are resistant to pristane-induced lupus. Int Immunol. Sep. 2003;15(9):1117-24.
Satthaporn, S. et al., Dendritic cells (II): Role and therapeutic implications in cancer. J R Coll Surg Edinb. Jun. 2001;46(3):159-67.
Satz, M.L. et al., Mechanism of immune transfer by RNA extracts. Immune RNA induces the synthesis of idiotype- bearing antigen receptors in noncommitted cells. Mol Cell Biochem. Dec. 16, 1980;33(3):105-13.
Scheel, B. et al., Immunostimulating capacities of stabilized RNA molecules. Eur J Immunol. Feb. 2004;34(2):537-47.
Scheid, Johannes et al., Sequence and Structural Convergence of Broad and Potent HIV Antibodies That Mimic CD4 Binding, Science , 2011, vol. 333, No Number, 16331637.
Schirrmacher, V. et al., Intra-pinna anti-tumor vaccination with self-replicating infectious RNA or with DNA encoding a model tumor antigen and a cytokine. Gene Ther. Jul. 2000;7(13):1137-47.
Schmidt, W.M. et al., CapSelect: a highly sensitive method for 5' Cap-dependent enrichment of full-length cDNA in PCR-mediated analysis of mRNAs. Nucleic Acids Res. Nov. 1, 1999;27(21):e31.
Schmitt, Francoise et al., Lentiviral Vectors That Express UGT1A1 in Liver and Contain miR-142 Target Sequences Normalize Hyperbilirubinemia in Gunn Rats, Gastroenterology, 2010, vol. 139, No. 3, pp. 999-1007.
Schmitt, W.E. et al., In vitro induction of a bladder cancer-specific T-cell response by mRNA-transfected dendritic cells. J Cancer Res Clin Oncol. 2001;127(3):203-6.
Scholte, B.J. et al., Animal models of cystic fibrosis. J Cyst Fibros. Aug. 2004;3 Suppl 2:183-90.
Schott, J.W., et al., Viral and non-viral approaches for transient delivery of mRNA and proteins. Current Gene Ther. 2011; 11 (5): 382-398.
Schroeder, Ulrich et al. , Peptide Nanoparticles Serve as a Powerful Platform for the Immunogenic Display of Poorly Antigenic Actin Determinants, Science Direct, J. Mol. Biol., 2009, vol. 386, No vol. Number, pp. 1368-1381.
S.Chuler, G. et al., Murine epidermal Langerhans cells mature into potent immunostimulatory dendritic cells in vitro. J Exp Med. Mar. 1, 1985;161(3):526-46.
Schuler-Thurner, B. et al., Mage-3 and influenza-matrix peptide-specific cytotoxic T cells are inducible in terminal stage HLA-A2.1+ melanoma patients by mature monocyte-derived dendritic cells. J Immunol. Sep. 15, 2000;165(6):3492-6.
Seabury, C.M., et al. Analysis of sequence variability and protein domain architectures for bovine peptidoglycan recognition protein 1 and Toll-like receptors 2 and 6. Genomics 92 (2008) pp. 235-245.
Segura, J., et al., Monitoring gene therapy by external imaging of mRNA: Pilot study on murine erythropoietin. Ther Drug Monit. Oct. 2007; 29(5): 612-8.
Seldin, Marcus M. et al., Regulation of tissue crosstalk by skeletal muscle-derived myonectin and other myokines, Adipocyte, 2012, vol. 1, No. 4, pp. 200-202.
Semple, S.C., et al., Efficient encapsulation of antisense oligonucleotides in lipid vesicles using ionizable aminolipids: formation of novel small multilamellar vesicle structures. Biochim Biophys Acta. Feb. 9, 2001; 1510(1-2): 152-166.
Serrate, S. et al., Transfer of cellular immunity in vivo with immune RNA in an allogeneic murine model. Clin Immunol Immunopathol. Jan. 1982;22(1):75-82.
Sharp, J.S. et al., Effect of translational signals on mRNA decay in Bacillus subtilis. J Bacteriol. Sep. 2003;185 (18):5372-9.
Sharp, P.M. et al., DNA sequence evolution: the sounds of silence. Philos Trans R Soc Lond B Biol Sci. Sep. 29, 1995;349(1329):241-7.
Shea, R.G. et al., Synthesis, hybridization properties and antiviral activity of lipid-Shea, R.G." oligodeoxynucleotide conjugates. Nucleic Acids Res. Jul. 11, 1990;18(13):3777-83.
Shealy, David et al., Characterization of Golimumab, A Human Antibody Specific for Human Tumor Necrosis Factor a, mAbs, 2010, vol. No. 2, No. 4, pp. 428-439.
Shen, B. et al., Generation of gene-modified mice via Cas9/RNA-mediated gene targeting. Cell Res. Apr. 2, 2013; 1-4. doi:10.1038/cr.2013.46.
Sheridan, W. et al., Effects of Peripheral-Blood Progenitor Cells Mobilised by Filgrastim (G-CSF) on Platelet Recovery After High-Dose Chemotherapy, The Lancet, 1992, vol. 339, pp. 640-644.
Shi, Y. et al., Identification and characterization of pancreatic eukaryotic initiation factor 2 alpha-subunit kinase, Pek, involved in translational control. Mol Cell Biol. Dec. 1998; 18(12): 7499-7509.
ShiY et al a combined chemical and genetic approach for the generation of induced pluripotent stem cells. Cell Stem Cell. Jun. 2008; 2: 525-528.
Shiba, Y. et al., Chemical Synthesis of a Very Long Oligoribonucleolide with a 2- cyanoethoxymethyl (CEM) as the 2'-O-protecting Group: Structural Identification and Biological Activity of a Synthetic 110mer precursor-microRNA Candidate, Nucleic Acids Research, 2007, vol. 35, No. 10, pp. 3287-3296.

(56) References Cited

OTHER PUBLICATIONS

Shin, Jae Hun et al., Positive conversion of negative signaling of CTLA4 potentiates anti-tumor efficacy of adoptive T cell therapy in murine tumor models, Blood, 2012, No vol. , pp. 1-29.

Shingai, M. et al., Antibody-mediated Immunotherapy of Macaques Chronically Infected with SHIV Suppresses Viraemia, Nature, 2013, vol. 503, No. 7475, pp. 277-80.

Shingo, T. et al., Erythropoietin regulates the in vitro and in vivo production of neuronal progenitors by mammalian forebrain neural stem cells. J Neurosci. Dec. 15, 2001;21(24):9733-43.

Shuman, S. et al., Purification and characterization of a GTP-pyrophosphate exchange activity from vaccinia virions. Association of the GTP-pyrophosphate exchange activity with vaccinia mRNA guanylyltransferase. RNA (guanine-7-) methyltransferase complex (capping enzyme). J Biol Chem. Dec. 10, 1980;255(23):11588-11598.

Shuman, S., Capping enzyme in eukaryotic mRNA synthesis. Prog Nucleic Acid Res Mol Biol. 1995;50:101-29.

Shuman, S., Structure, mechanism, and evolution of the mRNA capping apparatus. Prog Nucleic Acid Res Mol Biol. 2001;66:1-40.

Siena, S. et al., Expansion of Immunostimulatory Dendritic Cells from Peripheral Blood of Patients with Cancer. Oncologist. 1997;2(1):65-69.

Simioni, Paolo et al., X-Linked Thrombophilia with a Mutant Factor IX (Factor IX Padua), The New England Journal of Medicine, 2009, vol. 361, No. 17, pp. 1671-1675.

Simon, Thorsten et al., Consolidation Treatment With Chimeric Anti-GD2-Anlibody ch14.18 in Children Older Than 1 Year With Metastatic Neuroblastoma, Journal of Clinical Oncology, 2004, vol. 22, No. 17, pp. 3549-3557.

Simonaro, C.M. et al., Joint and bone disease in mucopolysaccharidoses VI and VII: identification of new therapeutic targets and biomarkers using animal models. Pediatr Res. May 2005;57(5 Pt 1):701-7. Epub Mar 3, 2005.

Sindelar, L. et al., High-throughput DNA Synthesis in a Multichannel Format, Nucl. Acids Res. 1995, vol. 23, No. 6, pp. 982-987. Abstract Only.

Slapikoff, S. et al., Mechanism of ribonucleic acid polymerase action. Effect of nearest neighbors on competition between uridine triphosphate and uridine triphosphate analogs for incorporation into ribonucleic acid. Biochemistry. Dec. 1967; 6(12): 36543658.

Sleeman, J. et al., Dynamic interactions between splicing snRNPs, coiled bodies and nucleoli revealed using snRNP protein fusions to the green fluorescent protein. Exp Cell Res. Sep. 15, 1998;243(2):290-304.

Smith, C.M. et al., Sno storm in the nucleolus: new roles for myriad small RNPs. Cell. May 30, 1997;89(5):669-72.

Smith, J.P., et al., Drug retention and distribution after intratumoral chemotherapy with fluorouracil/epinephrine injectable gel in human pancreatic cancer xenografts. Cancer Chemother Pharmacol. 1999; 44: 267-274.

Smith, K.P. et al., Interactions of U2 gene loci and their nuclear transcripts with Cajal (coiled) bodies: evidence for PreU2 within Cajal bodies. Mol Biol Cell. Sep. 2000;11(9):2987-98.

Smits, E., et al., RNA-based gene transfer for adult stem cells and T cells. Leukemia. 2004; 18: 1898-1902.

Smull, C.E., and Ludwig, E.H. Enhancement of the plaque-forming capacity of poliovirus ribonucleic acid with basic proteins. Journal of Bacteriology. 1962; 84(5): 1035-1040.

Sohn, R.L., et al., In-vivo particle mediated delivery of mRNA to mammalian tissues: ballistic and biological effects. Wound Rep and Regen. Jul.-Aug. 2001; 287-296.

Sontheimer, E.J. et al., The U5 and U6 small nuclear RNAs as active site components of the spliceosome. Science. Dec. 24, 1993;262(5142):1989-96.

Sorrentino, Vincenzo et al., Post-transcriptional regulation of lipoprotein receptors by the E3-ubiquitin ligase inducible degrader of the low-density lipoprotein receptor, Current Opinion, 2012, vol. 23, No. 3, pp. 213-219.

Sousa, R. et al., T7 RNA polymerase. Prog Nucleic Acid Res Mol Biol. 2003;73:1-41.

Sousa, R., Use of T7 RNA polymerase and its mutants for incorporation of nucleoside analogs into RNA. Methods Enzymol. 2000;317:65-74.

Spooner, Ra et al., DNA vaccination for cancer treatment. Gene Ther. May 1995;2(3):173-80.

Spratlin, Jennifer L. et al., Phase I Pharmacologic and Biologic Study of Ramucirumab (IMC-1121 B), a Fully Human Immunoglobulin G1 Monoclonal Antibody Targeting the Vascular Endothelial Growth Factor Receptor-2, Journal of Clinical Oncology, 2010, vol. 28, No. 5, pp. 780-787.

Sproat, B.S., Chemistry and applications of oligonucleotide analogues. J Biotechnol. Jul. 31, 1995;41 (2-3):221-38.

Squires, Jeffrey et al., Widespread occurrence of 5-methylcytosine in human coding an non-coding RNC, Nucleic Acids Research, 2012, vol. 40, No. 11, pp. 5023-5033.

Srinivasan, A. et al., Tositumomab and Iodine 1131 Tositumomab Bexxar, Pharmacology Vignette, 2011, vol. 32, No #,pp. 637-638.

Stadtfeld, M. et al., Induced pluripotent stem cells generated without viral integration. Science. Nov. 7, 2008; 322 (5903): 945-949.

Staley, J.P. et al., Mechanical devices of the spliceosome: motors, clocks, springs, and things. Cell. Feb. 6, 1998;92 (3):315-26.

Stanek, D. et al., Detection of snRNP assembly intermediates in Cajal bodies by fluorescence resonance energy transfer. J Cell Biol. Sep. 27, 2004;166(7):1015-25.

Stark, M. et al., An RNA Ligase-mediated Method for the Efficient Creation of Large, Synthetic RNAs, Method, 2006, vol. 12, no. vol. number, pp. 2014-2019.

Steege, Da, Emerging features of mRNA decay in bacteria. RNA. Aug. 2000;6(8):1079-90.

Steel, John et I., influenza Virus Vaccine Based on the Conserved Hemagglutinin Stalk Domain, mBio, 2010, vol. 1, Issue 1, pp. 1-10.

Stein et al., Effect of a Monoclonal Antibody to PCSK9 on LDL Cholesterol, N. Engl J Med 2012;366:1108-18.

Steinfield, Serge et al., Epratuzumab (humanized anti-CD22 antibody) in autoimmune diseases, Expert Opinion, 2006, vol. 6, No. 9, pp. 943-949.

Steinman, R.M., The dendritic cell system and its role in immunogenicity. Annu Rev Immunol. 1991;9:271-96.

Stepinski, J. et al., Synthesis and properties of mRNAs containing the novel "anti-reverse" cap analogs 7-methyl(3'- O-methyl)GpppG and 7-methyl (3'-deoxy)GpppG. RNA. Oct. 2001;7(10):1486-95.

Sterner, D.E. et al, Acetylation of histones and transcription-related factors. Microbiol Mol Biol Rev. Jun. 2000;64 (2):435-59.

Stevenson, Frazier et al., The N-terminal propiece of interleukin 1a is a transforming nuclear oncoprotein, Proc. Natl. Acad. Sci. USA, 1997, vol. 94, No#, pp. 508-513.

Stiles, D. K. et al., Widespread suppression of huntingtin with convection-enhanced delivery of siRNA. Experimental Neurology. Jan. 2012; 233(1): 463-471.

Stinchcomb, D.T. et al., Isolation and characterisation of a yeast chromosomal replicator. Nature. Nov. 1, 1979;282 (5734):39-43.

Stockinger et al., The PX-domain protein SNX17 interacts with members of the LDL receptor family and modulates endocytosis of the LDL receptor, European Molecular Biology Organization, vol. 21 No. 16 pp. 4259-4267.

Strassburg, Christian P. et al., Hyperbilirubinemia syndromes (Gilbert-Meulengracht, Crigler-Najjar, Dubin-Johnson, and Rotor syndrome), Best Practice & Research Clinical Gastroenterology, 2010, vol. 24, No.#, pp. 555-571.

Strausberg et al., National Cancer Institute, Cancer Genome Anatomy Project, Tumor Gene Index, gene accession No. 6E136127, 1997 1 page.

Strobel, I. et al., Human dendritic cells transfected with either RNA or DNA encoding influenza matrix protein M1 differ in their ability to stimulate cytotoxic T lymphocytes. Gene Ther. Dec. 2000; 7(23): 2028-2035.

Strong, V.T. et al., Incorporation of beta-globin untranslated regions into a Sindbis virus vector for augmentation of heterologous mRNA expression. Gene Ther. Jun. 1997;4(6):624-7.

Stroock, A. et al., Chaotic Mixer for Microchannels, Science, vol. 295, Jan. 25, 2002, pp. 647-651.

(56) References Cited

OTHER PUBLICATIONS

Stuart, Lynda M. et al., Cell Maturation upon Endotoxin-Driven Myeloid Dendritic Inhibitory Effects of Apoptotic Cell Ingestion, The Journal of Immunology, 2002, vol. 168, No#, pp. 1627-1635.
Studier, F.W. et al., Use of T7 RNA polymerase to direct expression of cloned genes. Methods Enzymol. 1990; 185:60-89.
Studier, F.W. et al., Use of bacteriophage T7 RNA polymerase to direct selective high-level expression of cloned genes. J Mol Biol. May 5, 1986;189(1):113-30.
Su, Z. et al., Enhanced induction of telomerase-specific CD4(+) T cells using dendritic cells transfected with RNA encoding a chimeric gene product. Cancer Res. Sep. 1, 2002;62(17):5041-8.
Su, Z. et al., Immunological and clinical responses in metastatic renal cancer patients vaccinated with tumor RNA- transfected dendritic cells. Cancer Res. May 1, 2003;63(9):2127-33.
Suchanek, Gerda et al., Amino Acid Sequence of Honeybee Prepromelil-lin Synthesized in Vitro, Proc. Natl. Acad. Sci. USA, 1978, vol. 75, No. 2, pp. 701-704.
Suciu-Foca, Nicole et al., Soluble IG-Like Transcript 3 Inhibits Tumor Allograft Rejection in Humanized Scio Mice and T Cell Responses in Cancer Patients, The Journal of Immunology, 2007, vol. 178, pp. 4732-7441.
Suda, T. et al., Hydrodynamic gene delivery: its principles and applications. Mol Ther. Dec. 2007;15(12):2063-9. Epub Oct. 2, 2007.
Sugatani, Junko et al., Transcriptional Regulation of Human UGT1A1 Gene Expression: Activated Glucocorticoid Receptor Enhances constitutive Androstane Receptor/ Pregnane X Receptor/ Mediated Udp-Glucuronosyltransferase 1A1 Regulation with Glucocorticoid Receptor-Interacting Protein 1, Molecular Pharmacology, 2013, vol. 67, No. 3, pp. 845-855.
Sullenger, Ba et al., Emerging clinical applications of RNA. Nature. Jul. 11, 2002;418(6894):252-8.
Sullivan, David et al., Effect of a Monoclonal Antibody to PCSK9 on Low-Density Lipoprotein Cholesterol Levels in Stalin-Intolerant Patients the Gauss Randomized Trial, Jama, 2012, vol. 308, No. 23, pp. 1-10.
Sumathipala, N. et al., Involvement of Manduca sexta peptidoglycan recognition protein-1 in the recognition of bacteria and activation of prophenoloxidase system. Insect Biochemistry and Molecular Biology 40 (2010) 487-495.
Summar, MD, Marshall et al., Current strategies for the management of neonatal urea cycle disorders, The Journal of Pediatrics, 2001, vol. 138, No. 1, pp. s30-s39.
Sun, Jian, et al., B lymphocyte stimulator: a new target for treating B cell malignancies, Chinese Medical Journal, 2008; vol. 12, No. 14, pp. 1319-1323.
Supplementary Data from Zhang et al., (J. Biol. Chem 282(25) 18602-12, 2007.
Surdo et al., Mechanistic implications for LDL receptor degradation from the PCSK9/LDLR structure at neutral pH, European Molecular Biology Organization, vol. 12 | no. 12 | 2011, pp. 1300-130.
Sutherland, Claire L. et al., ULBPs, human ligands of the NKG2D receptor, stimulate tumor immunity with enhancement by IL-15, 2006, vol. 108, No#, pp. 1313-1319.
Svinarchuk, F.P. et al., Inhibition of HIV proliferation in Mt-4 cells by antisense oligonucleotide conjugated to lipophilic groups. Biochimie. 1993;75(1-2):49-54.
Szabo, E. et al., Direct conversion of human fibroblasts to multilineage blood progenitors. Nature. Nov. 25, 2010; 468 (7323): 521-526.
Tahiliani et al., Conversion of 5-Methylcytosine to 5-Hydroxymethylcytosine in Mammalian DNA by MLL Partner TET1 Science 324, 930 (2009);www.sciencemag.org.
Takahashi, K., et al., Induction of pluripotent stem cells from adult human fibroblasts by defined factors. Cell. Nov. 2007; 131(5): 861-72.
Takahashi, K., et al., Induction of pluripotent stem cells from mouse embryonic and adult fibroblast cultures by defined factors. Cell. Aug. 2006; 126(4): 663-76.
Takahashi, R. et al., SOCS1 is Essential for Regulatory T Cell Functions by Preventing Loss of Foxp3 Expression As Well As IFN-y and IL-17A Production, The Journal of Experimental Medicine, 2011, vol. 208, No. 10, pp. 2055-2067.
Takahashi, T.T. et al., mRNA display: ligand discovery, interaction analysis and beyond. Trends in Biochem Sci. Mar. 2003; 28(3): 159-165.
Tam, C., et al., Cytokeratins mediate epithelial innate defense through their antimicrobial properties. J Clin Invest. Oct. 1, 2012; 122(10): 3665-3677.
Tanaka, M. et al., Inhibition of heart transplant injury and graft coronary artery disease after prolonged organ ischemia by selective protein kinase C regulators. J Thorac Cardiovasc Surg. May 2005;129(5):1160-7.
Tanaka, Toshio et al., Targeting Interleukin-6: All the Way to Treat Autoimmune and inflammatory Diseases, International Journal of Biological Sciences, 2012, vol. 8 No. 9, pp. 1227-1236.
Tang, D.C. et al., Genetic immunization is a simple method for eliciting an immune response. Nature. Mar. 12, 1992;356(6365):152-4.
Tanguay, R.L. et al., Translational efficiency is regulated by the length of the 3' untranslated region. Mol Cell Biol. Jan. 1996;16(1):146-56.
Taniguchi, Takashi et al., Serum Levels of Galectin-3: Possible Association with Fibrosis, Aberrant Angiogenesis, and Immune Activation in Patients with Systemic Sclerosis, the Journal of Rheumatology, 2012, vol. 39, No. 3, pp. 539-544.
Taranger, C.K. et al., Induction of dedifferentiation, genomewide transcriptional programming, and epigenetic reprogramming by extracts of carcinoma and embryonic stem cells. Mol Biol Cell. Dec. 2005;16(12):5719-35.
Tavernier, G., et al., mRNA as gene therapeutic: How to control protein expression. J. Of Controlled Release. Mar. 2011; 150(3): 238-247.
Tazi, J. et al., Alternative chromatin structure at CpG islands. Cell. Mar. 23, 1990;60(6):901744099-20.
Teckchandani et al., The clathrin adaptor Dab2 recruits Eh domain scaffold proteins to regulate integrin β1 endocytosis, Molecular Biology of the Cell, 2012, 23, 2905-2916.
Teeling, Jessica et al., Characterization of New Human CD20 Monoclonal Antibodies with Potent Cytolytic Activity Against Non-Hodgkin Lymphomas, Blood, 2004, vol. 104, No#, pp. 1793-1800.
Teeling, Jessica et al., The Biological Activity of Human CD20 Monoclonal Antibodies Is Linked to Unique Epitopes on CD20, the Journal of Immunology, 2006, vol. 177, No#, pp. 362-371.
Teufel, R. et al., Human peripheral blood mononuclear cells transfected with messenger RNA stimulate antigen- specific cytotoxic T-lymphocytes in vitro. Cell Mol Life Sci. Aug. 2005;62(15):1755-62.
Thess et al., Sequence-engineered mRNA Without Chemical Nucleoside Modifications Enables an Effective Protein Therapy in Large Animals. Mol Ther. Sep. 2015;23(9):1456-64. doi: 10.1038/mt.2015.103. Epub Jun. 8, 2015.
Thompson, M. et al., Nucleolar clustering of dispersed tRNA genes. Science. Nov. 21, 2003;302(5649):1399-401.
Thomson a. James., et al. Isolation of a primate embryonic stem cell line. vol. 92, pp. 7844-7848, Aug. 1995. Proc. Natl. Acad. Sci. USA.
Thomson, Neil et al, Circulatory, Respiratory and Pulmonary Medicine, Clinical Medicine Insights, 2012, vol. 6, No#, pp. 27-40.
Thurner, B. et al., Vaccination with mage-3A1 peptide-pulsed mature, monocyte-derived dendritic cells expands specific cytotoxic T cells and induces regression of some metastases in advanced stage IV melanoma. J Exp Med. Dec. 6, 1999;190(11):1669-78.
Toffolii, Giuseppe et al., Overexpression of Folate Binding Protein in Ovarian Cancers, 1997, Int. J. Cancer (Pred. Oncol.):vol. 74, pp. 193-198.
Torchilin, Vladimir et al., Multifunctional and Stimuli-Sensitive Pharmaceutical Nanocarriers, Eur J. Pharm Biopharm, 2009, vol. 71, No. 3, pp. 431-444.
Touriol, C. et al., Generation of Protein Isoform Diversity by Alternative Initiation of Translation Al Non-Aug Codons, Biology of the Cell, 2003, vol. 95, no number, pp. 168-178.

(56) References Cited

OTHER PUBLICATIONS

Tourriere, H. et al., mRNA degradation machines in eukaryotic cells. Biochimie. Aug. 2002;84(8):821-37.
Towle, H.C. et al., Purification and characterization of bacteriophage gh-l-induced deoxyribonucleic acid-dependent ribonucleic acid polymerase from Pseudomonas pulida. J Biol Chem. Mar. 10, 1975;250(5):1723-33.
Tracy, M., "Progress in the Development of LNP Delivery for siRNA Advancing LNPs to the Clinic," International Liposome Research Days Meeting, Vancouver, Canada. Aug. 2010, pp. 1-52.
Treat, J. et al., in Liposomes in the Therapy of Infectious Disease and Cancer, Lopez-Berestein and Fidler (eds.), Liss, New York, 1989. 353-65.
Trinchieri, G. et al., Cooperation of Toll-like receptor signals in innate immune defense. Nat Rev Immunol. Mar. 2007;7(3):179-90.
Tripathy, Sandeep et al., Long-term expression of erythropoietin in the systemic circulation of mice after intramuscular injection of a plasmid Dna vector, Proc. Natl. Acad. Sci. USA 93, 1996, pp. 10876-10880.
Trojan, A. et al., Immune reactivity against a novel HLA-A3-restricled influenza virus peptide identified by predictive algorithms and interferon-gamma quantitative PCR. J Immunother. Jan.-Feb. 2003;26(1):41-6.
Trollet et al., Delivery of DNA into muscle for treating systemic diseases: advantages and challenges. Methods Mol. Biol. 2008., 423: 199-214.
Tsuchiya, M, et al., Isolation and characterization of the cDNA for murine granulocyte colony-stimulating factor. Proc Natl Acad Sci USA. Oct. 1986; 83(20): 7633-7637.
Tung, T.C. et al., Organ formation caused by nucleic acid from different class.—Urodele DNA mediated balancer formation in goldfish. Sci Sin. Jan.-Feb. 1977;20(1):56-8.
Tung, T.C. et al., The effect of carp Egg-mRNA on the transformation of goldfish tail. Sci Sin. Jan.-Feb. 1977;20 (1):59-63.
Tung, T.C. et al., Transmission of the nucleic acid-induced character, caudal fin, to the offspring in goldfish. Sci Sin. Mar.-Apr. 1975;18(2):223-31.
Tuting, T. et al., Gene-based strategies for the immunotherapy of cancer. J Mol Med (Berl). Jul. 1997;75(7):478-91.
Tycowski, K.T. et al., a small nucleolar RNA requirement for site-specific ribose methylation of rRNA in Xenopus. Proc Natl Acad Sci USA. Dec. 10, 1996;93(25):144805.
Udenfriend, S., et al., The enzymatic conversion of phenylalanine to tyrosine. J. Biol. Chem. 1952; 194: 503-511.
Ueda, T. et al., Phosphorothioate-containing RNAs show mRNA activity in the prokaryotic translation systems in vitro. Nucleic Acids Res. Feb. 11, 1991;19(3):547-52.
Ulmer, J.B. et al., Heterologous protection against influenza by injection of DNA encoding a viral protein. Science. Mar. 19, 1993;259(5102):1745-9.
Ulmer, J.B., An update on the state of the art of DNA vaccines. Curr Opin Drug Discov Devel. Mar. 2001;4(2):192-7.
Utikal, J., et al., Immortalization eliminates a roadblock during cellular reprogramming into IPS cells. Nature. Aug. 2009; 460: 1145-1148.
Uzgun, S., et al., PEGylation improves nanoparticle formation and transfection efficiency of messenger RNA. Pharm Res. Sep. 2011; 28(9); 2223-2232.
Uzri, D., et al., Nucleotide sequences and modifications that determine RIG-I/RNA binding and signaling activities. J. Virol. May 2009; 83 (9): 4174-4184.
Vaheri, A. and Pagano, J.S. Infectious poliovirus RNA: a sensitive method of assay. Virology. Nov. 1965; 27(3): 434-436.
Valcarcel, J. et al., The protein Sex-lethal antagonizes the splicing factor U2AF to regulate alternative splicing of transformer pre-mRNA. Nature. Mar. 11, 1993;362(6416):171-5.
Valencia, P. et al. Microfluidic Platform for Combinatorial Synthesis and Optimization of Targeted Nanoparticles for Cancer Therapy, ACA Nano. Dec. 23, 2013; 7(12):10671-80.

van Bezooijen, Rutger L. et al., Sclerostin Is an Osteocyte-expressed Negative Regulator of Bone Formation, But Not a Classical BMP Antagonist, The Journal of Experimental Medicine, 2004, vol. 199, No. 6, pp. 805-814.
van Bezooijen, Rutger Let al., WNT but Not BMP Signaling Is Involved in the Inhibitory Action of Sclerostin on BMP- Stimulated Bone Formation, Journal of Bone and Mineral Research, 2007, vol. 22, No. 1, pp. 1-10.
van Cruijsen, Hester et al., Tissue micro array analysis of ganglioside N-glycolyl GM3 expression and signal transducer and activator of transcription (STA T)-3 activation in relation to dendritic cell infiltration and microvessel density in non-small cell lung cancer, BMC Cancer, 2009, vol. 9, No. 180, pp. 1-9.
Van Gelder, R.N. et al., Amplified RNA synthesized from limited quantities of heterogeneous cDNA. Proc Natl Acad Sci U S A. Mar. 1990;87(5):1663-7.
Van Tendeloo, V.F. et al., Highly efficient gene delivery by mRNA electroporation in human hematopoietic cells: superiority to lipofection and passive pulsing of mRNA and to electroporation of plasmid cDNA for tumor antigen loading of dendritic cells. Blood. Jul 1;98(1):49-56.
Van Tendeloo, V.F., et al., mRNA-based gene transfer as a tool for gene and cell therapy. Curr Opin Mol Therapeutics. 2007; 9(5): 423-431.
Vaquero, C. et al., Transient expression of a tumor-specific single-chain fragment and a chimeric antibody in tobacco leaves. Proc Natl Acad Sci U S A. Sep. 28, 1998;96(20):11128-33.
Varamball Y, S. et al., Genomic loss of microRNA-101 leads to overexpression of histone methyltransferase EZH2 in cancer. Science. Dec. 12, 2008;322(5908):1695-9. Epub Nov. 13, 2008.
Vasquez, Ana et al., Racotumomab: an anti-idiotype vaccine related to N-Glycolyl-containing gangliosides-preclinical and clinical dale, Frontiers in Oncology, 2012, vol. 2, Article 150, pp. 1-6.
Vassilev, V.B. et al., Microparticle-mediated RNA immunization against bovine viral diarrhea virus. Vaccine. Feb. 28, 2001;19(15-16):2012-9.
Veres, G., et al., The molecular basis of the sparse fur mouse mutation. Science. Jul. 1987; 237(4813):415-7.
Verheggen, C. et al., Box CID small nucleolar RNA trafficking involves small nucleolar RNP proteins, nucleolar factors and a novel nuclear domain. EMBO J. Oct. 1, 2001; 20(19):5480-90.
Verheggen, C. et al., Mammalian and yeast U3 snoRNPs are matured in specific and related nuclear compartments. EMOB J. Jun. 3, 2002;21(11):2736-45.
Verma, I.M. et al., Gene therapy: promises, problems and prospects. Nature. Sep. 18, 1997;389(6648):239-42.
Verma, I.M. et al., Gene therapy: twenty-first century medicine. Annu Rev Biochem. 2005;74:711-38.
Verma, Sandeep, el.al. , Functional Tuning of Nucleic Acids by Chemical Modifications: Tailored Oligonucleolides as Drugs, Devices, and Diagnostics, The Japan Chemical Journal Forum and Wiley Periodicals, Inc., 2003, Chem Rec 3, pp. 51-60.
Verma, Sandeep, et.al. Modified Oligonucleotides: Synthesis and Strategy for Users. Biochem. 1998. 67:99-134. 1998 by Annual Reviews.
Vichyanond, Pakit et al., Omalizumab in allergic diseases, a recent review, Asian Pac J Allergy Immunol, 2011, vol. 29, No#, pp. 209-19.
Vierbuchen, T. et al., Direct conversion of fibroblasts to functional neurons by defined factors. Nature. Feb. 25, 2010; 463(7284): 1035-1041.
Vilee, D.B., Ribonucleic acid: control of steroid synthesis in endocrine tissue. Science. Nov. 3, 1967;158(3801 ):652-3.
Villaret, D.B. et al., Identification of genes overexpressed in head and neck squamous cell carcinoma using a combination of complementary DNA subtraction and microarray analysis. Laryngoscope. Mar. 2000; 110(3 PI 1):374-81.
Virovic, L. et al., Novel delivery methods for treatment of viral hepatitis: an update. Expert Opin Drug Deliv. Jul. 2005;2(4):707-17.
Viza, D. et al., Human lymphoblastoid cells in culture replicate immune information carried by xenogeneic RNA. Differentiation. 1978;11 (3):181-4.

(56) References Cited

OTHER PUBLICATIONS

Vlad, George et al., Immunoglobulin-Like Transcript 3-FC Suppresses T-Cell Responses to Allogeneic Human Islet Transplants in hu-NOD/SCID Mice, Diabetes, 2006, vol. 57, No number, pp. 1-9.
Wagner, E. Polymers for siRNA delivery: Inspired by viruses to be targeted, dynamic, and precise. Ace Chem Res. 2012; 45(7): 1005-1013.
Wagner, Henry et al., Admiration Guidelines for Radioimmunotherapy of Non-Hodgkin's Lymphoma with 90Y-Labeled Anti-CD20 Monoclonal Antibody, 90Y Radioimmunotherapy Administration, The Journal of Nuclear Medicine, 2002, vol. 43, No. 2, pp. 267-272.
Wahl, Alan F. et al, The Anti-CD30 Monoclonal Antibody SGN-30 Promotes Growth Arrest and DNA Fragmentation in Vitro and Affects Antitumor Activity in Models of Hodgkin's Disease, Cancer Research, 2002, vol. 62, pp. 3737-3742.
Wahle, E. Poly(A) tail length control is caused by termination of processive synthesis. J Biol Chem. Feb. 10, 1995; 270 (6): 2800-2808.
Walker, Andreas et al., SplitCore: An Exceptionally Versatile Viral NanoParticles for Native Whole Protein Display Regardless of 3D Structure, Scientific Reporters, 2011, vol. 1, No. 5, pp. 1-8.
Walker, T., Isothermal in Vitro Amplification of DNA by a Restriction Enzyme/ DNA Polymerase System, Proc. Natl. Acad. Sci. USA, 1992, vol. 89, No number, pp. 392-396.
Walker, V., Ammonia toxicity and its prevention in inherited defects of the urea cycle, Diabetes, Obesity and Metabolism, 2009, vol. 11, No#, pp. 823-835.
Wallace, Daniel J et al., Efficacy and safety of epratuzumab in patients with moderate/severe active systemic lupus erythematosus: results from EMBLEM, a phase IIb, randomised, double-blind, placebo-controlled, multicentre study, Ann Rheum Dis, 2014;vol. 73, No#, pp. 183-190.
Wallet, Mark A et al., Immunoregulation of Dendritic Cells, Clinical Medicine & Research, 2005, vol. 3, No. 3, pp. 166-175.
Wan et al., Lipid nanoparticle delivery systems for siRNA-based therapeutics. Drug Deily Transl Res. Feb. 2014;4(1):74-83. doi:10.1007/s13346-013-0161-z.
Wang et al., Systemic delivery of modified mRNA encoding herpes simplex virus 1 thymidine kinase for targeted cancer gene therapy. Mol Ther. Feb. 2013;21(2):358-67. doi: 10.1038/mt.2012.250. Epub Dec. 11, 2012.
Wang et al., Endogenous miRNA Sponge lincRNA-RoR Regulates Oct4, Nanog, and Sox2 in Human Embryonic Stem Cell Self-Renewal, Developmental Cell, 2013, vol. 25, No#, pp. 69-80.
Wang, B. et al., Gene inoculation generates immune responses against human immunodeficiency virus type 1. Proc Natl Acad Sci US A. May 1, 1993;90(9):4156-60.
Wang, B. et al., Immunization by direct DNA inoculation induces rejection of tumor cell challenge. Hum Gene Ther. Apr 1995;6(4):407-18.
Wang, B.S. et al., Fractionation of immune RNA capable of transferring tumor-specific cellular cytotoxicity. Cell Immunol. May 1978;37(2):358-68.
Wang, Haichao et al., HMG-1 as a Late Mediator of Endotoxin Lethality in Mice, Science, 1999, vol. 285, No. 284, pp. 248-251.
Wang, S.P. et al., Phylogeny of mRNA capping enzymes. Proc Natl Acad Sci US A. Sep. 2, 1997;94(18):9573-8.
Wang, X.; Re-evaluating the Roles of Proposed Modulators of Mammalian Target of Rapamycin Complex 1 (mTORC1) Signaling. The Journal of Biological Chemistry, Nov. 7, 2008, vol. 283, No. 45, pp. 30482-30492.
Warren, L. et al. Highly efficient reprogramming to pluripotency and directed differentiation of human cells with synthetic modified mRNA. Cell Stem Cell. Nov. 5, 2010;7(5):618-30.
Warren, T.L. et al., Uses of granulocyte-macrophage colony-stimulating factor in vaccine development. Curr Opin Hematol. May 2000;7(3):168-73. Watanabe, Hiroshi, et al., Conformational Stability and Warfarin-Binding Properties of.

Human Serum Albumin Studied by Recombinant Mutants, Biochem. J., 2001, vol. 357, No number, pp. 269-274.
Watanabe, Hisayo et al., Experimental Autoimmune Thyroiditis Induced by Thyroglobulin-Pulsed Dendritic Cells, Autoimmunity, 1999, vol. 31, No. 4, pp. 273-282, abstract only.
Watanabe, T. et al., Induction of wild-type p53 activity in human cancer cells by ribozymes that repair mutant p53 transcripts. Proc Natl Acad Sci US A. Jul. 18, 2000;97(15):8490-4.
Watts et al., Familial hypercholesterolemia: a missed opportunity in preventive medicine, Nature Clinical Practice, Cardiovascular Medicine, Aug. 2007 , vol. 4, No 8, pp. 404-405.
Weber, J. et al., Granulocyte-macrophage-colony-stimulating factor added to a multipeptide vaccine for resected Stage II melanoma. Cancer. Jan. 1, 2003;97(1):186- 200.
Wechsler, Michael E. et al., Novel targeted therapies for eosinophilic disorders, J Allergy Clin Immunol., 2012; vol. 130, No. 3, pp. 563-571.
Wei, et al. Induction of Broadly Neutralizing H1N1 influenza Antibodies by Vaccination, Science vol. 329, (2010) pp. 1060-1064.
Wei, X. et al., Molecular cloning and Mrna expression of two peptidoglycan recognition protein (PGRP genes from mollusk Solen grandis. Fish & Shellfish Immunology 32 (2012) 178-185.
Weide, B. et al., Results of the first phase I/II clinical vaccination trial with direct injection of mRNA. J Immunother. Feb.-Mar. 2008;31(2):180-8.
Weide, B., et al., Direct injection of protamine-protected mRNA: Results of a phase 1/2 vaccination trial in metastatic melanoma patients. J. Of Immunotherapy. Jun. 2009; 32(5): 498-507.
Weilhammer et al., The use of nanolipoprotein particles to enhance the immunostimulatory properties of innate immune agonists against lethal influenza challenge. Biomaterials. Dec. 2013;34(38):10305-18. doi: 10.1016/j.biomaterials.2013.09.038. Epub Sep. 27, 2013.
Weisberger, A.S., Induction of altered globin synthesis in human immature erythrocytes incubated with ribonucleoprotein. Proc Natl Acad Sci USA. Jan. 1962; 48(1): 68-80.
Weiss, S.B. S B et al., Pseudouridine Formation: Evidence for RNA as an Intermediate. Science. Jul. 23, 1965; 149(3682): 429-431.
Weissman, D. et al., Dendritic cells express and use multiple HIV coreceptors. Adv Exp Med Biol. 1997;417:401-6.
Weissman, D. et al., HIV GAG mRNA transfection of dendritic cells (DC) delivers encoded antigen to MHC class I and II molecules, causes DC maturation, and induces a potent human in vitro primary immune response. J Immunol. Oct. 15, 2000;165(8):4710-7.
Wells, Michael J. et al,. Pathophysiology and Clinical Implications of Pulmonary Arterial Enlargement in COPD, International Journal of COPD, 2013, vol. 8, No number, pp. 509-521.
Wels, W., et al., Construction, bacterial expression and characterization of a bifunctional single-chain antibody- phosphatase fusion protein targeted to the human erbb-2 receptor. Biotechnology (NY). Oct. 1992; 10(10): 1128-1132.
Werman, Ariel et al., the precursor form of IL-1_ is an intracrine proinflammatory activator of transcription, PANS, 2004, vol. 101, No. 8, pp. 2434-2439.
West, James, et.al. Cloning and Expression of Two Human Lysophosphatidic Acid Acyltransferase cDNAs That Enhance Cytokine-Induced Signaling Responses in Cells. DNA and Cell Biology vol. 16, Nov. 6, 1997. Mary Ann Liebert, Inc. pp. 691-791.
Westenfeld, Ralf et al., Anti-RAN KL therapy-implications for the bone-vascular-axis in CKD? Denosumab in post- menopausal women with low bone mineral density, Nephrol Dial Transplant, 2006, vol. 21, pp. 2075-2077.
Whiteside, George, the Origins and the future of microfluidics, Nature, vol. 442, Jul. 27, 2006 pp. 368- 373.
Whitington, P. F. et al., Liver transplantation for the treatment of urea cycle disorders, J. Inher. Metab. Dis., 1998, vol. 21(Suppl 1) pp. 112-118.
Wickens, M. et al., A PUF family portrait: 3'UTR regulation as a way of life. Trends Genet. Mar. 2002;18(3):150-7.
Wiehe, J.M. et al., mRNA-mediated gene delivery into human progenitor cells promotes highly efficient protein expression. J Cell Mol Med. May.-Jun. 2007;11(3):521-30.

(56) References Cited

OTHER PUBLICATIONS

Wilcken, Bridget et al., Problems in the management of urea cycle disorders, Molecular Genetics and Metabolism, 2004, vol. 81, No#, S86-S91.
Wilkie, G.S. et al., Regulation of mRNA translation by 5'- and 3'-UTR-binding factors. Trends Biochem Sci. Apr. 2003;28(4):182-8.
Wilkinson, R. et al., Structure of the Fab Fragment of F105, a Broadly Reactive Anti-Human Immunodeficiency Virus (HIV) Antibody that Recognizes the CD4 Binding Site of HIV type 1 gp120, Journal of Virology, 2005, vol. 79, No. 20, pp. 13060-13069.
William Stohl et al., Future prospects in biologic therapy for systemic lupus erythematosus, Nature Reviews, Rheumatology, No vol., pp. 1-16.
Williams' Charlotte A. et al, Apoptotic cells induce dendritic cell-mediated suppression via interferon-c-induced IDO, Immunology, 2007, vol. 124, No#, pp. 89-101.
Wilusz, C.J. et al., Bringing the role of mRNA decay in the control of gene expression into focus. Trends Genet. Oct. 2004;20(10):491-7.
Wilusz, J. et al., A 64 KD nuclear protein binds to RNA segments that include the AAUAAA polyadenylation motif. Cell. Jan. 29, 1988;52(2):221-8.
Wing, Kajsa et al., Regulatory T Cells Exert Checks and Balances on Self Tolerance and Autoimmunity, Nature Immunology, 2010, vol. 11, No. 1, pp. 1-8.
Winkler, David G. et al. Osteocyte control of bone formation via sclerostin, a novel BMP antagonist, The EMBO Journal, 2003, vol. 22 No. 23 pp. 6267-6276.
Winkler, David G. et al., Noggin and Sclerostin Bone Morphogenetic Protein Antagonists Form a Mutually Inhibitory Complex, J. Biol. Chem., 2004, vol. 279, pp. 36293-36298.
Winnicka, B, et al., CD13 is dispensable for normal hematopoiesis and myeloid cell functions in the mouse. J Leukoc Biol. Aug. 2010; 88(2): 347-359. Epub Apr. 29, 2010.
Woltjen, K. et al., piggyBac transposition reprograms fibroblasts to induced pluripotent stem cells. Nature. Apr. 2009(458): 10.1038-07863.
Wong et al., An mRNA vaccine for influenza. Nat Biotechnol. Dec. 2012;30(12):1202-4. doi: 10.1038/nbt.2439.
Woodberry, T. et al., Immunogenicity of a human immunodeficiency virus (HIV) polytope vaccine containing multiple HLA A2 HIV CDS(+) cytotoxic T-cell epitopes. J Viral. Jul. 1999;73(7):5320-5.
World Health Organization, Department of Communicable Disease Surveillance and Response, WHO/CSR, 2006, Chapter, pp. 1-7.
World Health Organization, Serological Diagnosis of Influenza by Microneutralization Assay, 2010, No vol., pp. 1-25.
World Health Organization, Who Manual on Animal Influenza Diagnosis and Surveillance, WHO Global Influenza Programme, CDS, CSR, NCS, 2002, vol. 5, No Number, pp. 1-99.
\Nu! J.et al., Mammalian pre-mRNA branch site selection by U2 snRNP involves base pairing. Genes Dev. Oct. 1989;3 (10):1553-61.
Wu, L. et al., Fusion protein vectors to increase protein production and evaluate the immunogenicity of genetic vaccines. Mol Ther. Sep. 2000;2(3):288-97.
WU, X.C. et al., Engineering a Bacillus subtilis expression-secretion system with a strain deficient in six extracellular proteases. J Bacterial. Aug. 1991;173(16):4952-8.
Wurm, F. et al., Suppression of melanoma development and regression of melanoma in xiphophorine fish after treatment with immune RBA Cancer Res. Sep. 1981;41 (9 PI 1):3377-83.
Wyatt, J.R. et al., Site-specific cross-linking of mammalian U5 snRNP to the 5' splice site before the first step of pre- mRNA splicing. Genes Dev. Dec. 1992;6(12B):2542-53.
Xiang, Bo et al., Colorectal Cancer Immunotherapy, Discovery Medicine, 2013, No vol., pp. 1-8.
Xu, C. C et al., Feeder-free growth of undifferentiated human embryonic stem cells. Nat . Biotechnol. Oct. 2001;19 (10):971-4.
Xu, J. J et al., Identification of differentially expressed genes in human prostate cancer using subtraction and microarray. Cancer Res. Mar. 15, 2000;60(6)1 677-82.
Yamamoto et al., Current prospects for mRNA gene delivery, European Journal of Pharmaceutics and Biopharmaceutics 71 (2009) 484-489.
Yamashita, a. et al., Concerted action of poly(A) nucleases and decapping enzyme in mammalian mRNA turnover. Nat Struct Mol Biol. Dec. 2005;12(12):1054-63. Epub Nov. 13, 2005.
Yang, Junbao et al., CD+ T cells from Type 1 Diabetic and Healthy Subjects Exhibit Different Thresholds of Activation to a Naturally Processed Proinsulin Epitope, Journal of Autoimmunity, 2008, vol. 31, No vol. number, pp. 30-41.
Yang, Richard K. et al., Anti-GD2 Strategy in the Treatment of Neuroblastoma, Drugs Future, 2010 ; vol. 35, No. 8, pp. 1-15.
Yang, S.F. et al., Albumin synthesis in mouse uterus in response to liver mRNA. Proc Natl Acad Sci U S A. May 1977;74(5):1894-8.
Yang, Xiao-Dong et al., Development of ABX-EGF, A Fully Human anti-EGF Receptor Monoclonal Antibody, for Cancer Therapy, Oncology Hematology, 2001, vol. 38, No. #, pp. 17-23.
Yang, Xiao-Dong et al., Eradication of Established Tumors by a Fully Human Monoclonal Antibody to the Epidermal Growth Factor Receptor without Concomitant chemotherapy, Cancer Research, 1999, vol. 59, No. #, pp. 1236-1243.
Yang, Xiaoming, et al., Effect of CD44 Binding Peptide Conjugated to an Engineered Inert Matrix on Maintenance of Breast Cancer Stem Cells and Tumorsphere Formation, PLOS One, 2013, vol. 8, Issue 3, pp. 1-15.
Yarovoi, Helen et al., Factor VIII ectopically expressed in platelets: efficacy in hemophilia a treatment, Blood Journal, Dec. 1, 2003, vol. 102 No. 12, pp. 4005-4013.
Ye, X., et al., Prolonged metabolic correction in adult ornithine transcarbamylase- deficient mice with adenoviral vectors. Biological Chem. Feb. 1996; 271(7): 3639-3646.
Yi, P. et al., Betatrophin: A hormone that controls pancreatic beta cell proliferation. Cell. May 9, 2013; 153: 1-12.
Yi, Y., et al., Current advances in retroviral gene therapy. Current Gene Ther. 2011; 11: 218-228.
Ying, H. et al., Cancer therapy using a self-replicating Rna vaccine. Nat Med. Jul 1999;5(7):823-7.
Yisraeli, J.K. et al., [4] Synthesis of long, capped transcripts in vitro by SP6 and T7 RNA Polymerases. Methods in Enzymology, vol. 180. 1989; 180, 42-50.
Yokoe, H. et al., Spatial dynamics of GFP-tagged proteins investigated by local fluorescence enhancement. Nat Biotechnol. Oct. 1996;14(10):1252-6.
Yoshida, Y. et al., Hypoxia enhances the generation of induced pluripotent stem cells. Cell Stem Cells 5. Sep. 2009; 5: 237-241.
You, Z. et al., A retrogen strategy for presentation of an intracellular tumor antigen as an exogenous antigen by dendritic cells induces potent antitumor T helper and CTL responses. Cancer Res. Jan. 1, 2001;61(1):197-205.
Yu, Alice et al, Anti-GD2 Antibody with GM-CSF, Interleukin-2, and Isotretinoin for Neuroblastoma, The New England Journal of Medicine, 2010, vol. 363; No. 14, pp. 1324-1334.
Yu, Alice et al., Phase I Truak of a Human-Mouse Chimeric Ant-Disialoganglioside Monoclonal Antibody ch14.18 in Patients with Refractory Neuroblastoma, and Osteosarcoma, Journal of Clinical Oncology 1998, vol. 16, No. 6, pp. 2169-2180.
Yu J. et al Human induced pluripotent stem cells free of vector and transgene sequences. Science. May 8, 2009; 324 (5928): 797-801.
Yu, J. et al., Induced pluripotent stem cell lines derived from human somatic cells. Science. Dec. 21, 2007; 318(5858): 1917-1920.
Yu J. et al., Structural and functional analysis of an mRNP complex that mediates the high stability of human beta-globin mRNA. Mol Cell Biol. Sep. 2001;21(17):5879-88.
Yu, P.W. et al., Sustained correction of B-cell development and function in a murine model of X-linked agammaglobulinemia (XLA) using retroviral-mediated gene transfer. Blood. Sep. 1, 2004;104(5):1281-90. Epub May 13, 2004.
Yu, Y.T. et al., Internal modification of U2 small nuclear (sn)RNA occurs in nucleoli of Xenopus oocytes. J Cell Biol. Mar. 19, 2001;152(6):1279-88.

(56) References Cited

OTHER PUBLICATIONS

YU, Y.T. et al., Modifications of U2 snRNA are required for snRNP assembly and pre-mRNA splicing. EMBO J. Oct. 1, 1998;17(19):5783-95.

Zangi, L. et al., Modified mRNA directs the fate of heart progenitor cells and indices vascular regeneration after myocardial infarction, Nature Biology, Advanced Online Publication, May 10, 2013, pp. 1-9.

Zebarjadian, Y. et al., Point mutations in yeast CBF5 can abolish in vivo pseudouridylation of rRNA. Mol Cell Biol. Nov. 1999;19(11):7461-72.

Zeitlin, S. et al., In vivo splicing products of the rabbit beta-globin pre-mRNA. Cell. Dec. 1984;39(3 Pt 2):589-602.

Zelcer, A. et al., the detection and characterization of viral-related double-stranded RNAs in tobacco mosaic virus-infected plants. Virology. Sep. 1984;113(2):417-27.

Zeytin, H.E. et al., Construction and characterization of DNA vaccines encoding the single-chain variable fragment of the anti-idiotype antibody 1A7 mimicking the tumor-associated antigen disialoganglioside GD2. Cancer Gene Ther. Nov. 2000;7(11):1426-36.

Zhang, Li et al, Both K63 and K48 ubiquitin linkages signal lysosomal degradation of the LDL receptor, Journal of Lipid Research, 2013, vol. 54, No#, pp. 1410-1420.

Zhang, Bodi et al., Ofatumumab, mAbs, 2009, vol. 1, No. 4, pp. 326-331.

Zhang, X. et al., Advances in dendritic cell-based vaccine of cancer. Cancer Biother Radiopharm. Dec. 2002;17 (6):601-19.

Zhang, Y., et al., In vivo gene delivery by nonviral vectors: overcoming hurdles? Mol. Therapy. Jul. 2012; 20(7): 1298-1304.

Zhao, X. et al., Pseudouridines in and near the branch site recognition region of U2 snRNA are required for snRNP biogenesis and pre-mRNA splicing in Xenopus oocytes. RNA. Apr. 2004;10(4):681-90.

Zhao, Xiansi et al., Regulation of Nuclear Receptor Activity by a Pseudouridine Synthase through Posttranscriptional Modification of Steroid Receptor RNA Activator, Molecular Cell, 2004, vol. 15, No. 4, pp. 549-558.

Zhao, Xinliang, Detection and quantitation of RNA base modifications, RNA, 2004, vol. 10:, pp. 996-1002.

Zheng, Yue et al. Intracellular Interleukin-1 Receptor 2 Binding Prevents Cleavage and Activity of Interleukin-1a, Controlling Necrosis-Induced Sterile Inflammation, Immunity, 2013, vol. 38, No#, pp. 285-295.

Zhigaltsev, I.V., et al., Bottom-Up design and synthesis of limit size lipid nanoparticle systems with aqueous and triglyceride cores using millisecond microfluidic mixing. Langmuir. Feb. 21, 2012; 28(7): 3633-3640.

Zhou, H., et al., Generation of induced pluripotent stem cells using recombinant proteins. Cell Stem Cell. May 4, 2009 (5)381-4.

Zhou, J., et al., Short Communication Bilirubin Glucuronidation Revisited: Proper assay conditions to estimate enzyme kinetics with recombinant UGT1A1. Drug metabolism and Disp. 2010; 38(11): 1907-1911.

Zhou, W.Z. et al., RNA melanoma vaccine: induction of antitumor immunity by human glycoprotein 100 mRNA immunization. Hum Gene Ther. Nov. 1, 1999;10(16):2719-24.

Zhu B., Syn5 RNA Polymerase Synthesizes Precise Run-Off RNA Products, Nucleic Acids Research, 2013, vol. 103, No#, pp. 1-10.

Zhu, Min et al., Population Pharmacokinetics of Rilotumumab, a Fully Human Monoclonal Antibody Against Hepatocyte Growth Factor, in Cancer Patients, Journal of Pharmaceutical Sciences, 2014, vol. 328 No#, pp. 328-336.

Zhu, Z et al, Inhibition of human leukemia in an animal model with human antibodies directed against vascular endothelial growth factor receptor 2. Correlation between antibody affinity and biological activity, Leukemia, (2003)vol. 17, pp. 604-611.

Zhu, Zhenping et al., Inhibition of Vascular Endothelial Growth Factor-induced Receptor Activation with Anti-Kinase Insert Domain-containing Receptor Single-Chain Antibodies from a Phage Display Library, Cancer Research, 1998, vol. 58, No# pp. 3209-3214.

Zhuang, Y. et al., A compensatory base change in human U2 snRNA can suppress a branch site mutation. Genes Dev. Oct. 1989;3(10):1545-52.

Zia-Amirhosseini, P. et al., Pharmacokinetics and Pharmacodynamics of SB-240563, A Humanized Monoclonal Antibody Directed to Human Interleukin-5, in Monkeys, the Journal of Pharmacology and Experimental Therapeutics, 1999, vol. 291, No. 3, pp. 1060-1067.

Ziegler et al., AAV2 Vector Harboring a Liver-Restricted Promoter Facilitates Sustained Expression of Therapeutic Levels of a-Galactosidase A and the Induction of Immune Tolerance in Fabry Mice, Molecular Therapy, 2004, vol. 9, No. 2, pp. 231-240.

Zimmermann, E. et al., Electrolyte- and pH-stabilities of aqueous solid lipid nanoparticle (SLN™) dispersions in artificial gastrointestinal media. Eur J Pharm Biopharm. Sep. 2001;52(2):203-10.

Zitvogel, L. et al., Therapy of murine tumors with tumor peptide-pulsed dendritic cells: dependence on T cells, B7 costimulation, and T helper cell 1-associated cytokines. J Exp Med. Jan. 1, 1996;183(1):87-97.

Zorha, F.T., et al., Drastic effect of nanoapatite particles on liposome-mediated mRNA Zohra, delivery to mammalian cells. Analytical Biochem. Oct. 2005; 345(1): 164-166.

Zohra, F.T., et al., Effective delivery with enhanced translational activity synergistically accelerates mRNA-based transfection. Biochem Biophys Res Comm. Jun. 2007; 358(1): 373-378.

Zonta, S. et al., Uretero-neocystostomy in a swine model of kidney transplantation: A new technique. J Surg Res. Apr. 2005;124(2):250-5.

Zorio, DA et al., Both subunits of U2AF recognize the 3' splice site in Caenorhabditis elegans. Nature. Dec 16, 1999;402(6763):835-8.

Zou, Li-li et al., Cell-Penetrating Peptide-Mediated Therapeutic Molecule Delivery Into the Central Nervous System, Current Neuropharmacology, 2013, vol. 11, No. 2, pp. 197-208.

Zwick, M. et al., Identification and Characterization of a Peptide That Specifically Binds the Human, Broadly Neutralizing Anti-Human Immunodeficiency Virus Type 1 Antibody b12, Journal of Virology, Jul. 2001, vol. 75, No. 14, pp. 6692-6699.

Zwick, M. et al., Molecular Features of the Broadly Neutralizing Immunoglobulin G1, b12 Required for Recognition of Human Immunodeficiency Virus Type 1 gp120, Journal of Virology, 2003, vol. 77, No. 10, pp. 5863-5876.

Abdelwahed et al., "Freeze-drying of nanoparticles: Formulation, process and storage considerations," Advanced Drug Delivery Reviews 58 (2006) 1688-1713.

Andreakos et al., Amphoteric liposomes enable systemic antigen-presenting cell-directed delivery of CD40 antisense and are therapeutically effective in experimental arthritis. Arthritis Rheum. Apr. 2009;60(4):994-1005. doi: 10.1002/art.24434.

Bathgate et al., Relaxin family peptides and their receptors. Physiol Rev. Jan. 2013;93(1):405-80. doi: 10.1152/physrev.00001.2012.

Bogers et al., Potent immune responses in rhesus macaques induced by nonviral delivery of a self-amplifying RNA vaccine expressing HIV type 1 envelope with a cationic nanoemulsion.J Infect Dis. Mar. 15, 2015;211(6):947-55. doi: 10.1093/infdis/jiu522. Epub Sep. 18, 2014.

Corazzelli et al., Biweekly rituximab, cyclophosphamide, vincristine, non-pegylated liposome-encapsulated doxorubicin and prednisone (R-COMP-14) in elderly patients with poor-risk diffuse large B-cell lymphoma and moderate to high 'life threat' impact cardiopathy. Br J Haematol. Sep. 2011;154(5):579-89. doi: 10.1111/j.1365-2141.2011.08786.x. Epub Jun. 28, 2011.

Fleeton et al., Self-replicative RNA vaccines elicit protection against influenza a virus, respiratory syncytial virus, and a tickborne encephalitis virus. J Infect Dis. May. 1, 2001;183(9):1395-8. Epub Mar. 30, 2001.

Geall et al., Nonviral delivery of self-amplifying RNA vaccines. Proc Natl Acad Sci U S A. Sep. 4, 2012;109(36):14604-9. doi:10.1073/pnas.1209367109.

Hashimoto et al., Relationship between the concentration of anti-polyethylene glycol (PEG) immunoglobulin M (IgM) and the

(56) References Cited

OTHER PUBLICATIONS intensity of the accelerated blood clearance (ABC) phenomenon against PEGylated liposomes in mice. Biol Pharm Bull. 2015;38(3):417-24. doi: 10.1248/bpb.b14-00653.
Jayaraman et al., "Maximizing the Potency of siRNA Lipid Nanoparticles for Hepatic Gene Silencing in Vivo," Angew. Chem. Int. Ed. 2012, 51, 8529-8533.
Kallen et al., A development that may evolve into a revolution in medicine: mRNA as the basis for novel, nucleotide-based vaccines and drugs. Ther Adv Vaccines. Jan. 2014;2(1):10-31. doi: 10.1177/2051013613508729.
Kauffman et al., Efficacy and immunogenicity of unmodified and pseudouridine-modified mRNA delivered systemically with lipid nanoparticles in vivo. Biomaterials. Dec. 2016;109:78-87. doi: 10.1016/j.biomaterials.2016.09.006. Epub Sep. 25, 2016.
Kisich et al., Antimycobacterial agent based on mRNA encoding human beta-defensin 2 enables primary macrophages to restrict growth of Mycobacterium tuberculosis.Infect Immun. Apr. 2001;69(4):2692-9.
Leung et al., "Lipid Nanoparticles for Short Interfering RNA Delivery", Advances in Genetics, vol. 88, Chapter 4, pp. 71-110.
MacLachlan, Lipid Nanoparticle-mediated delivery of messenger RNA. Presentation. 1st International mRNA Health Conference. Tubingen, Germany. Oct. 24, 2013. http://files.shareholder.com/downloads/ABEA-50QJTB/2628241206x0x699789/47543d12-db34-4e6e-88a9-f3ae5d97b1d2/MacLachlan_mRNA_Conf 2013.pdf. Last accessed Dec. 22, 2016.
Madden et al., Systemic delivery of mRNA therapeutics using lipid nanoparticles (LNP): improved potency for novel LNP and influence of route of administration on protein expression. 2nd International mRNA Health Conference. Nov. 12, 2014. https://acuitastx.com/wp-content/uploads/2015/01/Poster-Second-International-mRNA-Health-Conference.pdf. 1 page.
Marina et al., Dose escalation and pharmacokinetics of pegylated liposomal doxorubicin (Doxil) in children with solid tumors: a pediatric oncology group study. Clin Cancer Res. Feb. 2002;8(2):413-8.
Müller et al, "Solid lipid nanoparticles (SLN) for controlled drug delivery—a review of the state of the art," European Journal of Pharmaceutics and Biopharmaceutics, 50 (2000) 161-177.
Oja et al., Doxorubicin entrapped within liposome-associated antigens results in a selective inhibition of the antibody response to the linked antigen. Biochim Biophys Acta. Sep. 29, 2000;1468(1-2):31-40.
Parisien et al., Rationalization and prediction of selective decoding of pseudouridine-modified nonsense and sense codons. RNA. Mar. 2012;18(3):355-67. doi: 10.1261/rna.031351.111. Epub Jan. 26, 2012.
Porteous et al., Evidence for safety and efficacy of DOTAP cationic liposome mediated CFTR gene transfer to the nasal epithelium of patients with cystic fibrosis. Gene Ther. Mar. 1997;4(3):210-8.
Ranganathan et al., the lipoprotein lipase (LPL) S447X gain of function variant involves increased mRNA translation. Atherosclerosis. Mar. 2012;221(1):143-7. doi: 10.1016/j.atherosclerosis. Dec. 28, 2011. Epub Dec. 27, 2011.
Ranganathan et al., Tissue-specific expression of human lipoprotein lipase. Effect of the 3'-untranslated region on translation. J Biol Chem. Mar. 31, 1995;270(13):7149-55.
Shah et al., "Lipid Nanoparticles: Production, Characterization and Stability," Springer International Publishing, 2014, 23 pages.
Taguchi et al., Effect of Repeated Injections of Adenosine Diphosphate-Encapsulated Liposomes Coated with a Fibrinogen γ-Chain Dodecapeptide Developed as a Synthetic Platelet Substitute on Accelerated Blood Clearance in a Healthy and an Anticancer Drug-Induced Thrombocytopenia Rat Model. J Pharm Sci. Sep. 2015;104(9):3084-91. doi: 10.1002/jps.24418. Epub Mar. 9, 2015.
Taguchi et al., Hemoglobin vesicles, polyethylene glycol (PEG)ylated liposomes developed as a red blood cell substitute, do not induce the accelerated blood clearance phenomenon in mice. Drug Metab Dispos. Nov. 2009;37(11):2197-203. doi: 10.1124/dmd.109.028852. Epub Aug. 13, 2009.
Tam et al., "Advances in Lipid Nanoparticles for siRNA Delivery," Pharmaceutics 2013, 5, 498-507; doi:10.3390/pharmaceutics5030498.
Cystic Fibrosis Transmembrane Conductance Regulator; cystic fibrosis transmembrane conductance regulator [Homo sapiens]; NCBI, 2010, No vol., pp. 1-5.
Glucosylceramidase, glucosylceramidase isoform 1 precursor [Homo sapiens]; NCBI, 2010, No vol., pp. 1-4.
Alpha Galactosidase A; alpha-galactosidase a precursor [Homo Sapiens] NCBI, 2010, pp. 1-4.
By hAQP5 (Homo sapiens aquaporin 5 (AQPS) mRNA); NCBI, pp. 1-5, published Dec. 27, 2010, No. vol. number available, http://www.ncbi.nlm.nih/gov/nuccore/186910293.
Carboxypeptidase N, Carboxypeptidase N caralytic Chanin precursor [Homo sapiens] NCBI, 2010, pp. 1-4.
Abciximab (ReoPro) FDA Description, Jan. 4, 1997, no vol. number, pp. 1-17.
Adcetris, brentuximab vedotin, Product Label, 2011, No Volume, pp. 1-15.
Adis R&D Profile, Belimumab, Drugs R D, 2010; vol. 10 , No. 1, pp. 55-65.
Aduri, R., et al., AMBER force field parameters for the naturally occurring modified nucleosides in RNA. J Chem Theory Comput. 2007; 3: 1464-1475.
Aksenova, N.N. et al., Influence of ribonucleic acids from the liver on implantation and growth of transplantable tumors. Nature. Nov. 3, 1962;196:443-4.
Alexandrakis, Michael et al., Relationship Between Circulating Baff Serum Levels with Proliferating Markers in Patients with Multiple Myeloma, Biomed Research International, 2013, vol. 2013, Article ID. 389579, pp. 1-7.
Alprolix, Highlights of Prescribing Information, Full Prescribing Information, Biogen Idec, 2013, No Vol, pp. 1-19.
Avastin, Bevacizumab, Labeling Text, 2013, no. Volume, pp. 1-27.
Avid Radiopharmaceuticals, Dominantly Inherited Alzheimer Network Trial: An Opportunity to Prevent Dementia. A Study of Potential Disease Modifying Treatments in Individuals at Risk for or With a Type of Early Onset Alzheimer's Disease Caused by a Genetic Mutation. (DIAN-TU), ClinicalTrials.gov, Apr. 2, 2014, http://clinicaltrials.govict2/show/NCT01760005, pp. 1-5.
Bertrand, E. et al., Assembly and traffic of small nuclear RNPs. Prog Mol Subcell Biol. 2004;35:79-97.
Bertrand, Edouard et al., The snoRNPs and Related Machines: Ancient Devices That Mediate Maturation of rRNA and Other RNAs, 2004, Chapter 13, pp. 223-257.
Bhatiacharya, B.K. et al., A practical synthesis of N1-Methyl-2'-deoxy-ψ-uridine (ψ-Thymidine) and its incorporation into G-rich triple helix forming oligonucleotides Nucleosides & Nucleotides. 1995; 14(6): 1269-1287.
Bococizumab, Statement on a Nonproprietary Name Adopted by the Usan Council, 2013, No vol. pp. 1-2.
Borghaei, Hossein et al., Phase I Dose Escalation, Pharmacokinetic and Pharmacodynamic Study of Naptumomab Estafenatox Alone in Patients With Advanced Cancer and With Docetaxel in Patients With Advanced Non-Small-Cell Lung Cancer, Journal of Clinical Oncology, 2009, vol. 27, No. 25, pp. 4116-4123.
Canakinumab FDA Label, 2009, No Volume# pp. 1-11.
Carnahan, Josette et al., Epratuzumab, a Humanized Monoclonal Antibody Targeting CD22 Characterization of in Vitro Properties, Clinical Cancer Research, 2009, vol. 9, No.#, pp. 1-8.
Chowdhury, Jayanta R. et al., Molecular Basis for the Lack of Bilirubin-specific and 3-Methylcholanthrene-inducibleUDP-GlucuronosyltransferaseActivities in Gunn Rats, The Journal of Biological Chemistry, 1991, vol. 266, No. 27, pp. 18294-18298.
CIMZIA, Product Label, Reference ID: 3217327, UCB, Inc., 2008, No. Vol#, pp. 1-26.
Colter, J.S., et al., Infectivity of ribonucleic acid from Ehrlich Ascites tumour cells infected with Mengo Encephalitis. Nature. Apr. 1957; 179(4565): 859-860.

(56) References Cited

OTHER PUBLICATIONS

Cang, Shundong et al., Novel CD20 Monoclonal Antibodies for Lymphoma Therapy, Journal of Hematology & Oncology, 2012, vol. 5, No. 64, pp. 1-9.
Conry, R.M. et al., A carcinoembryonic antigen polynucleotide vaccine has in vivo antitumor activity. Gene Ther. Jan. 1995;2(1):59-65.
Crigler, John et al. Society Transactions, Society for Pediatric Research, 31st Annual Meeting, Atlantic City, Congenital Familial Nonhemolytic Jaundice with Kernicterus: A New Clinical Entity, 1951, 3rd session, No vol. pp. 1-3, (258-260).
Croft, Michael et al., TNF superfamily in inflammatory disease: translating basic insights, Trends Immunol, 2012; vol. 33, No. 3, pp. 144-152.
Cu, Y. et al., Enhanced Delivery and Potency of Self-Amplifying mRNA Vaccines by Electroporation in Situ, Vaccines, 2013, 1, 367-383. Abstract Only.
David McAuley, Pharm. D., Alzheimer's Disease—Therapeutic agents, 2012, No vol.#, pp. 1-3.
Davis, H.L. et al., DNA-based immunization induces continuous secretion of hepatitis B surface antigen and high levels of circulating antibody. Hum Mol Genet. Nov. 1993;2(11 ):1847-51.
Deshayes, S. et al., Cell-penetrating peptides: tools for intracellular delivery of therapeutics. Cell Mol Life Sci. Aug. 2005;62(16):1839-49.
Doody, Rachelle S. et al., Phase 3 Trials of Solanezumab for Mild-lo-Moderate Alzheimer's Disease, NEJM Journal Watch, Apr. 2, 2014, no. vol. No#, http://www.nejm.org/doi/full/10.1056/NEJMoa1312889, pp. 1-2. Abstract only.
Eli Lilly and Company, A Study in Second Line Metastatic Colorectal Cancer, ClinicalTrials.gov, Apr. 2, 2014, http://clinicaltrials.gov/ct2/show/NCT01183780?term=ramucirumab&rank=20&submit_fld opt., 10 pages.
Eli Lilly and Company, A Study of Chemotherapy and Ramucirumab vs. Chemotherapy Alone in Second Line Non-small Cell Lung Cancer Participants Who Received Prior First Line Platinum Based Chemotherapy, ClinicalTrials.gov, Apr. 2, 2014, http://clinicaltrials.govict2/show/NCT01168973?term=ramucirumab&rank=2&submit_ftd_ opt, 11 pages.
Eli Lilly and Company, A Study of Paclitaxel With or Without Ramucirumab in Metastatic Gastric Adenocarcinoma, ClinicalTrials.gov, Apr. 2, 2014, http://clinicaltrials.gov/ct2/show/NCT01170663?term=ramucirumab&rank=5&submit_fld_ opt, pp. 1-4.
Eli Lilly and Company, A Study of Ramucirumab (IMC-1121 B) Drug Product (DP) and Best Supportive Care (BSC) Versus Placebo and BSC as 2nd-Line Treatment in Patients With Hepatocellular Carcinoma After 1st-Line Therapy With Sorafenib (REACH), ClinicalTrials.gov, Apr. 2, 2014, http://clinicaltrials.gov/ct2/show/NCT01140347?term=ramucirumab&rank=12&submit_fld _opt, pp. 1-4.
Eli Lilly and Company, Clinical Trial of Solanezumab for Older Individuals Who May be at Risk for Memory Loss (A4), ClinicalTrials.gov, Apr. 2, 2014, http://clinicaltrials.gov/ct2/show/NCT02008357, pp. 1-3.
Eli Lilly and Company, Progress of Mild Alzheimer's Disease in Participants on Solanezumab Versus Placebo (EXPEDITION 3), ClinicalTrials.gov, Apr. 2, 2014, http://clinicaltrials.govict2/show/NCT01900665, pp. 1-3.
Eli Lilly and Company, ReoPRo, Abciximab, Product Label, 2005, No volume number, pp. 1-4.
EMEA, Committee for Medicinal Products for Human Use, European Medicines Agency, 2008, no. vol. pp. 1-13.
EP11830061, Supplementary Search Report, Mar. 18, 2014.
European Public Assessment Report (EPAR), Removab, European Medicines Agency, 2009, no. vol.# pp. 1-2.
European Supplementary Search Report, EP11815407, Jun. 13, 2014, pp. 1-13.
FDA Guide, Herceptin (Irastuzumab), Highlights of Prescribing Information, 2010, Genentech, Inc., pp. 1-33.
FDA Guide, Tysabri, Elan Pharmaceuticals, Inc., Reference ID: 3308057, Biogen Idec, Inc. 2013, No Volume#, pp. 1-21.
FDA Label- SYNAGIS® (PALIVIXUMAB)-1999, MedImmune, Inc., No. vol. pp. 1-7.
FDA Label- Vectibix® (panitumumab), Amgen Inc., 2006-2008, No vol., pp. 1-13.
FDA Label, Actemra (tocilizumab), Risk Evaluation and Mitigation Strategy (REMS) 2013, Genentech, Inc., Reference ID: 3394610, no. vol.#, pp. 1-53.
FDA Label, Arzerra, Prescribing Info, 2009, GlaxoSmithKline, No. Vol, pp. 1-13.
FDA Label, Bexxar, Tositumomab and Iodine 1131 Tositumomab 2003, Corixa Corp. and GlaxoSmithKline, No. vol #, pp. 1-49.
FDA Label, Ibritumomab Tiuxetan, Zevalin, 2001, IDEC Pharmaceuticals Corporation, No vol. pp. 1-38.
FDA Label, Rituxan, Rituximab, IDEC Pharmaceuticals Corporation and Genentech, Inc., No Vol. #, pp. 1-2.
FDA Label- Rituxan (rituximab), Biogen Idec Inc. and Genentech Inc., Revised 2012, No Vol, pp. 1-40.
FDA, Highlights of Prescribing Information LUCENTIS(ranibizumab injection), Genentech, Inc., 2006, No vol., pp. 1-9.
FDA, Medication Guide Xolair, (omalizumab), 2013, No vol. pp. 1-2.
Feng, R. et al., PU.1 and C/EBPα/βconvert fibroblasts into macrophage-like cells. Proc Natl Acad Sci USA. Apr. 22, 2008; 105(16): 6057-6062.
Genentech, A Study of the Efficacy and Safety of Ocrelizumab in Patients With Relapsing-Remitting Multiple Sclerosis, ClinicalTrials.gov, Apr. 1, 2014, http://clinicaltrials.gov/c12/show/NCT00676715, pp. 1-3.
Gevokizumab, Statement on a Nonproprietary Name Adopted by the Usan Council, no. year no. vol. Page 1. 2010.
Goldstein, N. et al., Biological Efficacy of a Chimeric Antibody to the Epidermal Growth Factor Receptor in a Human Tumor Xenograft Model, Clinical Cancer Research, 1995, Vol. 1, No number, pp. 1311-1318.
Golimumab-Product Label- Janssen Biotech, Inc., 2013, No volume number, pp. 1-29.
Gomes, Anita Q. et al., Non-classical major histocompatibility complex proteins as determinants of tumour immunosurveillance, 2007, EMBO reports, vol. 8, No. 11, pp. 1024-1030.
Grosjean, H., DNA and RNA Modification Enzymes Structure, Mechanisms, Functions and Evolution. Molecular Biology Intelligence Unit. Estimated Publication Date: May, 2009. pp. 1-2.
Grosjean, H., et al. How Nucleic Acids Cope with High Temperature. Physiology and Biochemistry of Extremophiles. 2007. Chapter 4, pp. 39-58.
Grosjean, H., Nucleic Acids Are Not Boring Long Polymers of Only Four Types of Nucleotides: A Guided Tour. Chapter 1. Landes Bioscience. 2009. pp. 1-18.
Grudzien, E. et al., Novel cap analogs for in vitro synthesis of mRNAs with high translational efficiency. RNA. Sep. 2004; 10(9): 1479-87.
Grudzien-Nogalska, E. et al., Phosphorothioate cap analogs stabilize mRNA and increase translational efficiency in mammalian cells. RNA. Oct. 2007;13(10):1745-55. Epub Aug. 24, 2007.
Grunwald, Viktor et al., Developing Inhibitors of the Epidermal Growth Factor Receptor for Cancer Treatment, Journal of the National Cancer Institute, 2003, vol. 95, No. 12, pp. 851-867.
Gryaznov, S.M., Oligonucleotide N3'→P5' phosphoramidates as potential therapeutic agents. Biochim Biophys Acta. Dec. 10, 1999;1489(1):131-40.
Gu, Minghao et al., Combinatorial synthesis with high throughput discovery of protein-resistant membrane surfaces, BioMaterials, 2013, vol. 34, No#., pp. 6133-6138.
Hale, G. et al., Removal of T Cells From Bone Marrow for Transplantation: a Monoclonal Antilyphocyte Antibody That Fixes Human Complement, Blood, 1983, vol. 62, No. 4, pp. 873-882.
Higman, Ma et al., The mRNA (guanine-7-)methyltransferase domain of the vaccinia virus mRNA capping enzyme. Expression in *Escherichia coli* and structural and kinetic comparison to the intact capping enzyme. J Biol Chem. May 27, 1994;269(21 ):14974-81.

(56) References Cited

OTHER PUBLICATIONS

Hobbs et al., "Molecular Genetics of the LDL Receptor Gene in Familial Hypercholesterolemia." Human Mutation (1992); 1: 445-466.

Hoffmann-La Roche, A Study of Obinutuzumab (R05072759) in Combination With CHOP Chemotherapy Versus MabThera/Rituxan (Rituximab) With CHOP in Patients With CD2O-Positive Diffuse Large B-Cell Lymphoma (GOYA), ClinicalTrials.gov, Apr. 2, 2014, http://clinicaltrials.gov/ct2/show/NCT01287741?term=Obinutuzumab&rank=13&submit_fld_opt, pp. 1-3.

Hoffmann-La Roche, A Study of Obinutuzumab (R05072759) Plus Chemotherapy in Comparison With MabThera/Rituxan (Rituximab) Plus Chemotherapy Followed by GA101 or MabThera/Rituxan Maintenance in Patients With Untreated Advanced Indolent Non-Hodgkin's Lymphoma (Gallium), ClinicalTrials.gov, Apr. 2, 2014, http://clinicaltrials.gov/ct2/show/NCT01332968, pp. 1-3.

*Iduronate 2-Sulfatase: iduronate 2-sulfatase iso form a preproprotein [Homo Sapiens], NCBI,* 2010, no. vol., pp. 1-4.

ImClone Systems Incorporated and Bristol-Myers Squibb Company, Erbitux, Cetuximab, 2004, No Vol number, pp. 1-18.

PCT Invitation to pay additional fees and, where applicable, protest fee for International application No. PCT/US2013/030061, dated Aug. 22, 2013.

PCT Invitation to pay additional fees and, where applicable, protest fee for International application no. PCT/US2013/030062, dated Jul. 19, 2013.

PCT Invitation to pay additional fees and, where applicable, protest fee for International application No. PCT/US2013/030064, dated Jul. 5, 2013.

Janssens, Ann et al., Rituximab for Chronic Lymphocytic Leukemia in Treatment-Naive and Treatment-Experienced Patients, Onelive, Bringing Oncology Together, Apr. 2, 2014, No vol., pp. 1-7.

Jiang et al., "CYP7A1 polymorphism influences the LDL cholesterol-lowering response to atorvastation." J. Clin. Pharm. Ther. (2012); 37: 719-723.

Jinek, M. et al., RNA-programmed genome editing in human cells. Elife. 2013;2:e00471.

Kobayashi et al., Roles of the WHHL Rabbit in Translational Research on Hypercholesterolemia and Cardiovascular Diseases, Journal of Biomedicine and Biotechnology, vol. 2011, Article ID 406473, pp. 1-10.

Kreitman, Robert J. et al., Phase I Trial of Anti-CD22 Recombinant Immunotoxin Moxetumomab Pasudotox (CAT-8015 or HA22) in Patients With Hairy Cell Leukemia, Journal of Clinical Oncology, 2012, vol. 30, No. 15, pp. 1822-1826.

Krueger, Gerald G. et al., A Human Interleukin-12/23 Monoclonal Antibody for the Treatment of Psoriasis, the New England Journal of Medicine, 2007,vol. 356, No. 6, pp. 580-592.

Kufe, D.W. et al., Holland-Frei cancer medicine, 6th edition. Hamilton (ON): BC Decker; 2003; Table 12-1.

Kuijpers, Taco W. et al., CD20 deficiency in humans results in impaired T cell-independent antibody responses, the Journal of Clinical Investigation, 2010, vol. 120, No. 1, pp. 214-222.

Latarjet, R., Production of multiple cancers in mice having received nucleic acid extract from isologous & homologous leukemic tissues. C.R. Hebd Seances Acad. Sci., 1958, 246(5):853-5.

Lewis, J.K., et al., Matrix-assisted laser desorption/ionization mass spectrometry in peptide and protein analysis. Enc of Anal Chem. 2000; RA Meyers (Ed.) 5880-5894.

Li et al., "Gene Therapy Targeting LDL Cholesterol but not HDL Cholesterol Induces Regression of Advanced Atherosclerosis in a Mouse Model of Familial Hypercholesterolemia," J Genet Syndr Gene Ther., 2011;2:106 (22 pages).

Mackie, Ga, Vectors for the synthesis of specific RNAs in vitro. Biotechnology. 1988;10:253-67.

Micromedex, Antihemophilic Factor VIII and Von Willebrand Factor Complex (Intravenous Route), Mayo Clinic, No Vol #, pp. 1-5.

Ministry of Health, Labour and Welfare, Report on the Deliberation Results, Soliris for Intravenous Infusion 300 mg, 2010, No vol., pp. 1-105.

Mohamadzadeh, M et al., Dendritic Cell Targeting of Bacillus Anthracis Protective Antigen Expressed by Lactobacillus Acidophilus Protects Mice From Lethal Challenge, PNAS, 2009, vol. 106, No. 11, pp. 4331-4336.

Morphotek, Efficacy and Safety of MORAb-003 in Subjects With Platinum-sensitive Ovarian Cancer in First Relapse, ClinicalTrials. gov, Apr. 2, 2014, http://clinicaltrials.gov/ct2/show/NCT00849667?term=Farletuzu mab&rank=4&submit_ftd _opt, pp. 1-3.

Mulkearns et al., FCH02 organizes clathrin-coated structures and interacts with Dab2 for LDLR endocytosis, Molecular Biology of the Cell, 2012, pp. 1-28.

National Cancer Institute, Drugs Approved for Ovarian Cancer, Aug. 16, 2013, No vol., pp. 1-2.

Niu, M.C., Current Evidence Concerning Chemical Inducers. Evolution of Nervous Control from Primitive Organisms. Publication No. 52 of the American Association for Advancement of Science, Washington, D.C. 1959, 7-30.

Niu, M.C., Mode of Action of the Exogenous Ribonucleic Acid in Cell Function. Natl Cancer Inst. Monogr. 1964, 13:167-77.

Niu, M.C., The Effect of mRNA on Nuclear Activity in Developing Systems, The Role of RNA in Development and Reproduction, 1980, 415-33.

Niu, M.C., VII. New Approaches to the Problem of Embryonic Induction. Cellular Mechanisms, Differentiation and Growth. 1956, 155-71.

Novartis, Product Label, Simulect, Basiliximab, 1998, No vol. pp. 1-7.

Okumura, K., et al., Bax mRNA therapy using cationic liposomes for human malignant melanoma. J Gene Med. 2008; 10: 910-917.

Prokaria LTD, TSC DNA ligase, 2013, No vol., pp. 1-3.

Prokazyme Ltd., ThermoPhage, ssDNA ligase,2013, No vol. pp. 1-3.

Reichert, Janice M. et al., Which Are the Antibodies to Watch in 2013?, mAbs, 2013, vol. 5, No. 1, pp. 1-4.

Rob C. et al., IgG4 Breaking the Rules, Immunology, 2002, vol. 105, No#, pp. 9-19.

Roche Pharma AG, A Study to Evaluate Two Doses of Ocrelizumab in Patients With Active Systemic Lupus Erythematosus (Begin), ClinicalTrials.gov, Apr. 1, 2014, No Vol#, http://clinicaltrials.gov/c12/show/NCT00539838, pp. 1-4.

Roche Pharma AG, A Study to Investigate the Efficacy and Safety of Bendamustine Compared With Bendamustine +R05072759 (GA 101) in Patients With Rituximab-Refractory, Indolent Non-Hodgkin's Lymphoma (Gadolin), ClinicalTrials. gov, Apr. 2, 2014, http://clinicaltrials.gov/ct2/show/Ncto 10 59630?term=Obinutuzumab&rank=20&submit_fld_opt, pp. 1-3.

Roche, Zenapax (daclizumab) Sterile Concentrate for Injection,2013, no. vol., pp. 1-11.

Romosozumab, Statement on a Nonproprietary Name Adopted by the Usan Council, 2011, No Volume, p. 1.

Rose, Jason, MicroRNA "Sponge": Proof of Concept for a Novel MicroRNA Target Identification Technique, A Major Qualifying Project Report, Submitted to the Faculty of Worcester Polytechnic Institute, 2010, No Volume, pp. 1-26.

Rosenberg, Leon E., et al., Biogenesis of Ornithine Transcarbamylase in spfash Mutant Mice: Two Cytoplasmic Precursors, One Mitochondrial Enzyme, Science, 1983, Vol. 222, no. vol.#, pp. 426-428.

Ross, B.S. et al., Synthesis and incorporation of 2'-0-methyl-pseudouridine into oligonucleotides. Nucleosides and Nucleotides. 1997; 16(7/9):1547-9.

Rossi, Derrick. Open letter Entitled "Change to mRNA Reprogramming Protocol" Publication Date: Aug. 13, 2011 ("Rossi")(available at Addgene website: http://www.addgene.org/static/data/83/87/3686c0f2-c9a2-11e0-b8a9-003048dd6500.pdf, last retrieved Mar. 17, 2013), p. 1.

Sikora et al., Update on the Pathogenesis and Treatment of Systemic Idiopathic Arthritis, Curr. Opinion Pediat, 2011, vol. 23, No. 6, pp. 640-646.

Seq Search Result 1 (US Patent Application No. 13/897,362) dated Oct. 11, 2013.

Smith, W.S. et al., Rna modified uridines: Vi: Conformations of 343-(S)-Amino-3- Carboxypropyl]Uridine (acp3U) from tRNA and

(56) References Cited

OTHER PUBLICATIONS

1-Methyl-3-[3-(S)-Amino-3-Carboxypropyl]Pseudouridine (m1acp3(P) from rRNA. Nucleosides and Nucleotides. 1992; 11(10):1683-94.
Soll, D. Enzymatic modification of transfer Rna. Science. 1971 Jul. 23; 173(3994): 293-299.
Steinman, R.M. et al., Dendritic cells: antigen presentation, accessory function and clinical relevance. Adv Exp Med Biol. 1993;329:1-9.
Stelic Institute & Co., Contract Research Services Specialized in Nash-Hcc, Ver.2012.11, 2012, 99.1-10.
The Human Embryonic Stem Cell and the Human Embryonic Germ Cell. Nih Stem Cells: Scientific Progress and Future Research Directions, Department of Health and Human Services, Chapter 3, Jun. 2001.
The Stem Cell. Nih Stem Cells: Scientific Progress and Future Research Directions, Department of Health and Human Services, Chapter 1, Jun. 2001.
Van Den Bosch, Ga, et al., Simultaneous activation of Viral Antigen-specific Memory CD4+ and CD8+ T-cells using mRNA--electroporated CD40-activaled autologous B-cells. J Immunother. 2006 Sep/Oct; 29, 512-23.
Wallace, Daniel J. et al., Epratuzumab Demonstrates Clinically Meaningful Improvements in Patients with Moderate to Severe Systemic Lupus Erythematosus (Sle) Results from Emblem, a Phase Iib Study, Acr Concurrent Abstract Sessions, Systemic Lupus Enrthematosus- Clinical Aspects and Treatment: New Therapies, 2010, no. vol., pp. 1452.
Weaver, J.C., Electroporation theory. Concepts and mechanisms. Methods Mol Biol. 1995;55:3-28.
Who Drug Information, International Nonproprietary Names for Pharmaceutical Substances (Inn), 1993, vol. 7, No. 4, pp. 1-16.
Who Drug Information, International Nonproprietary Names for Pharmaceutical Substances (Inn), 2011, vol. 25, No. 3, pp. 1-46.
Who Drug Information, International Nonproprietary Names for Pharmaceutical Substances (Inn), 2012, vol. 26, No. 2, pp. 1-79.
Who Drug Information, International Nonproprietary Names for Pharmaceutical Substances (Inn), 2012, vol. 26, No. 3, pp. 1-36.
Who Drug Information, International Nonproprietary Names for Pharmaceutical Substances (Inn), 2012, vol. 26, No. 4, pp. 1-71.
Who Drug Information, International Nonproprietary Names for Pharmaceutical Substances (Inn), Recommended Inn, 2000, vol. 14, No. 1, pp. 39-76.
Who Drug Information, International Nonproprietary Names for Pharmaceutical Substances (Inn),2013, vol. 27, No. 4, pp. 1-60.
Xgeva (denosumab) Product Label 2010-2013 pp. 1-16.
Yamamoto et al., "The human Ldl receptor: a cysteine-rich protein with multiple Alu sequences in its Mrna." Cell (1984); 39: 27-38.
Zhi, Y., et al., "Hypermethylation in promoter area of Ldlr gene in atherosclerosis patients," Journal of Molecular Cell Biology 40(6):419-427, Oxford Academic, England (2015).
Abu Lila et al., Application of polyglycerol coating to plasmid Dna lipoplex for the evasion of the accelerated blood clearance phenomenon in nucleic acid delivery. J Pharm Sci. 2014 Feb;103(2):557-66. doi: 10.1002/jps.23823. Epub 2013 Dec 17.
Abu Lila et al., Use of polyglycerol (Pg), instead of polyethylene glycol (Peg), prevents induction of the accelerated blood clearance phenomenon against long-circulating liposomes upon repeated administration. Int J Pharm. 2013 Nov 1;456(1):235-42. doi: 10.1016/j.ijpharm.2013.07.059. Epub Aug. 5, 2013.
Ashizawa et al., "Liposomal delivery of nucleic acid-based anticancer therapeutics: Bp-100-1.01," Expert Opin. Drug Deliv., (2014) 12(7):1107-1120.
Bhattacharya et al., a Practical Synthesis of N1-Methyl-2'-deoxy-tp-uridine (tp-Thymidine) and Its Incorporation into G-Rich Triple Helix Forming Oligonucleotides. 1995. Nucleosides and Nucleotides, 14(6):1269-87.
Chamberlain et al., Recurrent lymphomatous meningitis treated with intra-Csf rituximab and liposomal ara-C. J Neurooncol. 2009 Feb;91(3):271-7. doi: 10.1007/s11060-008-9707-1. Epub Sep. 27, 2008.
Heyes et al., Cationic lipid saturation influences intracellular delivery of encapsulated nucleic acids. J Control Release. Oct. 3, 2005;107(2):276-87.
Kauffman et al., Optimization of Lipid Nanoparticle Formulations for mRNA Delivery in Vivo with Fractional Factorial and Definitive Screening Designs. Nano Lett. 2015 Nov 11;15(11):7300-6. doi: 10.1021/acs.nanolett.5b02497. Epub Oct. 20, 2015.
.Krause et al., Prevention of the hemodynamic effects of iopromide-carrying liposomes in rats and pigs. Invest Radio!. Aug. 2000;35(8):493-503.
Marcu et al., the 5'-terminal sequences of immunoglobulin messenger RNAs of a mouse myeloma. J Mol Biol. Apr. 15, 1978;120(3):381-400.
Popov et al., Multivalent rituximab lipid nanoparticles as improved lymphoma therapies: indirect mechanisms of action and in vivo activity. nNanomedicine (Lond). 2011 Nov;6(9):1575-91. doi: 10.2217/nnm.11.50. Epub Oct. 20, 2011.
Sahin et al., mRNA-based therapeutics—developing a new class of drugs. Nat Rev Drug Discov. 2014 Oct;13(10):759-80. doi: 10.1038/nrd4278. Epub Sep. 19, 2014.
Shimizu et al., Transport of PEGylated liposomes from the splenic marginal zone to the follicle in the induction phase of the accelerated blood clearance phenomenon. Immunobiology. May 2013;218(5):725-32. doi: 10.1016/j.imbio.2012.08.274. Epub Aug. 23, 2012.

\* cited by examiner

FIGURE 5

Patterns of positional modification

| A (L) | B | (L) | C | (L) |
|---|---|---|---|---|

5'[NNNNN$_n$]$_x$ L1 [NNNNNNNNNNNN$_o$]$_y$ L2 [XXXXXXXXXXX$_p$]$_z$ L3 3'

5'[NNNNN$_n$]$_x$ L1 [XXXXXXXXXXXX$_o$]$_y$ L2 [XXXXXXXXXXX$_p$]$_z$ L3 3'

5'[XXXXX$_n$]$_x$ L1 [XXXXXXXXXXXX$_o$]$_y$ L2 [XXXXXXXXXXX$_p$]$_z$ L3 3'

5'[NNNNN$_n$]$_x$ L1 [NNNNNNNNNNNN$_o$]$_y$ L2 [XXXXXXXXXXX$_p$]$_z$ L3 3'

A, B, C- Region or Part of chimeric polynucleotide
N-nucleoside
n, o, p-number of nucleosides
x, y, z-number of regions
X-selective placement nucleoside
L-linker (optional)

FIGURE 6

Blocked or structured 3' termini

| A | (L) | B | (L) | C | (L) |
|---|---|---|---|---|---|

5'[NNNNN$_n$]$_x$ L1 [NNNNNNNNNNNN$_o$]$_y$ L2 [XXXXXXXXXXX$_p$]$_z$ L3 3'

5'[NNNNN$_n$]$_x$ L1 [NNNNNNNNNNNN$_o$]$_y$ L2 [XXXXXXXXXXX$_p$]$_z$ K 3'

5'[NNNNN$_n$]$_x$ L1 [NNNNNNNNNNNN$_o$]$_y$ L2 [XXXXXXXXXXXXXXXX X X
　　　　　　　　　　　　　　　　　　　　　　　　　3'[XXXXXXXXXX X

5'[NNNNN$_n$]$_x$ L1 [NNNNNNNNNNNN$_o$]$_y$ L2 [XXXXXXXXXXXXXXXX[L L  =L3
　　　　　　　　　　　　　　　　　　　　　　　3' XXXXXXXXXX[L L

5'[NNNNN$_n$]$_x$ L1 [NNNNNNNNNNNN$_o$]$_y$ L2 [XXXXXXXXXXXXXXXX[L L  =L3
　　　　　　　　　　　　　　　　　　　　　　　X X XXXXXXXXXX[L L
　　　　　　　　　　　　　　　　　　　　　　　X X XXXXXXXXX 3'

A, B, C - Region or Part of chimeric polynucleotide
N - nucleoside
n, o, p - number of nucleosides
x, y, z - number of regions
X - selective placement nucleoside
K - non-nucleosidic moiety or conjugate
L - linker (optional)

PRIOR ART

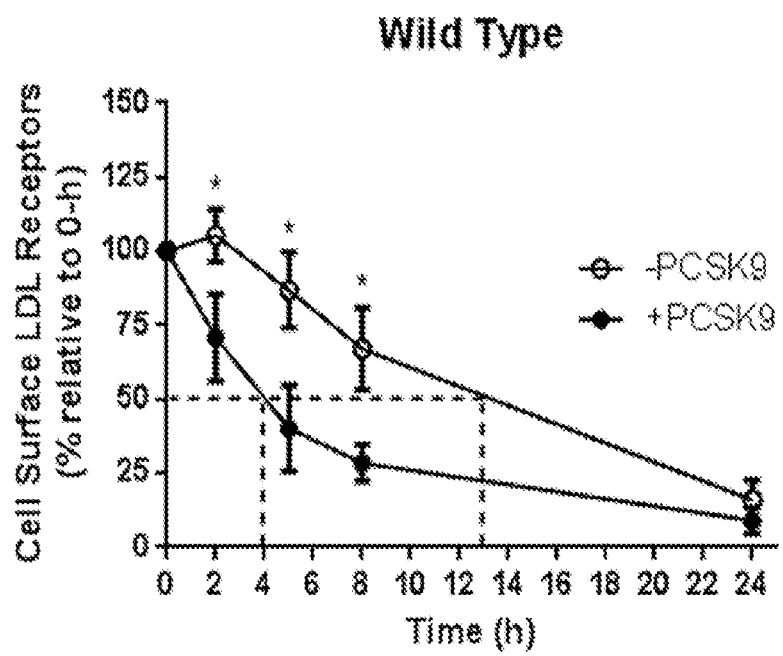
FIGURE 19B
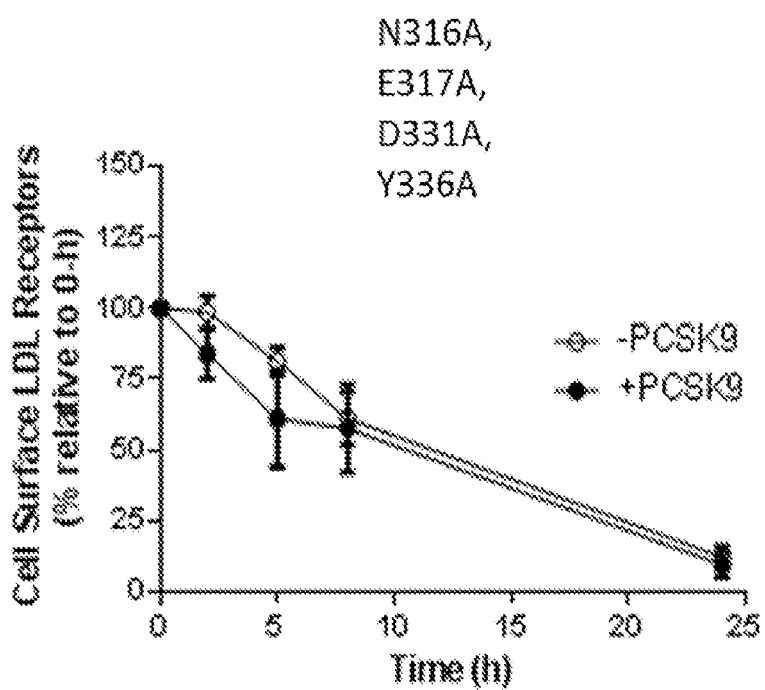

POLYNUCLEOTIDES ENCODING LOW DENSITY LIPOPROTEIN RECEPTOR

CROSS REFERENCE TO RELATED APPLICATIONS

This application claims priority to U.S. Provisional Patent Application No. 62/052,139 filed Sep. 18, 2014, entitled Polynucleotides Encoding Low Density Lipoprotein Receptor, U.S. Provisional Patent Application No. 61/952,906, filed Mar. 14, 2014, entitled Polynucleotides Encoding Low Density Lipoprotein Receptor, U.S. Provisional Patent Application No. 61/886,137, filed Oct. 3, 2013, entitled Polynucleotides Encoding Low Density Lipoprotein Receptor and U.S. Provisional Patent Application No. 61/903,485, filed Nov. 13, 2013, entitled Polynucleotides Encoding Low Density Lipoprotein Receptor, the contents of each of which are herein incorporated by reference in its entirety.

REFERENCE TO SEQUENCE LISTING

The present application is being filed along with a Sequence Listing in electronic format. The Sequence Listing is provided as a file entitled 3529.0200004_M070PCT.txt, created on Apr. 1, 2016, which is 2,607,606 bytes in size. The information in the electronic format of the sequence listing is incorporated herein by reference in its entirety.

FIELD OF THE INVENTION

The invention relates to compositions, methods, processes, kits and devices for the design, preparation, manufacture and/or formulation of polynucleotides encoding low density lipoprotein receptor comprising at least one mutation, e.g., a LDLR cell surface expression-enhancing mutation, a mutation increasing the residence time of LDLR at the cell surface or a mutation resulting in increased levels of LDLR at the cell surface.

BACKGROUND OF THE INVENTION

High cholesterol is one of a number of risk factors for heart attack and stroke. Although poor diet and lack of excise are common causes of high cholesterol, genetic changes, such as familiar hypercholesterolemia (FH), which is caused by deficiency in LDLR, can be causes of high cholesterol. A number of cholesterol lowering drugs are currently on the market but they are not without risk or contraindications with certain conditions or other medications. Such drugs include statins, fibrates, niacin, bile acid sequestrants (resins), phytosterols, or other compounds that prevent absorption of fats, reduce absorption of cholesterol, or target genes in the cholesterol trafficking pathway.

Nucleic acid based cholesterol lowering drugs include, for example an antisense oligonucleotide inhibitor which targets ApoB-100, mipomersen, which was approved in January 2013 for the treatment of homozygous familial hypercholesterolemia (FH). In December of 2012, the FDA also approved lomitapide for the same condition.

More troubling are the liver related problems associated with cholesterol targeting drugs, particularly elevation in serum transaminases and accumulation of hepatic fat (or hepatic steatosis). For example, because of the potentially significant safety concerns surrounding mipomersen, the drug will carry a boxed warning about liver toxicity as well as requiring certification of prescribers and pharmacies, as well as documentation that the drug is being properly used with each new prescription. While mipomersen was generally effective in lowering LDL cholesterol (more than half of patients in clinical trials had more than a 20% decrease in LDL levels and in the homozygous FH trial, it reduced LDL by 24.7%), a typical FH patient has an average LDL between 400-1000 mg/dL. Consequently, lowering was not likely enough in these patients. In addition, the trials were not large enough to be powered to assess cardiovascular outcomes, though cardiovascular benefit is of course the ultimate intended effect of the drug. Further, serious adverse events of cardiac disorders occurred in the mipomersen group in phase 3 trials.

The present invention addresses the problem of the degradation of LDLR by providing polynucleotides which encode a polypeptide of interest comprising at least one mutation, e.g., a LDLR cell surface expression-enhancing mutation, a mutation increasing the residence time of LDLR at the cell surface or a mutation resulting in increased levels of LDLR at the cell surface. The present invention addresses this need by providing nucleic acid based compounds or polynucleotides (both coding and non-coding and combinations thereof) which have structural and/or chemical features that avoid one or more of the problems in the art, for example, features which are useful for optimizing nucleic acid-based therapeutics while retaining structural and functional integrity, overcoming the threshold of expression, improving expression rates, half life and/or protein concentrations, optimizing protein localization, and avoiding deleterious bio-responses such as the immune response and/or degradation pathways. These barriers may be reduced or eliminated using the present invention.

SUMMARY OF THE INVENTION

Described herein are compositions, methods, processes, kits and devices for the design, preparation, manufacture and/or formulation of polynucleotides encoding low density lipoprotein receptor (LDLR) comprising at least one mutation, e.g., a LDLR cell surface expression-enhancing mutation, a mutation increasing the residence time of LDLR at the cell surface or a mutation resulting in increased levels of LDLR at the cell surface. In one nonlimiting embodiment, such polynucleotides take the form or or function as modified mRNA molecules which encode one or more peptides or polypeptides of interest. In one embodiment, such polynucleotides are substantially non-coding.

Provided herein are polynucleotides encoding LDLR. In one aspect the polynucleotides comprise at least one chemical modified nucleoside disclosed herein such as naturally and non-naturally occurring nucleosides.

In one embodiment, provided herein are polynucleotides, e.g., IVT polynucleotides for the expression of LDLR comprising a first region of linked nucleosides, a first flanking region located 5' relative to the first region and a second flanking region located 3' relative to the first region. The first region may encode a polypeptide of interest encoding LDLR such as, but not limited to, SEQ ID NO: 37-55. The first region of linked nucleosides may comprise at least an open reading frame of a nucleic acid sequence such as, but not limited to, SEQ ID NO: 56-718.

In one embodiment, provided herein are polynucleotides, e.g., IVT polynucleotides for the expression of LDLR comprising a first region of linked nucleosides, a first flanking region located 5' relative to the first region and a second flanking region located 3' relative to the first region. The first region may encode a polypeptide of interest encoding LDLR such as, but not limited to, SEQ ID NO: 37-55. The first region of linked nucleosides may comprise at least an open reading frame of a nucleic acid sequence such as, but not limited to, SEQ ID NO: 56-718.

In one embodiment, the polynucleotides e.g., IVT polynucleotides described herein may encode a polypeptide of interest comprising at least two mutations, e.g., a LDLR cell surface expression-enhancing mutation, a mutation increasing the residence time of LDLR at the cell surface or a mutation resulting in increased levels of LDLR at the cell surface. The mutations may be located on the intracellular domain, the EGF-A domain or on both the intracellular domain the EGF-A domain. As a non-limiting example, the polypeptide of interest comprises two mutations on the intracellular domain such as K830R and C839A. As another non-limiting example, the polypeptide of interest comprises three mutations on the intracellular domain such as K816R, K830R and C839A.

In another embodiment, the polynucleotides, e.g., IVT polynucleotides described herein may encode a polypeptide of interest comprising one mutations, e.g., LDLR cell surface expression-enhancing mutations, mutations increasing the residence time of LDLR at the cell surface or mutations resulting in increased levels of LDLR at the cell surface, on the EGF-A domain and at least two mutations on the intracellular domain. The mutation on the EGF-A domain may be, but is not limited to, N316A and L339D and the mutation on the intracellular domain may be, but are not limited to, K816R, K830R and C839A. As a non-limiting example, the polypeptide of interest may comprise the mutation N316A on the EGF-A domain and the mutations K830R and C839A on the intracellular domain. As another non-limiting example, the polypeptide of interest may comprise the mutation N316A on the EGF-A domain and the mutations K816R, K830R and C839A on the intracellular domain. As a non-limiting example, the polypeptide of interest may comprise the mutation L339D on the EGF-A domain and the mutations K830R and C839A on the intracellular domain. As another non-limiting example, the polypeptide of interest may comprise the mutation L339D on the EGF-A domain and the mutations K816R, K830R and C839A on the intracellular domain.

In one embodiment, the first flanking region may comprise a sequence of linked nucleosides having properties of a 5' untranslated region (UTR) such as, but not limited to, the native 5' UTR of any of the nucleic acids that encode any of SEQ ID NOs 37-55, SEQ ID NOs: 3-19 and functional variants thereof. In one aspect, the first flanking region may be a structured UTR. The first flanking region may also comprise at least one 5' terminal cap such as, but not limited to, Cap0, Cap1, ARCA, inosine, N1-methyl-guanosine, 2'fluoro-guanosine, 7-deaza-guanosine, 8-oxo-guanosine, 2-amino-guanosine, LNA-guanosine, 2-azido-guanosine, Cap2 and Cap4.

In one embodiment, the second flanking region may comprise a sequence of linked nucleosides having properties of a 3'UTR such as, but not limited to, native 3' UTR of any of the nucleic acids that encode any of SEQ ID NOs 37-55, SEQ ID NOs 20-36 and functional variants thereof. The second flanking region may also comprise a 3' tailing sequence of linked nucleosides such as, but not limited to, a poly-A tail of at least 140 nucleotides, a polyA-G quartet and a stem loop sequence.

In one embodiment, the polynucleotides, e.g., IVT polynucleotides may comprise at least one chemically modified nucleoside such as, but not limited to, the modifications listed in Table 5 such as, but not limited to, a uridine modification, a cytidine modification, a guanosine modification, an adenosine modification and/or a thymidine modification. In another embodiment, the polynucleotide, e.g., IVT polynucleotide comprises two chemically modified nucleosides. The two chemically modified nucleosides may be a modification listed in Table 5 such as, but not limited to, a uridine modification, a cytidine modification, a guanosine modification, an adenosine modification and/or a thymidine modification. In yet another embodiment, the polynucleotide, e.g., IVT polynucleotide may comprise three chemically modified nucleosides.

The polynucleotide, e.g., IVT polynucleotides of the present invention may be purified.

In one embodiment, provided herein are polynucleotides, e.g., chimeric polynucleotides encoding LDLR, wherein the polynucleotide, e.g., chimeric polynucleotide has a sequence comprising Formula I,

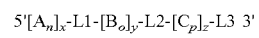

5'-[A$_n$]$_x$-L1-[B$_o$]$_y$-L2-[C$_p$]$_z$-L3 3'      I wherein:
each of A and B independently comprise a region of linked nucleosides;
C is an optional region of linked nucleosides;
at least one of regions A, B, or C is positionally modified;
n, o and p are independently an integer between 15-1000;
x and y are independently 1-20;
z is 0-5;
L1 and L2 are independently optional linker moieties, said linker moieties being either nucleic acid based or non-nucleic acid based; and
L3 is an optional conjugate or an optional linker moiety, said linker moiety being either nucleic acid based or non-nucleic acid based.

In one embodiment, positions A, B or C is positionally modified and the positionally modified region comprises at least two chemically modified nucleosides of one or more of the same nucleoside type of adenosine, thymidine, guanosine, cytidine, or uridine, and wherein at least two of the chemical modifications of nucleosides of the same type are different chemical modifications. In one aspect, the same nucleotide type may be any of the uridine, adenosine, thymidine, cytidine or guanosine modifications described in Table 5, such as two, three or four or more of the same nucleoside type. As a non-limiting example, the two of the same nucleoside type are selected from uridine and cytidine. As another non-limiting example, the chemical modification may be all naturally occurring or all non-naturally occurring.

In one embodiment, the polynucleotides, e.g., chimeric polynucleotides described herein may encode a polypeptide of interest comprising at least two mutations. The mutations may be located on the intracellular domain, the EGF-A domain or on both the intracellular domain the EGF-A domain. As a non-limiting example, the polypeptide of interest comprises two mutations on the intracellular domain such as K830R and C839A. As another non-limiting example, the polypeptide of interest comprises three mutations on the intracellular domain such as K816R, K830R and C839A.

In another embodiment, the polynucleotides, e.g., chimeric polynucleotides described herein may encode a polypeptide of interest comprising one mutation on the EGF-A domain and at least two mutations on the intracellular domain. The mutation on the EGF-A domain may be, but is not limited to, N316A and L339D and the mutations on the intracellular domain may be, but are not limited to, K816R, K830R and C839A. As a non-limiting example, the polypeptide of interest may comprise the mutation N316A on the EGF-A domain and the mutations K830R and C839A on the intracellular domain. As another non-limiting example, the polypeptide of interest may comprise the mutation N316A on the EGF-A domain and the mutations K816R, K830R and C839A on the intracellular domain. As a non-limiting example, the polypeptide of interest may comprise the mutation L339D on the EGF-A domain and the mutations K830R and C839A on the intracellular domain. As another non-limiting example, the polypeptide of interest may comprise the mutation L339D on the EGF-A domain and the mutations K816R, K830R and C839A on the intracellular domain.

In one embodiment, at least one of the regions of linked nucleosides of A may comprise a sequence of linked nucleosides such as, but not limited to, the native 5' UTR of any of the nucleic acids that encode any of SEQ ID NOs 37-55, SEQ ID NOs: 3-19 and functional variants thereof.

In another embodiment, at least one of the regions of linked nucleosides of A is a cap region. The cap region may comprise at least one cap such as, but not limited to, Cap0, Cap1, ARCA, inosine, N1-methyl-guanosine, 2'fluoro-guanosine, 7-deaza-guanosine, 8-oxo-guanosine, 2-amino-guanosine, LNA-guanosine, 2-azido-guanosine, Cap2 and Cap4.

In one embodiment, at least one of the regions of linked nucleosides of C may comprise a sequence of linked nucleosides such as, but not limited to, the native 3' UTR of any of the nucleic acids that encode any of SEQ ID NOs 37-55, SEQ ID NOs 20-36 and functional variants thereof.

In one embodiment, at least one of the regions of linked nucleosides of C is a polyA tail region.

In one embodiment, at least one of the regions of linked nucleosides of B comprises at least an open reading frame of a nucleic acid sequence such as, but not limited to, SEQ ID NOs: 56-718.

In one embodiment, the chimeric polynucleotide is encoded across two regions.

In one embodiment, region B or region C of the chimeric polynucleotide is positionally modified and the polypeptide is encoded entirely within region A.

In another embodiment, region A or region C is positionally modified and the polypeptide is encoded entirely within region B.

In one embodiment, at least one of the regions A, B or C may be codon optimized for expression in human cells.

In another embodiment, the overall G:C content of the codon optimization region may be no greater than the G:C content prior to codon optimization.

The chimeric polynucleotides described herein may also be circular.

Provided herein are compositions comprising at least one of the polynucleotides encoding LDLR and at least one pharmaceutically acceptable excipient. The pharmaceutically acceptable excipient may be, but is not limited to, a solvent, aqueous solvent, non-aqueous solvent, dispersion media, diluent, dispersion, suspension aid, surface active agent, isotonic agent, thickening or emulsifying agent, preservative, lipid, lipidoids liposome, lipid nanoparticle, core-shell nanoparticles, polymer, lipoplex, peptide, protein, cell, hyaluronidase, and mixtures thereof. As a non-limiting example, the pharmaceutically acceptable excipient is a lipid and the lipid may be selected from DLin-DMA, DLin-K-DMA, DLin-KC2-DMA, 98N12-5, C12-200, DLin-MC3-DMA, reLNP, PLGA, PEG, PEG-DMA and PEGylated lipids and mixtures thereof.

The details of various embodiments of the invention are set forth in the description below. Other features, objects, and advantages of the invention will be apparent from the description and the drawings, and from the claims.

BRIEF DESCRIPTION OF THE DRAWINGS

The foregoing and other objects, features and advantages will be apparent from the following description of particular embodiments of the invention, as illustrated in the accompanying drawings in which like reference characters refer to the same parts throughout the different views. The drawings are not necessarily to scale, emphasis instead being placed upon illustrating the principles of various embodiments of the invention.

FIG. 5 is a schematic of a series of chimeric polynucleotides illustrating various patterns of positional modifications based on Formula I.

FIG. 6 is a is a schematic of a series of chimeric polynucleotides illustrating various patterns of positional modifications based on Formula I and further illustrating a blocked or structured 3' terminus.

FIG. 18A shows contour plots of the binding of BODIPY- LDL to LDLR mRNA transfected cells. FIG. 18B shows the half-maximal cell association of BODIPY-LDL.

FIGS. 19A-19G shows the effect on half-life after transfection with LDLR mRNA. FIG. 19A shows wild-type LDLR mRNA. FIG. 19B shows a LDLR mRNA encoding a LDLR with 4 mutations (N316A, E317A, D331A and Y336A). FIG. 19C shows a LDLR mRNA encoding a LDLR with 1 mutation, Y336A. FIG. 19D shows a LDLR mRNA encoding a LDLR with 1 mutation, E317A. FIG. 19E shows a LDLR mRNA encoding a LDLR with 1 mutation, N316A. FIG. 19F shows a LDLR mRNA encoding a LDLR with 1 mutation, L339D. FIG. 19G shows a LDLR mRNA encoding a LDLR with 1 mutation, D331E.

DETAILED DESCRIPTION

Figure 1:
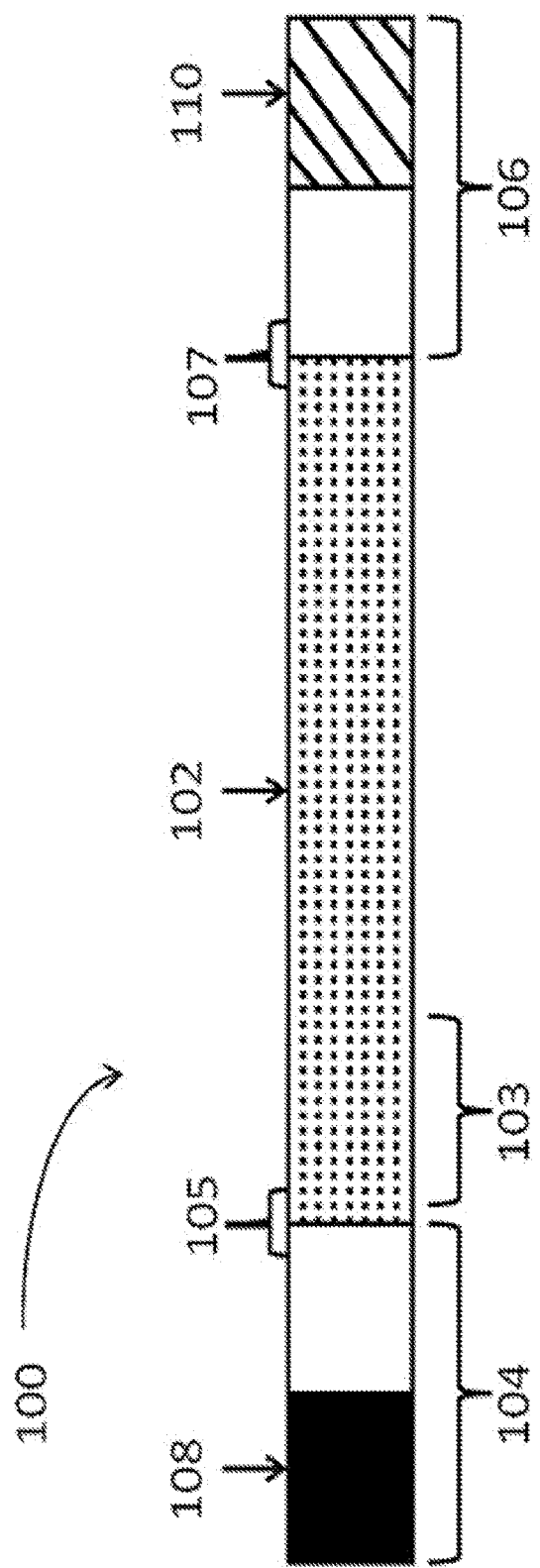
FIG. 1 is a schematic of an IVT polynucleotide construct taught in commonly owned co-pending U.S. patent application Ser. No. 13/791,922 filed Mar. 9, 2013, the contents of which are incorporated herein by reference.

It is of great interest in the fields of therapeutics, diagnostics, reagents and for biological assays to be able design, synthesize and deliver a nucleic acid, e.g., a ribonucleic acid (RNA) inside a cell, whether in vitro, in vivo, in situ or ex vivo, such as to effect physiologic outcomes which are beneficial to the cell, tissue or organ and ultimately to an organism. One beneficial outcome is to cause intracellular translation of the nucleic acid and production of at least one encoded peptide or polypeptide of interest. In like manner, non-coding RNA has become a focus of much study; and utilization of non-coding polynucleotides, alone and in conjunction with coding polynucleotides, could provide beneficial outcomes in therapeutic scenarios.

Described herein are compositions (including pharmaceutical compositions) and methods for the design, preparation, manufacture and/or formulation of polynucleotides, specifically IVT polynucleotides, chimeric polynucleotides and/or circular polynucleotides.

Also provided are systems, processes, devices and kits for the selection, design and/or utilization of the polynucleotides described herein.

According to the present invention, the polynucleotides are preferably modified in a manner as to avoid the deficiencies of other molecules of the art.

The use of polynucleotides such as modified polynucleotides encoding polypeptides (i.e., modified mRNA) in the fields of human disease, antibodies, viruses, veterinary applications and a variety of in vivo settings has been explored previously and these studies are disclosed in for example, those listed in Table 6 of U.S. Provisional Patent Application Nos. 61/618,862, 61/681,645, 61/737,130, 61/618,866, 61/681,647, 61/737,134, 61/618,868, 61/681,648, 61/737,135, 61/618,873, 61/681,650, 61/737,147, 61/618,878, 61/681,654, 61/737,152, 61/618,885, 61/681,658, 61/737,155, 61/618,896, 61/668,157, 61/681,661, 61/737,160, 61/618,911, 61/681,667, 61/737,168, 61/618,922, 61/681,675, 61/737,174, 61/618,935, 61/681,687, 61/737,184, 61/618,945, 61/681,696, 61/737,191, 61/618,953, 61/681,704, 61/737,203; Table 6 and 7 of U.S. Provisional Patent Application Nos. 61/681,720, 61/737,213, 61/681,742; Table 6 of International Publication Nos. WO2013151666, WO2013151668, WO2013151663, WO2013151669, WO2013151670, WO2013151664, WO2013151665, WO2013151736; Tables 6 and 7 International Publication No. WO2013151672; Tables 6, 178 and 179 of International Publication No. WO2013151671; Tables 6, 28 and 29 of U.S. Provisional Patent Application No. 61/618,870; Tables 6, 56 and 57 of U.S. Provisional Patent Application No. 61/681,649; Tables 6, 186 and 187 U.S. Provisional Patent Application No. 61/737,139; Tables 6, 185 and 186 of International Publication No WO2013151667; the contents of each of which are herein incorporated by reference in their entireties. Any of the foregoing may be synthesized as an IVT polynucleotide, chimeric polynucleotide or a circular polynucleotide and such embodiments are contemplated by the present invention.

Provided herein, therefore, are polynucleotides which have been designed to improve one or more issues in the art such as stability and/or clearance in tissues, receptor uptake and/or kinetics, cellular access, engagement with translational machinery, mRNA half-life, translation efficiency, immune evasion, protein production capacity, secretion efficiency (when applicable), accessibility to circulation, protein half-life and/or modulation of a cell's status, function and/or activity.

In one aspect, the invention provides polynucleotides that encode LDLR. In exemplary embodiments, the polynucleotides of the invention encode LDLR comprising at least one mutation. In exemplary embodiments, the polynucleotides of the invention encode a LDLR comprising at least one LDLR cell surface expression-enhancing mutation (e.g., increasing the residence time of LDLR on the cell surface or increased levels of LDLR at the cell surface). As will be appreciated by the skilled artisan, modulation of cell surface receptors, e.g., modulation of activity and/or expression of cell surface receptors to achieve a desired biological or therapeutic outcome can be quite challenging. In particular, modulating (e.g., increasing) expression of complex cell surface receptors can be difficult, especially when trying to do so in vivo. The instant invention features the use of polynucleotides, e.g., modified mRNAs, particularly suited for in vivo delivery. The modified mRNAs of the invention are designed to facilitate, for example, enhanced expression of biologically active LDLRs in a variety of biological and/or therapeutic settings.

I. Compositions of the Invention

Polynucleotides

The present invention provides nucleic acid molecules, specifically polynucleotides which, in some embodiments, encode one or more peptides or polypeptides of interest. The term "nucleic acid," in its broadest sense, includes any compound and/or substance that comprise a polymer of nucleotides. These polymers are often referred to as polynucleotides.

Exemplary nucleic acids or polynucleotides of the invention include, but are not limited to, ribonucleic acids (RNAs), deoxyribonucleic acids (DNAs), threose nucleic acids (TNAs), glycol nucleic acids (GNAs), peptide nucleic acids (PNAs), locked nucleic acids (LNAs, including LNA having a β-D-ribo configuration, α-LNA having an α-L-ribo configuration (a diastereomer of LNA), 2'-amino-LNA having a 2'-amino functionalization, and 2'-amino-α-LNA having a 2'-amino functionalization), ethylene nucleic acids (ENA), cyclohexenyl nucleic acids (CeNA) or hybrids or combinations thereof.

In one embodiment, polynucleotides of the present invention which are made using only in vitro transcription (IVT) enzymatic synthesis methods are referred to as "IVT polynucleotides." Methods of making IVT polynucleotides are known in the art and are described in U.S. Provisional Patent Application Nos. 61/618,862, No 61/681,645, 61/737,130, 61/618,866, 61/681,647, 61/737,134, 61/618,868, 61/681,648, 61/737,135, 61/618,873, 61/681,650, 61/737,147, 61/618,878, 61/681,654, 61/737,152, 61/618,885, 61/681, 658, 61/737,155, 61/618,896, 61/668,157, 61/681,661, 61/737,160, 61/618,911, 61/681,667, 61/737,168, 61/618,922, 61/681,675, 61/737,174, 61/618,935, 61/681,687, 61/737,184, 61/618,945, 61/681,696, 61/737,191, 61/618,953, 61/681,704, 61/737,203, 61/618,870, 61/681,649 and 61/737,139; and International Publication Nos. WO2013151666, WO2013151667, WO2013151668, WO2013151663, WO2013151669, WO2013151670, WO2013151664, WO2013151665, WO2013151671, WO2013151672 and WO2013151736; the contents of each of which are herein incorporated by reference in their entireties.

In another embodiment, the polynucleotides of the present invention which have portions or regions which differ in size and/or chemical modification pattern, chemical modification position, chemical modification percent or chemical modification population and combinations of the foregoing are known as "chimeric polynucleotides." A "chimera" according to the present invention is an entity having two or more incongruous or heterogeneous parts or regions. As used herein a "part" or "region" of a polynucleotide is defined as any portion of the polynucleotide which is less than the entire length of the polynucleotide.

In yet another embodiment, the polynucleotides of the present invention that are circular are known as "circular polynucleotides" or "circP." As used herein, "circular polynucleotides" or "circP" means a single stranded circular polynucleotide which acts substantially like, and has the properties of, an RNA. The term "circular" is also meant to encompass any secondary or tertiary configuration of the circP.

In some embodiments, the polynucleotide includes from about 30 to about 100,000 nucleotides (e.g., from 30 to 50, from 30 to 100, from 30 to 250, from 30 to 500, from 30 to 1,000, from 30 to 1,500, from 30 to 3,000, from 30 to 5,000, from 30 to 7,000, from 30 to 10,000, from 30 to 25,000, from 30 to 50,000, from 30 to 70,000, from 100 to 250, from 100 to 500, from 100 to 1,000, from 100 to 1,500, from 100 to 3,000, from 100 to 5,000, from 100 to 7,000, from 100 to 10,000, from 100 to 25,000, from 100 to 50,000, from 100 to 70,000, from 100 to 100,000, from 500 to 1,000, from 500 to 1,500, from 500 to 2,000, from 500 to 3,000, from 500 to 5,000, from 500 to 7,000, from 500 to 10,000, from 500 to 25,000, from 500 to 50,000, from 500 to 70,000, from 500 to 100,000, from 1,000 to 1,500, from 1,000 to 2,000, from 1,000 to 3,000, from 1,000 to 5,000, from 1,000 to 7,000, from 1,000 to 10,000, from 1,000 to 25,000, from 1,000 to 50,000, from 1,000 to 70,000, from 1,000 to 100,000, from 1,500 to 3,000, from 1,500 to 5,000, from 1,500 to 7,000, from 1,500 to 10,000, from 1,500 to 25,000, from 1,500 to 50,000, from 1,500 to 70,000, from 1,500 to 100,000, from 2,000 to 3,000, from 2,000 to 5,000, from 2,000 to 7,000, from 2,000 to 10,000, from 2,000 to 25,000, from 2,000 to 50,000, from 2,000 to 70,000, and from 2,000 to 100,000).

In one embodiment, the polynucleotides of the present invention may encode at least one peptide or polypeptide of interest. The peptide or polypeptide of interest may be low density lipoprotein receptor (LDLR), a variant or mutant thereof.

In exemplary embodiments, the polynucleotides of the present invention encode a LDLR protein such as a wild-type LDLR or a variant of a wild-type protein. In exemplary embodiments, the polynucleotides of the invention encode a variant LDLR protein, i.e., a LDLR that differs by one or more amino acid differences, insertions or deletions from a wild-type LDLR. As a non-limiting example, the LDLR protein can comprise a polymorphism, e.g., a naturally-occurring polymorphism. As a non-limiting example, the LDLR protein comprises mutation e.g., a naturally occurring mutation or a non-naturally occurring mutation or both.

In exemplary embodiments, the polynucleotides of the invention comprise at least one mutation that alters a biological property of the LDLR or a LDLR protein. In exemplary embodiments, the polynucleotides of the invention comprise at least one mutation that alters expression, in particular, cell-surface expression, of the LDLR. Such mutations are referred to herein as "cell-surface expression-enhancing" mutations." Exemplary "cell-surface expression-enhancing mutations" alter, e.g., inhibit or reduce, LDLR degradation, thus leading to increase expression, e.g., cell surface expression of LDLR or LDLR proteins, or increased levels of LDLR at the cell surface. In exemplary embodiments, a cell-surface expression-enhancing mutation occurs in a LDLR domain associated with LDLR degradation.

In one embodiment, the polynucleotides of the present invention may encode a LDLR protein comprising a mutation in the EGF-A domain.

In one embodiment, the polynucleotides of the present invention may encode a variant of a LDLR protein where the LDLR protein comprises mutation in the IDOL interacting domain. IDOL (inducible degrader of LDLR) is an E3 ubiquitin ligase known to be induced following activation of liver X receptors and subsequently interacts with a cytoplasmic domain within LDLR (the IDOL interacting domain) mediating receptor ubiquitination and degradation. As a non-limiting example, the alteration of the IDOL interacting domain, e.g., by introducing mutations therein, leads to an inhibition of IDOL-mediated LDLR degradation and causes an increase in LDLR protein expression. As a yet non-limiting example, the alteration of the IDOL interacting domain, e.g., by introducing mutations therein, leads to IDOL-mediated LDLR degradation and promotes low density lipoprotein (LDL) uptake.

In another embodiment, the polynucleotides of the present invention may encode a LDLR protein where the LDLR protein comprises an alteration, e.g., a mutation in the PCSK9 interacting domain. PCSK9 (proprotein convertase subtilisin/kexin type 9) is proteinase K enzyme that binds to an epidermal growth factor-like repeat A (EGF-A) domain of LDLR (the PCSK9 interacting domain), inducing LDLR degradation. As a non-limiting example, the alteration of the PCSK9 interacting domain, e.g., by introducing mutations therein, leads to an inhibition of PCSK9-mediated LDLR degradation causing an increase in LDLR protein expression. As a yet non-limiting example, the alteration of the PCSK9 interacting domain, e.g., by introducing mutations therein, leads to an inhibition of PCSK9-mediated LDLR degradation and promotes low density lipoprotein (LDL) uptake.

In yet another embodiment, the polynucleotides of the present invention may encode a LDLR protein where the LDLR protein comprises an alteration to the IDOL interacting domain and the PCSK9 interacting domain. As a non-limiting example, the alteration, e.g., mutation, of the PCSK9 interacting domain and the IDOL interacting domain leads an increase in LDLR protein expression. As a yet non-limiting example, the alteration, e.g., mutation, of the PCSK9 interacting domain and IDOL interacting domain promotes low density lipoprotein (LDL) uptake.

In one embodiment, the polynucleotides of the present invention may encode a LDLR protein or variant thereof which is 839 amino acids in length. In another embodiment, the polynucleotides of the present invention may encode a LDLR protein or variant thereof which is 860 amino acids in length.

In another embodiment, the polynucleotides of the present invention may comprise at least one nucleic acid sequence which is non-coding.

In one embodiment, the length of a region encoding at least one peptide polypeptide of interest of the polynucleotides present invention is greater than about 30 nucleotides in length (e.g., at least or greater than about 35, 40, 45, 50, 55, 60, 70, 80, 90, 100, 120, 140, 160, 180, 200, 250, 300, 350, 400, 450, 500, 600, 700, 800, 900, 1,000, 1,100, 1,200, 1,300, 1,400, 1,500, 1,600, 1,700, 1,800, 1,900, 2,000, 2,500, 3,000, 4,000, 4,100, 4,200, 4,300, 4,400, 4,500, 4,600, 4,700, 4,800, 4,900, 5,000, 5,100, 5,200, 5,300, 5,400, 5,500, 5,600, 5,700, 5,800, 5,900, 6,000, 7,000, 8,000, 9,000, 10,000, 20,000, 30,000, 40,000, 50,000, 60,000, 70,000, 80,000, 90,000 or up to and including 100,000 nucleotides). As used herein, such a region may be referred to as a "coding region" or "region encoding."

In one embodiment, the polynucleotides of the present invention is or functions as a messenger RNA (mRNA). As used herein, the term "messenger RNA" (mRNA) refers to any polynucleotide which encodes at least one peptide or polypeptide of interest and which is capable of being translated to produce the encoded peptide polypeptide of interest in vitro, in vivo, in situ or ex vivo.

In one embodiment, the polynucleotides of the present invention may be structurally modified or chemically modified. As used herein, a "structural" modification is one in which two or more linked nucleosides are inserted, deleted, duplicated, inverted or randomized in a polynucleotide without significant chemical modification to the nucleotides themselves. Because chemical bonds will necessarily be broken and reformed to effect a structural modification, structural modifications are of a chemical nature and hence are chemical modifications. However, structural modifications will result in a different sequence of nucleotides. For example, the polynucleotide "ATCG" may be chemically modified to "AT-5meC-G". The same polynucleotide may be structurally modified from "ATCG" to "ATCCG". Here, the dinucleotide "CC" has been inserted, resulting in a structural modification to the polynucleotide.

In one embodiment, the polynucleotides of the present invention, such as IVT polynucleotides or circular polynucleotides, may have a uniform chemical modification of all or any of the same nucleoside type or a population of modifications produced by mere downward titration of the same starting modification in all or any of the same nucleoside type, or a measured percent of a chemical modification of all any of the same nucleoside type but with random incorporation, such as where all uridines are replaced by a uridine analog, e.g., pseudouridine. In another embodiment, the polynucleotides may have a uniform chemical modification of two, three, or four of the same nucleoside type throughout the entire polynucleotide (such as all uridines and all cytosines, etc. are modified in the same way).

When the polynucleotides of the present invention are chemically and/or structurally modified the polynucleotides may be referred to as "modified polynucleotides."

In one embodiment, the polynucleotides of the present invention may include a sequence encoding a self-cleaving peptide. The self-cleaving peptide may be, but is not limited to, a 2A peptide. As a non-limiting example, the 2A peptide may have the protein sequence: GSGATNFSLLKQAGDVEENPGP (SEQ ID NO: 1), fragments or variants thereof. In one embodiment, the 2A peptide cleaves between the last glycine and last proline. As another non-limiting example, the polynucleotides of the present invention may include a polynucleotide sequence encoding the 2A peptide having the protein sequence GSGATNFSLLKQAGDVEENPGP (SEQ ID NO: 1) fragments or variants thereof.

One such polynucleotide sequence encoding the 2A peptide is GGAAGCGGAGCTACTAACTTCAGCCTGCT-GAAGCAGGCTGGAGACGTGGAG GAGAACCCTG-GACCT (SEQ ID NO: 2). The polynucleotide sequence of the 2A peptide may be modified or codon optimized by the methods described herein and/or are known in the art.

In one embodiment, this sequence may be used to separate the coding region of two or more polypeptides of interest. As a non-limiting example, the sequence encoding the 2A peptide may be between a first coding region A and a second coding region B (A-2Apep-B). The presence of the 2A peptide would result in the cleavage of one long protein into protein A, protein B and the 2A peptide. Protein A and protein B may be the same or different peptides or polypeptides of interest. In another embodiment, the 2A peptide may be used in the polynucleotides of the present invention to produce two, three, four, five, six, seven, eight, nine, ten or more proteins.

IVT Polynucleotide Architecture

Traditionally, the basic components of an mRNA molecule include at least a coding region, a 5'UTR, a 3'UTR, a 5' cap and a poly-A tail. The IVT polynucleotides of the present invention may function as mRNA but are distinguished from wild-type mRNA in their functional and/or structural design features which serve to overcome existing problems of effective polypeptide production using nucleic-acid based therapeutics.

FIG. 1 shows a primary construct 100 of an IVT polynucleotide of the present invention. As used herein, "primary construct" refers to a polynucleotide of the present invention which encodes one or more polypeptides of interest and which retains sufficient structural and/or chemical features to allow the polypeptide of interest encoded therein to be translated.

According to FIG. 1, the primary construct 100 of an IVT polynucleotide here contains a first region of linked nucleotides 102 that is flanked by a first flanking region 104 and a second flaking region 106. The first flanking region 104 may include a sequence of linked nucleosides which function as a 5' untranslated region (UTR) such as the 5' UTR of any of the nucleic acids encoding the native 5'UTR of the polypeptide or a non-native 5'UTR such as, but not limited to, a heterologous 5'UTR or a synthetic 5'UTR. The polypeptide of interest may comprise at its 5' terminus one or more signal sequences encoded by a signal sequence region 103. The flanking region 104 may comprise a region of linked nucleotides comprising one or more complete or incomplete 5' UTRs sequences. The flanking region 104 may also comprise a 5' terminal cap 108. The second flanking region 106 may comprise a region of linked nucleotides comprising one or more complete or incomplete 3' UTRs which may encode the native 3' UTR of the polypeptide or a non-native 3'UTR such as, but not limited to, a heterologous 3'UTR or a synthetic 3' UTR. The flanking region 106 may also comprise a 3' tailing sequence 110. The 3' tailing sequence may be, but is not limited to, a polyA tail, a polyA-G quartet and/or a stem loop sequence.

Bridging the 5' terminus of the first region 102 and the first flanking region 104 is a first operational region 105. Traditionally this operational region comprises a Start codon. The operational region may alternatively comprise any translation initiation sequence or signal including a Start codon.

Bridging the 5' terminus of the first region 102 and the first flanking region 104 is a first operational region 105. Traditionally this operational region comprises a Start codon. The operational region may alternatively comprise any translation initiation sequence or signal including a Start codon.

Bridging the 3' terminus of the first region 102 and the second flanking region 106 is a second operational region 107. Traditionally this operational region comprises a Stop codon. The operational region may alternatively comprise any translation initiation sequence or signal including a Stop codon. Multiple serial stop codons may also be used in the IVT polynucleotide. In one embodiment, the operation region of the present invention may comprise two stop codons. The first stop codon may be "TGA" or "UGA" and the second stop codon may be selected from the group consisting of "TAA," "TGA," "TAG," "UAA," "UGA" or "UAG."

Figure 2:
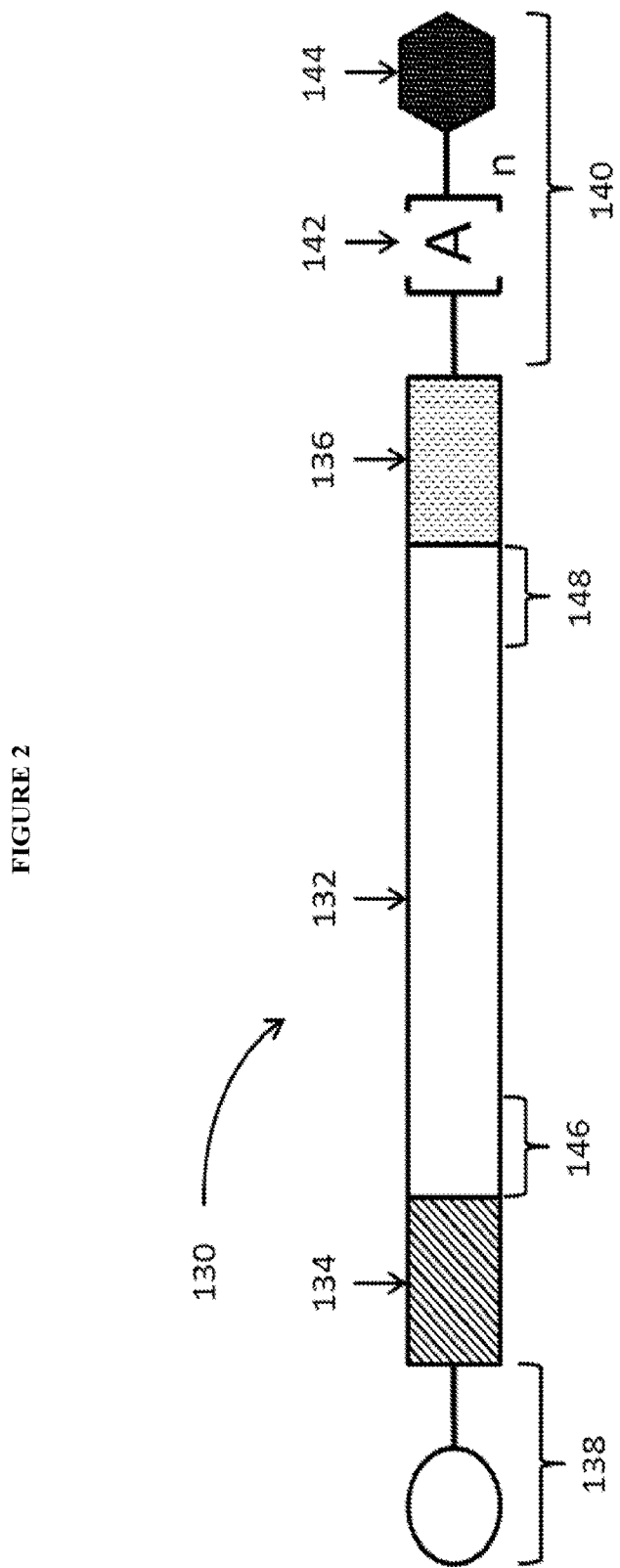
FIG. 2 is a schematic of an IVT polynucleotide construct.

FIG. 2 shows a representative IVT polynucleotide primary construct 130 of the present invention. Polynucleotide primary construct refers to a polynucleotide transcript which encodes one or more polypeptides of interest and which retains sufficient structural and/or chemical features to allow the polypeptide of interest encoded therein to be translated. Non-limiting examples of polypeptides of interest include low density lipoprotein receptor (LDLR) and variants thereof (e.g., a LDLR protein comprising at least one mutation such as a LDLR cell surface enhancing mutation) (Tables 3, 10 and 11 herein) and polynucleotides encoding polypeptide of interest are described in Table 3 herein and in Table 6 of U.S. Provisional Patent Application Nos. 61/618,862, 61/681,645, 61/737,130, 61/618,866, 61/681,647, 61/737,134, 61/618,868, 61/681,648, 61/737,135, 61/618,873, 61/681,650, 61/737,147, 61/618,878, 61/681,654, 61/737,152, 61/618,885, 61/681,658, 61/737,155, 61/618,896, 61/668,157, 61/681,661, 61/737,160, 61/618,911, 61/681,667, 61/737,168, 61/618,922, 61/681,675, 61/737,174, 61/618,935, 61/681,687, 61/737,184, 61/618,945, 61/681,696, 61/737,191, 61/618,953, 61/681,704, 61/737,203; Table 6 and 7 of U.S. Provisional Patent Application Nos. 61/681,720, 61/737,213, 61/681,742; Table 6 of International Publication Nos. WO2013151666, WO2013151668, WO2013151663, WO2013151669, WO2013151670, WO2013151664, WO2013151665, WO2013151736; Tables 6 and 7 International Publication No. WO2013151672; Tables 6, 178 and 179 of International Publication No. WO2013151671; Tables 6, 28 and 29 of U.S. Provisional Patent Application No. 61/618,870; Tables 6, 56 and 57 of U.S. Provisional Patent Application No. 61/681,649; Tables 6, 186 and 187 U.S. Provisional Patent Application No. 61/737,139; Tables 6, 185 and 186 of International Publication No WO2013151667, the contents of each of which are incorporated herein by reference in their entirety. Exemplary reference amino acid and nucleic acid sequences for a wild-type human low density lipoprotein receptor (LDLR) are described in >gi|4504975|ref|NP_000518.1| low-density lipoprotein receptor isoform 1 precursor [*Homo sapiens*] (SEQ ID NO: 744) and >gi|307775410|ref|NM_000527.4|*Homo sapiens* low density lipoprotein receptor (LDLR), transcript variant 1, mRNA (SEQ ID NO: 745), respectively. Exemplary reference amino acid and nucleic acid sequences for a wild-type mouse low density lipoprotein receptor (LDLR) are described in >gi|113195700|ref|NP_034830.2|low-density lipoprotein receptor isoform 1 precursor [*Mus musculus*] (SEQ ID NO: 746) and >gi|358030302|ref|NM_010700.3|*Mus musculus* low density lipoprotein receptor (Ldlr), transcript variant 1, mRNA (SEQ ID NO: 747), respectively. Accession numbers are found at the National Center for Biotechnology Information (NCBI) website.

Returning to FIG. 2, the IVT polynucleotide primary construct 130 here contains a first region of linked nucleotides 132 that is flanked by a first flanking region 134 and a second flaking region 136. As used herein, the "first region" may be referred to as a "coding region" or "region encoding" or simply the "first region." This first region may include, but is not limited to, the encoded polypeptide of interest. In one aspect, the first region 132 may include, but is not limited to, the open reading frame encoding at least one polypeptide of interest. The open reading frame may be codon optimized in whole or in part. The flanking region 134 may comprise a region of linked nucleotides comprising one or more complete or incomplete 5' UTRs sequences which may be completely codon optimized or partially codon optimized. The flanking region 134 may include at least one nucleic acid sequence including, but not limited to, miR sequences, TERZAK™ sequences and translation control sequences. The flanking region 134 may also comprise a 5' terminal cap 138. The 5' terminal capping region 138 may include a naturally occurring cap, a synthetic cap or an optimized cap. Non-limiting examples of optimized caps include the caps taught by Rhoads in U.S. Pat. No. 7,074,596 and International Patent Publication No. WO2008157668, WO2009149253 and WO2013103659. The second flanking region 106 may comprise a region of linked nucleotides comprising one or more complete or incomplete 3' UTRs. The second flanking region 136 may be completely codon optimized or partially codon optimized. The flanking region 134 may include at least one nucleic acid sequence including, but not limited to, miR sequences and translation control sequences. After the second flanking region 136 the polynucleotide primary construct may comprise a 3' tailing sequence 140. The 3' tailing sequence 140 may include a synthetic tailing region 142 and/or a chain terminating nucleoside 144. Non-liming examples of a synthetic tailing region include a polyA sequence, a polyC sequence, a polyA-G quartet. Non-limiting examples of chain terminating nucleosides include 2'-O methyl, F and locked nucleic acids (LNA).

Bridging the 5' terminus of the first region 132 and the first flanking region 134 is a first operational region 144. Traditionally this operational region comprises a Start codon. The operational region may alternatively comprise any translation initiation sequence or signal including a Start codon.

Bridging the 3' terminus of the first region 132 and the second flanking region 136 is a second operational region 146. Traditionally this operational region comprises a Stop codon. The operational region may alternatively comprise any translation initiation sequence or signal including a Stop codon. According to the present invention, multiple serial stop codons may also be used.

The shortest length of the first region of the primary construct of the IVT polynucleotide of the present invention can be the length of a nucleic acid sequence that is sufficient to encode for a dipeptide, a tripeptide, a tetrapeptide, a pentapeptide, a hexapeptide, a heptapeptide, an octapeptide, a nonapeptide, or a decapeptide. In another embodiment, the length may be sufficient to encode a peptide of 2-30 amino acids, e.g. 5-30, 10-30, 2-25, 5-25, 10-25, or 10-20 amino acids. The length may be sufficient to encode for a peptide of at least 11, 12, 13, 14, 15, 17, 20, 25 or 30 amino acids, or a peptide that is no longer than 40 amino acids, e.g. no longer than 35, 30, 25, 20, 17, 15, 14, 13, 12, 11 or 10 amino acids. Examples of dipeptides that the polynucleotide sequences can encode or include, but are not limited to, carnosine and anserine.

The length of the first region of the primary construct of the IVT polynucleotide encoding the polypeptide of interest of the present invention is greater than about 30 nucleotides in length (e.g., at least or greater than about 35, 40, 45, 50, 55, 60, 70, 80, 90, 100, 120, 140, 160, 180, 200, 250, 300, 350, 400, 450, 500, 600, 700, 800, 900, 1,000, 1,100, 1,200, 1,300, 1,400, 1,500, 1,600, 1,700, 1,800, 1,900, 2,000, 2,500, and 3,000, 4,000, 4,100, 4,200, 4,300, 4,400, 4,500, 4,600, 4,700, 4,800, 4,900, 5,000, 5,100, 5,200, 5,300, 5,400, 5,500, 6,000, 7,000, 8,000, 9,000, 10,000, 20,000, 30,000, 40,000, 50,000, 60,000, 70,000, 80,000, 90,000 or up to and including 100,000 nucleotides).

In some embodiments, the IVT polynucleotide includes from about 30 to about 100,000 nucleotides (e.g., from 30 to 50, from 30 to 100, from 30 to 250, from 30 to 500, from 30 to 1,000, from 30 to 1,500, from 30 to 3,000, from 30 to 5,000, from 30 to 7,000, from 30 to 10,000, from 30 to 25,000, from 30 to 50,000, from 30 to 70,000, from 100 to 250, from 100 to 500, from 100 to 1,000, from 100 to 1,500, from 100 to 3,000, from 100 to 5,000, from 100 to 7,000, from 100 to 10,000, from 100 to 25,000, from 100 to 50,000, from 100 to 70,000, from 100 to 100,000, from 500 to 1,000, from 500 to 1,500, from 500 to 2,000, from 500 to 3,000, from 500 to 5,000, from 500 to 7,000, from 500 to 10,000, from 500 to 25,000, from 500 to 50,000, from 500 to 70,000, from 500 to 100,000, from 1,000 to 1,500, from 1,000 to 2,000, from 1,000 to 3,000, from 1,000 to 5,000, from 1,000 to 7,000, from 1,000 to 10,000, from 1,000 to 25,000, from 1,000 to 50,000, from 1,000 to 70,000, from 1,000 to 100,000, from 1,500 to 3,000, from 1,500 to 5,000, from 1,500 to 7,000, from 1,500 to 10,000, from 1,500 to 25,000, from 1,500 to 50,000, from 1,500 to 70,000, from 1,500 to 100,000, from 2,000 to 3,000, from 2,000 to 5,000, from 2,000 to 7,000, from 2,000 to 10,000, from 2,000 to 25,000, from 2,000 to 50,000, from 2,000 to 70,000, from 2,000 to 100,000, and from 4,500 to 5,500).

According to the present invention, the first and second flanking regions of the IVT polynucleotide may range independently from 15-1,000 nucleotides in length (e.g., greater than 30, 40, 45, 50, 55, 60, 70, 80, 90, 100, 120, 140, 160, 180, 200, 250, 300, 350, 400, 450, 500, 600, 700, 800, 900, 1,000, 1,500, 2,000, 2,500, 3,000, 3,500, 4,000, 4,500, 5,000, 5,500 nucleotides or at least 30, 40, 45, 50, 55, 60, 70, 80, 90, 100, 120, 140, 160, 180, 200, 250, 300, 350, 400, 450, 500, 600, 700, 800, 900, 1,000, 1,500, 2,000, 2,500, 3,000, 3,500, 4,000, 4,500, 5,000, 5,500 nucleotides).

According to the present invention, the tailing sequence of the IVT polynucleotide may range from absent to 500 nucleotides in length (e.g., at least 60, 70, 80, 90, 120, 140, 160, 180, 200, 250, 300, 350, 400, 450, or 500 nucleotides). Where the tailing region is a polyA tail, the length may be determined in units of or as a function of polyA Binding Protein binding. In this embodiment, the polyA tail is long enough to bind at least 4 monomers of PolyA Binding Protein. PolyA Binding Protein monomers bind to stretches of approximately 38 nucleotides. As such, it has been observed that polyA tails of about 80 nucleotides and 160 nucleotides are functional.

According to the present invention, the capping region of the IVT polynucleotide may comprise a single cap or a series of nucleotides forming the cap. In this embodiment the capping region may be from 1 to 10, e.g. 2-9, 3-8, 4-7, 1-5, 5-10, or at least 2, or 10 or fewer nucleotides in length. In some embodiments, the cap is absent.

According to the present invention, the first and second operational regions of the IVT polynucleotide may range from 3 to 40, e.g., 5-30, 10-20, 15, or at least 4, or 30 or fewer nucleotides in length and may comprise, in addition to a Start and/or Stop codon, one or more signal and/or restriction sequences.

In one embodiment, the IVT polynucleotides of the present invention may be structurally modified or chemically modified. When the IVT polynucleotides of the present invention are chemically and/or structurally modified the polynucleotides may be referred to as "modified IVT polynucleotides."

In one embodiment, if the IVT polynucleotides of the present invention are chemically modified they may have a uniform chemical modification of all or any of the same nucleoside type or a population of modifications produced by mere downward titration of the same starting modification in all or any of the same nucleoside type, or a measured percent of a chemical modification of all any of the same nucleoside type but with random incorporation, such as where all uridines are replaced by a uridine analog, e.g., pseudouridine. In another embodiment, the IVT polynucleotides may have a uniform chemical modification of two, three, or four of the same nucleoside type throughout the entire polynucleotide (such as all uridines and all cytosines, etc. are modified in the same way).

In one embodiment, the IVT polynucleotides of the present invention may include a sequence encoding a self-cleaving peptide, described herein, such as but not limited to the 2A peptide. The polynucleotide sequence of the 2A peptide in the IVT polynucleotide may be modified or codon optimized by the methods described herein and/or are known in the art.

In one embodiment, this sequence may be used to separate the coding region of two or more polypeptides of interest in the IVT polynucleotide.

In one embodiment, the IVT polynucleotide of the present invention may be structurally and/or chemically modified. When chemically modified and/or structurally modified the IVT polynucleotide may be referred to as a "modified IVT polynucleotide."

In one embodiment, the IVT polynucleotide may encode at least one peptide or polypeptide of interest. In another embodiment, the IVT polynucleotide may encode two or more peptides or polypeptides of interest. Non-limiting examples of peptides or polypeptides of interest include heavy and light chains of antibodies, an enzyme and its substrate, a label and its binding molecule, a second messenger and its enzyme or the components of multimeric proteins or complexes.

IVT polynucleotides (such as, but not limited to, primary constructs), formulations and compositions comprising IVT polynucleotides, and methods of making, using and administering IVT polynucleotides are described in U.S. Provisional Patent Application Nos. 61/618,862, 61/681,645, 61/737,130, 61/618,866, 61/681,647, 61/737,134, 61/618,868, 61/681,648, 61/737,135, 61/618,873, 61/681,650, 61/737,147, 61/618,878, 61/681,654, 61/737,152, 61/618,885, 61/681,658, 61/737,155, 61/618,896, 61/668,157, 61/681,661, 61/737,160, 61/618,911, 61/681,667, 61/737,168, 61/618,922, 61/681,675, 61/737,174, 61/618,935, 61/681,687, 61/737,184, 61/618,945, 61/681,696, 61/737,191, 61/618,953, 61/681,704, 61/737,203, 61/618,870, 61/681,649 and 61/737,139; International Publication Nos. WO2013151666, WO2013151667, WO2013151668, WO2013151663, WO2013151669, WO2013151670, WO2013151664, WO2013151665, WO2013151671, WO2013151672 and WO2013151736; the contents of each of which are herein incorporated by reference in their entireties.

In one embodiment, the IVT polynucleotide encodes a LDLR protein such as, but not limited to, a LDLR protein sequence comprising at least one mutation, e.g., a LDLR cell surface expression-enhancing mutation, a mutation increasing the residence time of LDLR at the cell surface or a mutation resulting in increased levels of LDLR at the cell surface.

Chimeric Polynucleotide Architecture

The chimeric polynucleotides or RNA constructs of the present invention maintain a modular organization similar to IVT polynucleotides, but the chimeric polynucleotides comprise one or more structural and/or chemical modifications or alterations which impart useful properties to the polynucleotide. As such, the chimeric polynucleotides which are modified mRNA molecules of the present invention are termed "chimeric modified mRNA" or "chimeric mRNA."

Chimeric polynucleotides have portions or regions which differ in size and/or chemical modification pattern, chemical modification position, chemical modification percent or chemical modification population and combinations of the foregoing.

Figure 3:
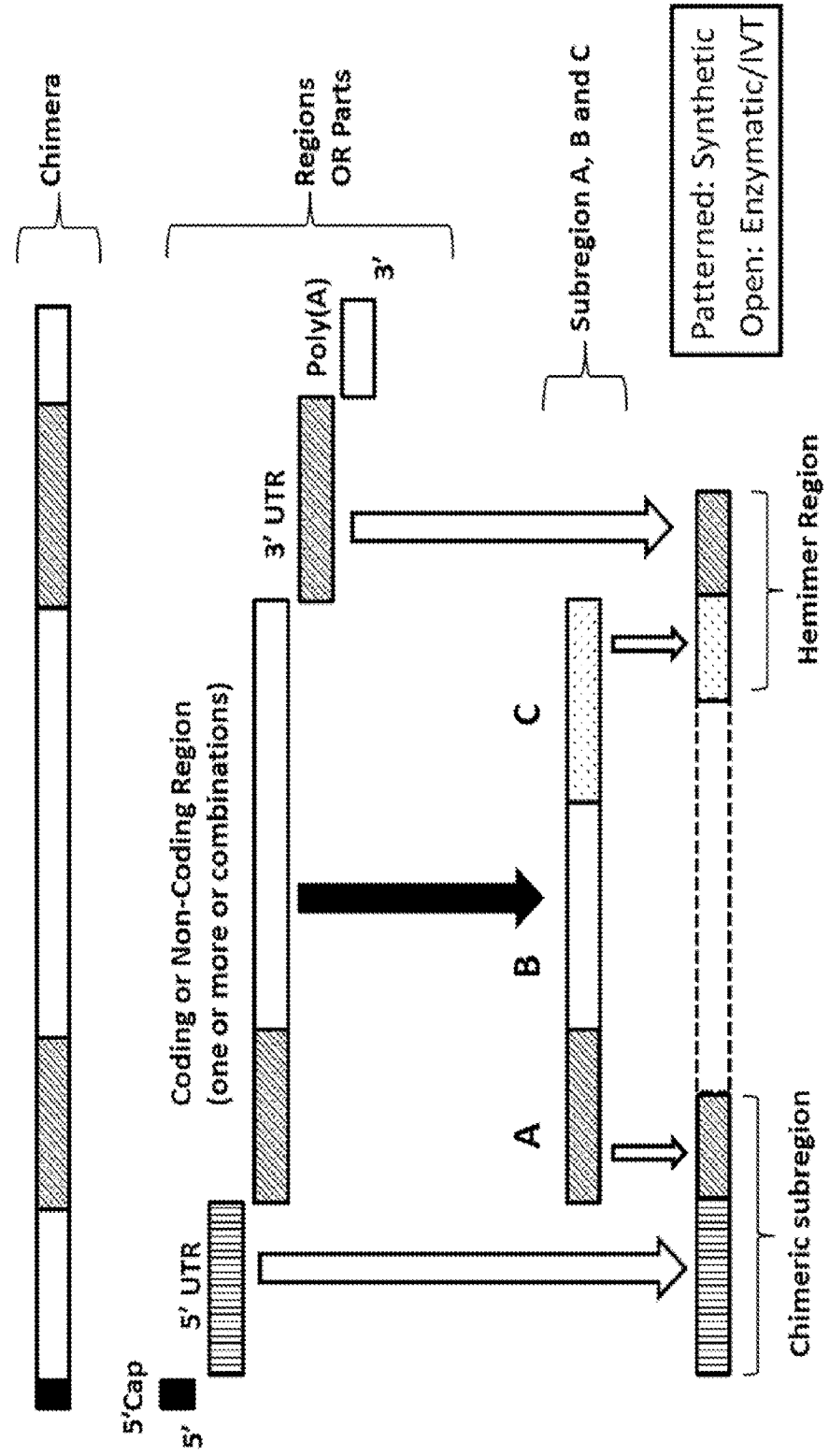
FIG. 3 is a schematic of a series of chimeric polynucleotides of the present invention.
Figure 4:
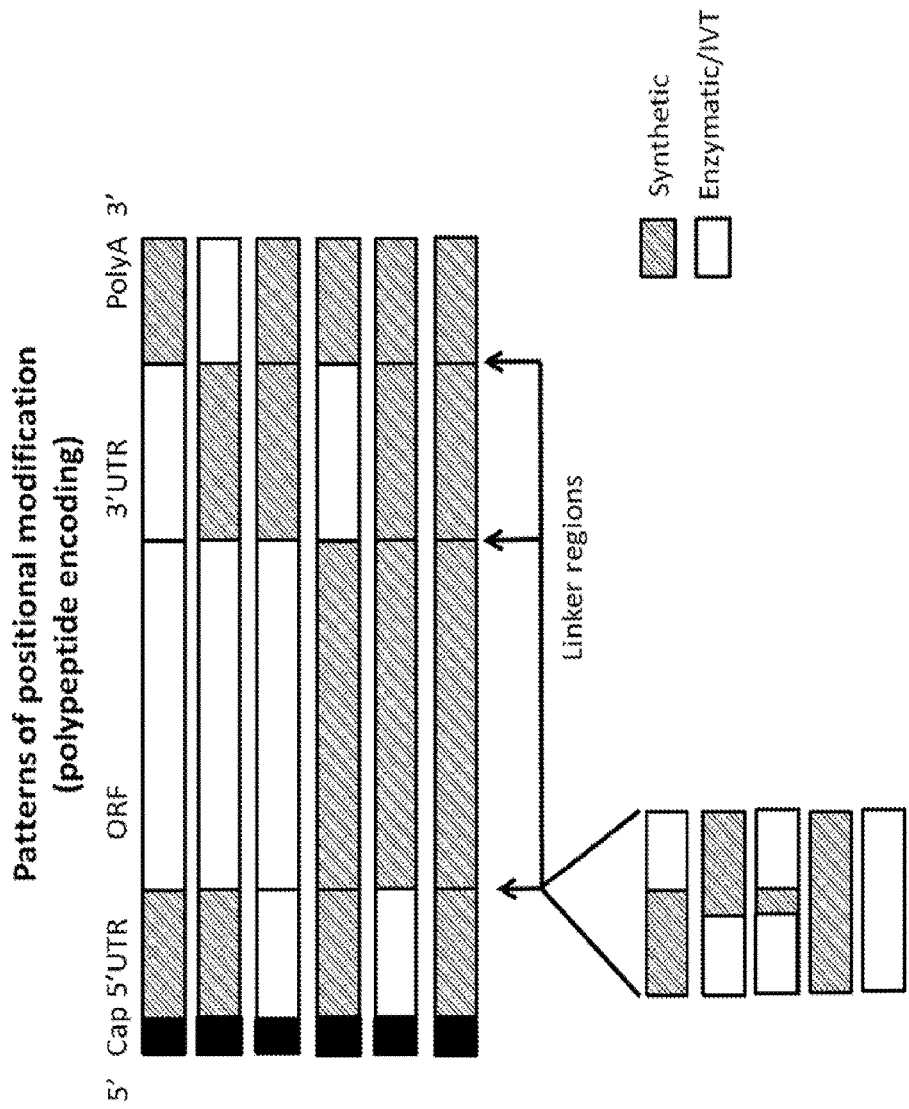
FIG. 4 is a schematic of a series of chimeric polynucleotides illustrating various patterns of positional modifications and showing regions analogous to those regions of an mRNA polynucleotide.

Examples of parts or regions, where the chimeric polynucleotide functions as an mRNA and encodes a polypeptide of interest include, but are not limited to, untranslated regions (UTRs, such as the 5' UTR or 3' UTR), coding regions, cap regions, polyA tail regions, start regions, stop regions, signal sequence regions, and combinations thereof. FIG. 3 illustrates certain embodiments of the chimeric polynucleotides of the invention which may be used as mRNA. FIG. 4 illustrates a schematic of a series of chimeric polynucleotides identifying various patterns of positional modifications and showing regions analogous to those regions of an mRNA polynucleotide. Regions or parts that join or lie between other regions may also be designed to have subregions. These are shown in the figure.

In some embodiments, the chimeric polynucleotides of the invention have a structure comprising Formula I.

$$5'[A_n]_x\text{-}L1\text{-}[B_o]_y\text{-}L2\text{-}[C_p]_z\text{-}L3\ 3'\qquad\text{Formula I}$$

wherein:

each of A and B independently comprise a region of linked nucleosides;

C is an optional region of linked nucleosides;

at least one of regions A, B, or C is positionally modified, wherein said positionally modified region comprises at least two chemically modified nucleosides of one or more of the same nucleoside type of adenosine, thymidine, guanosine, cytidine, or uridine, and wherein at least two of the chemical modifications of nucleosides of the same type are different chemical modifications;

n, o and p are independently an integer between 15-1000;

x and y are independently 1-20;

z is 0-5;

L1 and L2 are independently optional linker moieties, said linker moieties being either nucleic acid based or non-nucleic acid based; and L3 is an optional conjugate or an optional linker moiety, said linker moiety being either nucleic acid based or non-nucleic acid based.

In some embodiments the chimeric polynucleotide of Formula I encodes one or more peptides or polypeptides of interest. Such encoded molecules may be encoded across two or more regions.

In one embodiment, at least one of the regions of linked nucleosides of A may comprise a sequence of linked nucleosides which can function as a 5' untranslated region (UTR). The sequence of linked nucleosides may be a natural or synthetic 5' UTR. As a non-limiting example, the chimeric polynucleotide may encode a polypeptide of interest and the sequence of linked nucleosides of A may encode the native 5' UTR of a polypeptide encoded by the chimeric polynucleotide or the sequence of linked nucleosides may be a non-heterologous 5' UTR such as, but not limited to a synthetic UTR.

In another embodiment, at least one of the regions of linked nucleosides of A may be a cap region. The cap region may be located 5' to a region of linked nucleosides of A functioning as a 5'UTR. The cap region may comprise at least one cap such as, but not limited to, Cap0, Cap1, ARCA, inosine, N1-methyl-guanosine, 2'fluoro-guanosine, 7-deaza-guanosine, 8-oxo-guanosine, 2-amino-guanosine, LNA-guanosine, 2-azido-guanosine, Cap2 and Cap4.

In one embodiment, at least one of the regions of linked nucleosides of B may comprise at least one open reading frame of a nucleic acid sequence. The nucleic acid sequence may be codon optimized and/or comprise at least one modification.

In one embodiment, at least one of the regions of linked nucleosides of C may comprise a sequence of linked nucleosides which can function as a 3' UTR. The sequence of linked nucleosides may be a natural or synthetic 3' UTR. As a non-limiting example, the chimeric polynucleotide may encode a polypeptide of interest and the sequence of linked nucleosides of C may encode the native 3' UTR of a polypeptide encoded by the chimeric polynucleotide or the sequence of linked nucleosides may be a non-heterologous 3' UTR such as, but not limited to a synthetic UTR.

In one embodiment, at least one of the regions of linked nucleosides of A comprises a sequence of linked nucleosides which functions as a 5' UTR and at least one of the regions of linked nucleosides of C comprises a sequence of linked nucleosides which functions as a 3' UTR. In one embodiment, the 5' UTR and the 3' UTR may be from the same or different species. In another embodiment, the 5' UTR and the 3' UTR may encode the native untranslated regions from different proteins from the same or different species.

FIGS. 5 and 6 provide schematics of a series of chimeric polynucleotides illustrating various patterns of positional modifications based on Formula I as well as those having a blocked or structured 3' terminus.

Chimeric polynucleotides, including the parts or regions thereof, of the present invention may be classified as hemimers, gapmers, wingmers, or blockmers.

As used herein, a "hemimer" is chimeric polynucleotide comprising a region or part which comprises half of one pattern, percent, position or population of a chemical modification(s) and half of a second pattern, percent, position or population of a chemical modification(s). Chimeric polynucleotides of the present invention may also comprise hemimer subregions. In one embodiment, a part or region is 50% of one and 50% of another.

In one embodiment the entire chimeric polynucleotide can be 50% of one and 50% of the other. Any region or part of any chimeric polynucleotide of the invention may be a hemimer. Types of hemimers include pattern hemimers, population hemimers or position hemimers. By definition, hemimers are 50:50 percent hemimers.

As used herein, a "gapmer" is a chimeric polynucleotide having at least three parts or regions with a gap between the parts or regions. The "gap" can comprise a region of linked nucleosides or a single nucleoside which differs from the chimeric nature of the two parts or regions flanking it. The two parts or regions of a gapmer may be the same or different from each other.

As used herein, a "wingmer" is a chimeric polynucleotide having at least three parts or regions with a gap between the parts or regions. Unlike a gapmer, the two flanking parts or regions surrounding the gap in a wingmer are the same in degree or kind. Such similarity may be in the length of number of units of different modifications or in the number of modifications. The wings of a wingmer may be longer or shorter than the gap. The wing parts or regions may be 20, 30, 40, 50, 60 70, 80, 90 or 95% greater or shorter in length than the region which comprises the gap.

As used herein, a "blockmer" is a patterned polynucleotide where parts or regions are of equivalent size or number and type of modifications. Regions or subregions in a blockmer may be 50, 51, 52, 53, 54, 55, 56, 57, 58, 59, 60, 61 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 310, 320, 330, 340, 350, 360, 370, 380, 390, 400, 410, 420, 430, 440, 450, 460, 470, 480, 490 or 500, nucleosides long.

Chimeric polynucleotides, including the parts or regions thereof, of the present invention having a chemical modification pattern are referred to as "pattern chimeras." Pattern chimeras may also be referred to as blockmers. Pattern chimeras are those polynucleotides having a pattern of modifications within, across or among regions or parts.

Patterns of modifications within a part or region are those which start and stop within a defined region. Patterns of modifications across a part or region are those patterns which start in on part or region and end in another adjacent part or region. Patterns of modifications among parts or regions are those which begin and end in one part or region and are repeated in a different part or region, which is not necessarily adjacent to the first region or part.

The regions or subregions of pattern chimeras or blockmers may have simple alternating patterns such as ABAB [AB]n where each "A" and each "B" represent different chemical modifications (at least one of the base, sugar or backbone linker), different types of chemical modifications (e.g., naturally occurring and non-naturally occurring), different percentages of modifications or different populations of modifications. The pattern may repeat n number of times where n=3-300. Further, each A or B can represent from 1-2500 units (e.g., nucleosides) in the pattern. Patterns may also be alternating multiples such as AABBAABB[AABB]n (an alternating double multiple) or AAABBBAAABBB [AAABBB]n (an alternating triple multiple) pattern. The pattern may repeat n number of times where n=3-300.

Different patterns may also be mixed together to form a second order pattern. For example, a single alternating pattern may be combined with a triple alternating pattern to form a second order alternating pattern A'B'. One example would be [ABABAB] [AAABBBAAABBB] [ABABAB] [AAABBBAAABBB] [ABABAB][AAABBBAAABBB], where [ABABAB] is A' and [AAABBBAAABBB] is B'. In like fashion, these patterns may be repeated n number of times, where n=3-300.

Patterns may include three or more different modifications to form an ABCABC[ABC]n pattern. These three component patterns may also be multiples, such as AABBC-CAABBCC[AABBCC]n and may be designed as combinations with other patterns such as ABCABCAABBCCABCABCAABBCC, and may be higher order patterns.

Regions or subregions of position, percent, and population modifications need not reflect an equal contribution from each modification type. They may form series such as "1-2-3-4", "1-2-4-8", where each integer represents the number of units of a particular modification type. Alternatively, they may be odd only, such as '1-3-3-1-3-1-5" or even only "2-4-2-4-6-4-8" or a mixture of both odd and even number of units such as "1-3-4-2-5-7-3-3-4".

Pattern chimeras may vary in their chemical modification by degree (such as those described above) or by kind (e.g., different modifications).

Chimeric polynucleotides, including the parts or regions thereof, of the present invention having at least one region with two or more different chemical modifications of two or more nucleoside members of the same nucleoside type (A, C, G, T, or U) are referred to as "positionally modified" chimeras. Positionally modified chimeras are also referred to herein as "selective placement" chimeras or "selective placement polynucleotides". As the name implies, selective placement refers to the design of polynucleotides which, unlike polynucleotides in the art where the modification to any A, C, G, T or U is the same by virtue of the method of synthesis, can have different modifications to the individual As, Cs, Gs, Ts or Us in a polynucleotide or region thereof. For example, in a positionally modified chimeric polynucleotide, there may be two or more different chemical modifications to any of the nucleoside types of As, Cs, Gs, Ts, or Us. There may also be combinations of two or more to any two or more of the same nucleoside type. For example, a positionally modified or selective placement chimeric polynucleotide may comprise 3 different modifications to the population of adenines in the molecule and also have 3 different modifications to the population of cytosines in the construct—all of which may have a unique, non-random, placement.

Chimeric polynucleotides, including the parts or regions thereof, of the present invention having a chemical modification percent are referred to as "percent chimeras." Percent chimeras may have regions or parts which comprise at least 1%, at least 2%, at least 5%, at least 8%, at least 10%, at least 20%, at least 30%, at least 40%, at least 50%, at least 60%, at least 70%, at least 80%, at least 90%, at least 95%, or at least 99% positional, pattern or population of modifications. Alternatively, the percent chimera may be completely modified as to modification position, pattern, or population. The percent of modification of a percent chimera may be split between naturally occurring and non-naturally occurring modifications.

Chimeric polynucleotides, including the parts or regions thereof, of the present invention having a chemical modification population are referred to as "population chimeras." A population chimera may comprise a region or part where nucleosides (their base, sugar or backbone linkage, or combination thereof) have a select population of modifications. Such modifications may be selected from functional populations such as modifications which induce, alter or modulate a phenotypic outcome. For example, a functional population may be a population or selection of chemical modifications which increase the level of a cytokine. Other functional populations may individually or collectively function to decrease the level of one or more cytokines. Use of a selection of these like-function modifications in a chimeric polynucleotide would therefore constitute a "functional population chimera." As used herein, a "functional population chimera" may be one whose unique functional feature is defined by the population of modifications as described above or the term may apply to the overall function of the chimeric polynucleotide itself. For example, as a whole the chimeric polynucleotide may function in a different or superior way as compared to an unmodified or non-chimeric polynucleotide.

It should be noted that polynucleotides which have a uniform chemical modification of all of any of the same nucleoside type or a population of modifications produced by mere downward titration of the same starting modification in all of any of the same nucleoside type, or a measured percent of a chemical modification of all any of the same nucleoside type but with random incorporation, such as where all uridines are replaced by a uridine analog, e.g., pseudouridine, are not considered chimeric. Likewise, polynucleotides having a uniform chemical modification of two, three, or four of the same nucleoside type throughout the entire polynucleotide (such as all uridines and all cytosines, etc. are modified in the same way) are not considered chimeric polynucleotides. One example of a polynucleotide which is not chimeric is the canonical pseudouridine/5-methyl cytosine modified polynucleotide of the prior art. These uniform polynucleotides are arrived at entirely via in vitro transcription (IVT) enzymatic synthesis; and due to the limitations of the synthesizing enzymes, they contain only one kind of modification at the occurrence of each of the same nucleoside type, i.e., adenosine (A), thymidine (T), guanosine (G), cytidine (C) or uridine (U), found in the polynucleotide. Such polynucleotides may be characterized as IVT polynucleotides.

The chimeric polynucleotides of the present invention may be structurally modified or chemically modified. When the chimeric polynucleotides of the present invention are chemically and/or structurally modified the polynucleotides may be referred to as "modified chimeric polynucleotides."

In some embodiments of the invention, the chimeric polynucleotides may encode two or more peptides or polypeptides of interest. Such peptides or polypeptides of interest include the heavy and light chains of antibodies, an enzyme and its substrate, a label and its binding molecule, a second messenger and its enzyme or the components of multimeric proteins or complexes.

The regions or parts of the chimeric polynucleotides of the present invention may be separated by a linker or spacer moiety. Such linkers or spaces may be nucleic acid based or non-nucleosidic.

In one embodiment, the chimeric polynucleotides of the present invention may include a sequence encoding a self-cleaving peptide described herein, such as, but not limited to, a 2A peptide. The polynucleotide sequence of the 2A peptide in the chimeric polynucleotide may be modified or codon optimized by the methods described herein and/or are known in the art.

Notwithstanding the foregoing, the chimeric polynucleotides of the present invention may comprise a region or part which is not positionally modified or not chimeric as defined herein.

For example, a region or part of a chimeric polynucleotide may be uniformly modified at one or more A, T, C, G, or U but according to the invention, the polynucleotides will not be uniformly modified throughout the entire region or part.

Regions or parts of chimeric polynucleotides may be from 15-1000 nucleosides in length and a polynucleotide may have from 2-100 different regions or patterns of regions as described herein.

In one embodiment, chimeric polynucleotides encode one or more polypeptides of interest. In another embodiment, the chimeric polynucleotides are substantially non-coding. In another embodiment, the chimeric polynucleotides have both coding and non-coding regions and parts.

FIG. 3 illustrates the design of certain chimeric polynucleotides of the present invention when based on the scaffold of the polynucleotide of FIG. 1. Shown in the figure are the regions or parts of the chimeric polynucleotides where patterned regions represent those regions which are positionally modified and open regions illustrate regions which may or may not be modified but which are, when modified, uniformly modified. Chimeric polynucleotides of the present invention may be completely positionally modified or partially positionally modified. They may also have subregions which may be of any pattern or design. Shown in FIG. 3 are a chimeric subregion and a hemimer subregion.

In one embodiment, the shortest length of a region of the chimeric polynucleotide of the present invention encoding a peptide can be the length that is sufficient to encode for a dipeptide, a tripeptide, a tetrapeptide, a pentapeptide, a hexapeptide, a heptapeptide, an octapeptide, a nonapeptide, or a decapeptide. In another embodiment, the length may be sufficient to encode a peptide of 2-30 amino acids, e.g. 5-30, 10-30, 2-25, 5-25, 10-25, or 10-20 amino acids. The length may be sufficient to encode for a peptide of at least 11, 12, 13, 14, 15, 17, 20, 25 or 30 amino acids, or a peptide that is no longer than 40 amino acids, e.g. no longer than 35, 30, 25, 20, 17, 15, 14, 13, 12, 11 or 10 amino acids. Examples of dipeptides that the polynucleotide sequences can encode or include, but are not limited to, carnosine and anserine.

In one embodiment, the length of a region of the polynucleotide of the present invention encoding the peptide or polypeptide of interest is greater than about 30 nucleotides in length (e.g., at least or greater than about 35, 40, 45, 50, 55, 60, 70, 80, 90, 100, 120, 140, 160, 180, 200, 250, 300, 350, 400, 450, 500, 600, 700, 800, 850, 900, 1,000, 1,100, 1,200, 1,300, 1,400, 1,500, 1,600, 1,700, 1,800, 1,900, 2,000, 2,500, and 3,000, 4,000, 5,000, 6,000, 7,000, 8,000, 9,000, 10,000, 20,000, 30,000, 40,000, 50,000, 60,000, 70,000, 80,000, 90,000 or up to and including 100,000 nucleotides). As used herein, such a region may be referred to as a "coding region" or "region encoding."

In some embodiments, the polynucleotide such as chimeric polynucleotide includes from about 30 to about 100,000 nucleotides (e.g., from 30 to 50, from 30 to 100, from 30 to 250, from 30 to 500, from 30 to 1,000, from 30 to 1,500, from 30 to 3,000, from 30 to 5,000, from 30 to 7,000, from 30 to 10,000, from 30 to 25,000, from 30 to 50,000, from 30 to 70,000, from 100 to 250, from 100 to 500, from 100 to 1,000, from 100 to 1,500, from 100 to 3,000, from 100 to 5,000, from 100 to 7,000, from 100 to 10,000, from 100 to 25,000, from 100 to 50,000, from 100 to 70,000, from 100 to 100,000, from 500 to 1,000, from 500 to 1,500, from 500 to 2,000, from 500 to 3,000, from 500 to 5,000, from 500 to 7,000, from 500 to 10,000, from 500 to 25,000, from 500 to 50,000, from 500 to 70,000, from 500 to 100,000, from 1,000 to 1,500, from 1,000 to 2,000, from 1,000 to 3,000, from 1,000 to 5,000, from 1,000 to 7,000, from 1,000 to 10,000, from 1,000 to 25,000, from 1,000 to 50,000, from 1,000 to 70,000, from 1,000 to 100,000, from 1,500 to 3,000, from 1,500 to 5,000, from 1,500 to 7,000, from 1,500 to 10,000, from 1,500 to 25,000, from 1,500 to 50,000, from 1,500 to 70,000, from 1,500 to 100,000, from 2,000 to 3,000, from 2,000 to 5,000, from 2,000 to 7,000, from 2,000 to 10,000, from 2,000 to 25,000, from 2,000 to 50,000, from 2,000 to 70,000, from 2,000 to 100,000 and from 4,500 to 5,500).

According to the present invention, regions or subregions of the polynucleotides may also range independently from 15-1,000 nucleotides in length (e.g., greater than 30, 40, 45, 50, 55, 60, 70, 80, 90, 100, 110, 120, 130, 140, 150, 160, 170, 180, 190, 200, 225, 250, 275, 300, 325, 350, 375, 400, 425, 450, 475, 500, 550, 600, 650, 700, 750, 800, 850, 900 and 950 nucleotides or at least 30, 40, 45, 50, 55, 60, 70, 80, 90, 100, 110, 120, 130, 140, 150, 160, 170, 180, 190, 200, 225, 250, 275, 300, 325, 350, 375, 400, 425, 450, 475, 500, 550, 600, 650, 700, 750, 800, 850, 900, 950, 1,000, 2,000, 3,000, 4,000 and 5,000 nucleotides).

According to the present invention, regions or subregions of the polynucleotides may range from absent to 500 nucleotides in length (e.g., at least 60, 70, 80, 90, 100, 110, 120, 130, 140, 150, 160, 170, 180, 190, 200, 250, 300, 350, 400, 450, or 500 nucleotides). Where the region is a polyA tail, the length may be determined in units of or as a function of polyA Binding Protein binding. In this embodiment, the polyA tail is long enough to bind at least 4 monomers of PolyA Binding Protein. PolyA Binding Protein monomers bind to stretches of approximately 38 nucleotides. As such, it has been observed that polyA tails of about 80 nucleotides to about 160 nucleotides are functional. The chimeric polynucleotides of the present invention which function as an mRNA need not comprise a polyA tail.

According to the present invention, chimeric polynucleotides which function as an mRNA may have a capping region. The capping region may comprise a single cap or a series of nucleotides forming the cap. In this embodiment the capping region may be from 1 to 10, e.g. 2-9, 3-8, 4-7, 1-5, 5-10, or at least 2, or 10 or fewer nucleotides in length. In some embodiments, the cap is absent.

The present invention contemplates chimeric polynucleotides which are circular or cyclic. As the name implies circular polynucleotides are circular in nature meaning that the termini are joined in some fashion, whether by ligation, covalent bond, common association with the same protein or other molecule or complex or by hybridization. Any of the circular polynucleotides as taught in for example International Patent Application No. PCT/US2014/53904 the contents of which are incorporated herein by reference in their entirety, may be made chimeric according to the present invention.

Chimeric polynucleotides, formulations and compositions comprising chimeric polynucleotides, and methods of making, using and administering chimeric polynucleotides are also described in co-pending International Patent Application No. PCT/US2014/53907, the contents of which is incorporated by reference in its entirety.

Circular Polynucleotide Architecture

The present invention contemplates polynucleotides which are circular or cyclic. As the name implies circular polynucleotides are circular in nature meaning that the termini are joined in some fashion, whether by ligation, covalent bond, common association with the same protein or other molecule or complex or by hybridization. Any of the circular polynucleotides as taught in for example International Patent Application No. PCT/US2014/053904, filed Sep. 3, 2014, the contents of which are incorporated herein by reference in their entirety.

Circular polynucleotides of the present invention may be designed according to the circular RNA construct scaffolds shown in FIGS. 7-13. Such polynucleotides are circular polynucleotides or circular constructs.

The circular polynucleotides or circPs of the present invention which encode at least one peptide or polypeptide of interest are known as circular RNAs or circRNA. As used herein, "circular RNA" or "circRNA" means a circular polynucleotide that can encode at least one peptide or polypeptide of interest. The circPs of the present invention which comprise at least one sensor sequence and do not encode a peptide or polypeptide of interest are known as circular sponges or circSP. As used herein, "circular sponges," "circular polynucleotide sponges" or "circSP" means a circular polynucleotide which comprises at least one sensor sequence and does not encode a polypeptide of interest. As used herein, "sensor sequence" means a receptor or pseudo-receptor for endogenous nucleic acid binding molecules. Non-limiting examples of sensor sequences include, microRNA binding sites, microRNA seed sequences, microRNA binding sites without the seed sequence, transcription factor binding sites and artificial binding sites engineered to act as pseudo-receptors and portions and fragments thereof.

The circPs of the present invention which comprise at least one sensor sequence and encode at least one peptide or polypeptide of interest are known as circular RNA sponges or circRNA-SP. As used herein, "circular RNA sponges" or "circRNA-SP" means a circular polynucleotide which comprises at least one sensor sequence and at least one region encoding at least one peptide or polypeptide of interest.

Figure 7:
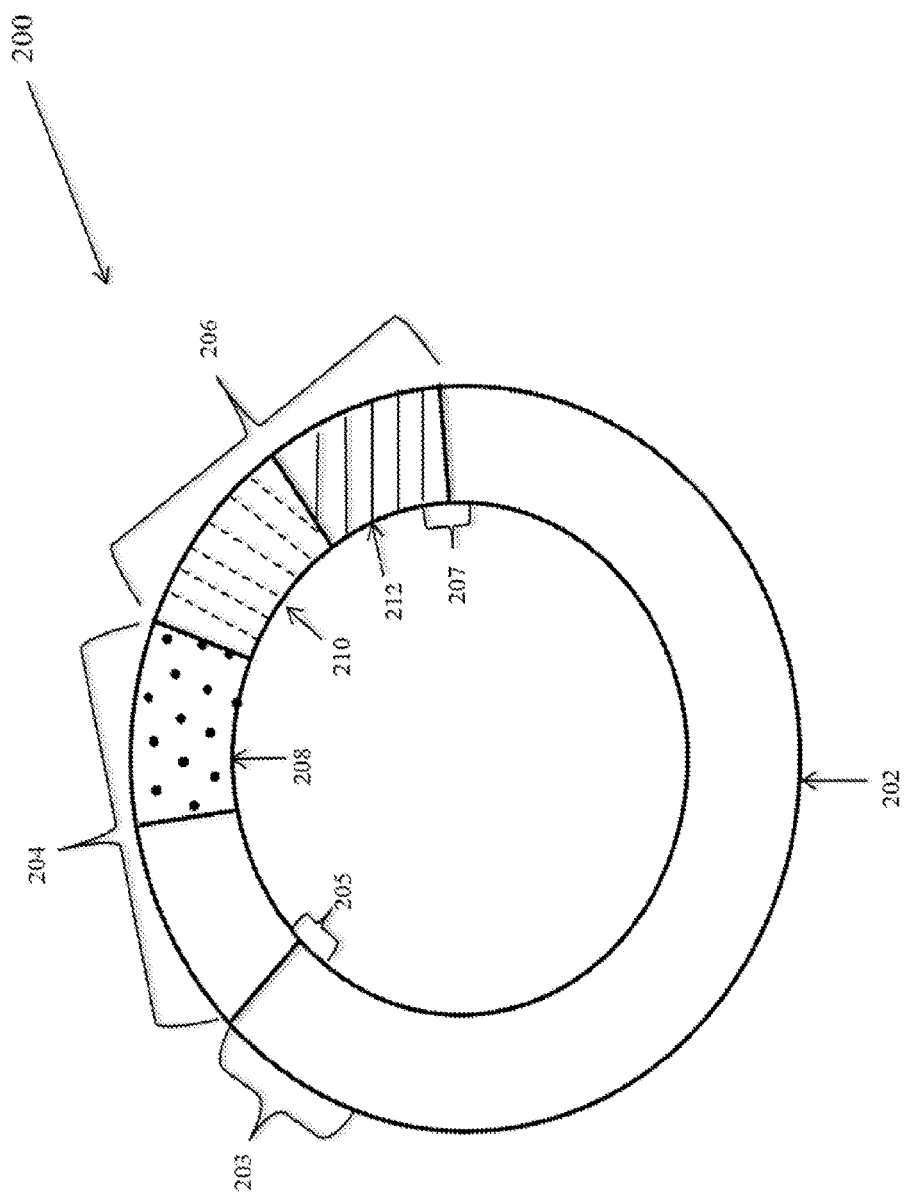
FIG. 7 is a schematic of a circular polynucleotide construct of the present invention.

FIG. 7 shows a representative circular construct 200 of the circular polynucleotides of the present invention. As used herein, the term "circular construct" refers to a circular polynucleotide transcript which may act substantially similar to and have properties of a RNA molecule. In one embodiment the circular construct acts as an mRNA. If the circular construct encodes one or more peptides or polypeptides of interest (e.g., a circRNA or circRNA-SP) then the polynucleotide transcript retains sufficient structural and/or chemical features to allow the polypeptide of interest encoded therein to be translated. Circular constructs may be polynucleotides of the invention. When structurally or chemically modified, the construct may be referred to as a modified circP, modified circSP, modified circRNA or modified circRNA-SP.

Returning to FIG. 7, the circular construct 200 here contains a first region of linked nucleotides 202 that is flanked by a first flanking region 204 and a second flanking region 206. As used herein, the "first region" may be referred to as a "coding region," a "non-coding region" or "region encoding" or simply the "first region." In one embodiment, this first region may comprise nucleotides such as, but is not limited to, encoding at least one peptide or polypeptide of interest and/or nucleotides encoding a sensor region. The peptide or polypeptide of interest may comprise at its 5' terminus one or more signal peptide sequences encoded by a signal peptide sequence region 203. The first flanking region 204 may comprise a region of linked nucleosides or portion thereof which may act similarly to an untranslated region (UTR) in a mRNA and/or DNA sequence. The first flanking region may also comprise a region of polarity 208. The region of polarity 208 may include an IRES sequence or portion thereof. As a non-limiting example, when linearlized this region may be split to have a first portion be on the 5' terminus of the first region 202 and second portion be on the 3' terminus of the first region 202. The second flanking region 206 may comprise a tailing sequence region 210 and may comprise a region of linked nucleotides or portion thereof 212 which may act similarly to a UTR in a mRNA and/or DNA.

Bridging the 5' terminus of the first region 202 and the first flanking region 204 is a first operational region 205. In one embodiment, this operational region may comprise a start codon. The operational region may alternatively comprise any translation initiation sequence or signal including a start codon.

Bridging the 3' terminus of the first region 202 and the second flanking region 206 is a second operational region 207. Traditionally this operational region comprises a stop codon. The operational region may alternatively comprise any translation initiation sequence or signal including a stop codon. According to the present invention, multiple serial stop codons may also be used. In one embodiment, the operation region of the present invention may comprise two stop codons. The first stop codon may be "TGA" or "UGA" and the second stop codon may be selected from the group consisting of "TAA," "TGA," "TAG," "UAA," "UGA" or "UAG."

Figure 8:
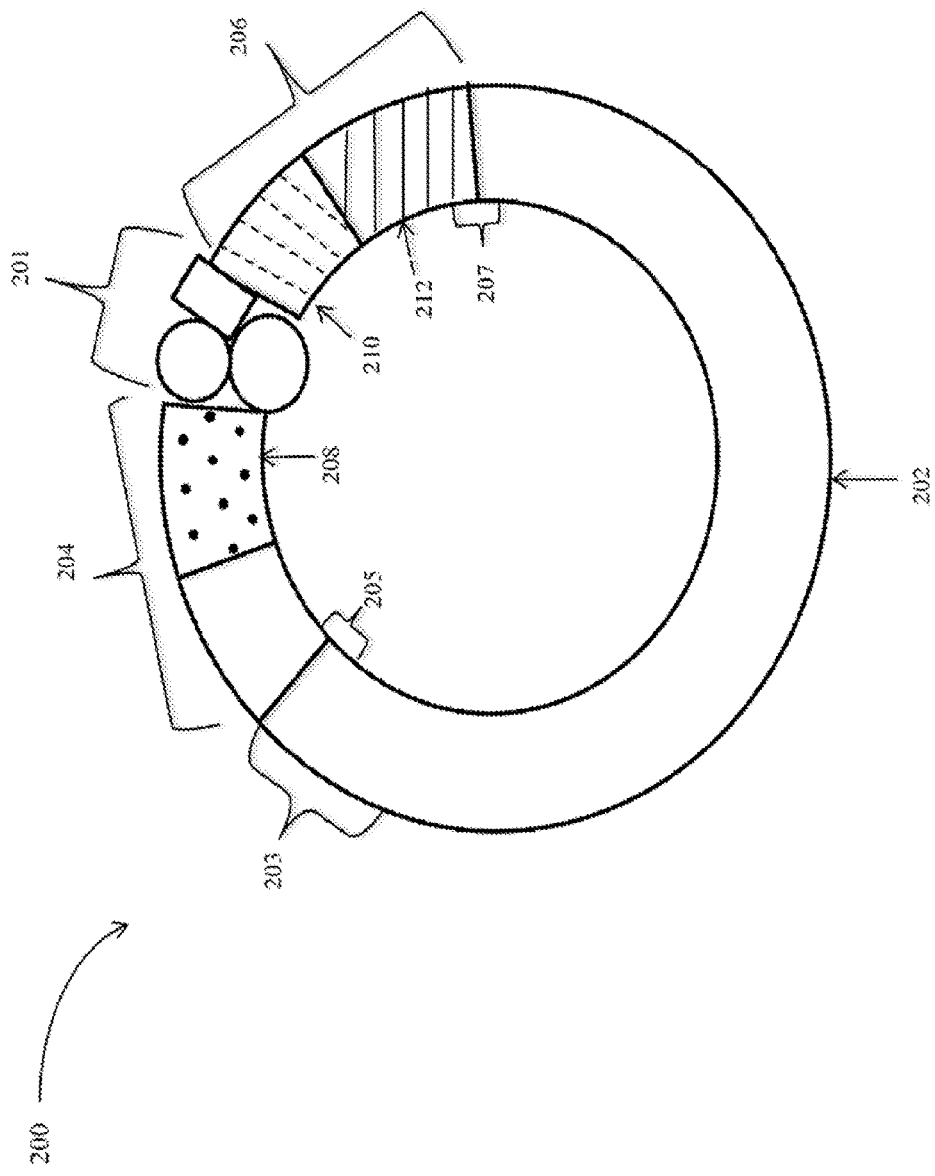
FIG. 8 is a schematic of a circular polynucleotide construct of the present invention.

Turning to FIG. 8, at least one non-nucleic acid moiety 201 may be used to prepare a circular construct 200 where the non-nucleic acid moiety 201 is used to bring the first flanking region 204 near the second flanking region 206. Non-limiting examples of non-nucleic acid moieties which may be used in the present invention are described herein. The circular construct 200 may comprise more than one non-nucleic acid moiety wherein the additional non-nucleic acid moieties may be heterologous or homologous to the first non-nucleic acid moiety.

Figure 9:
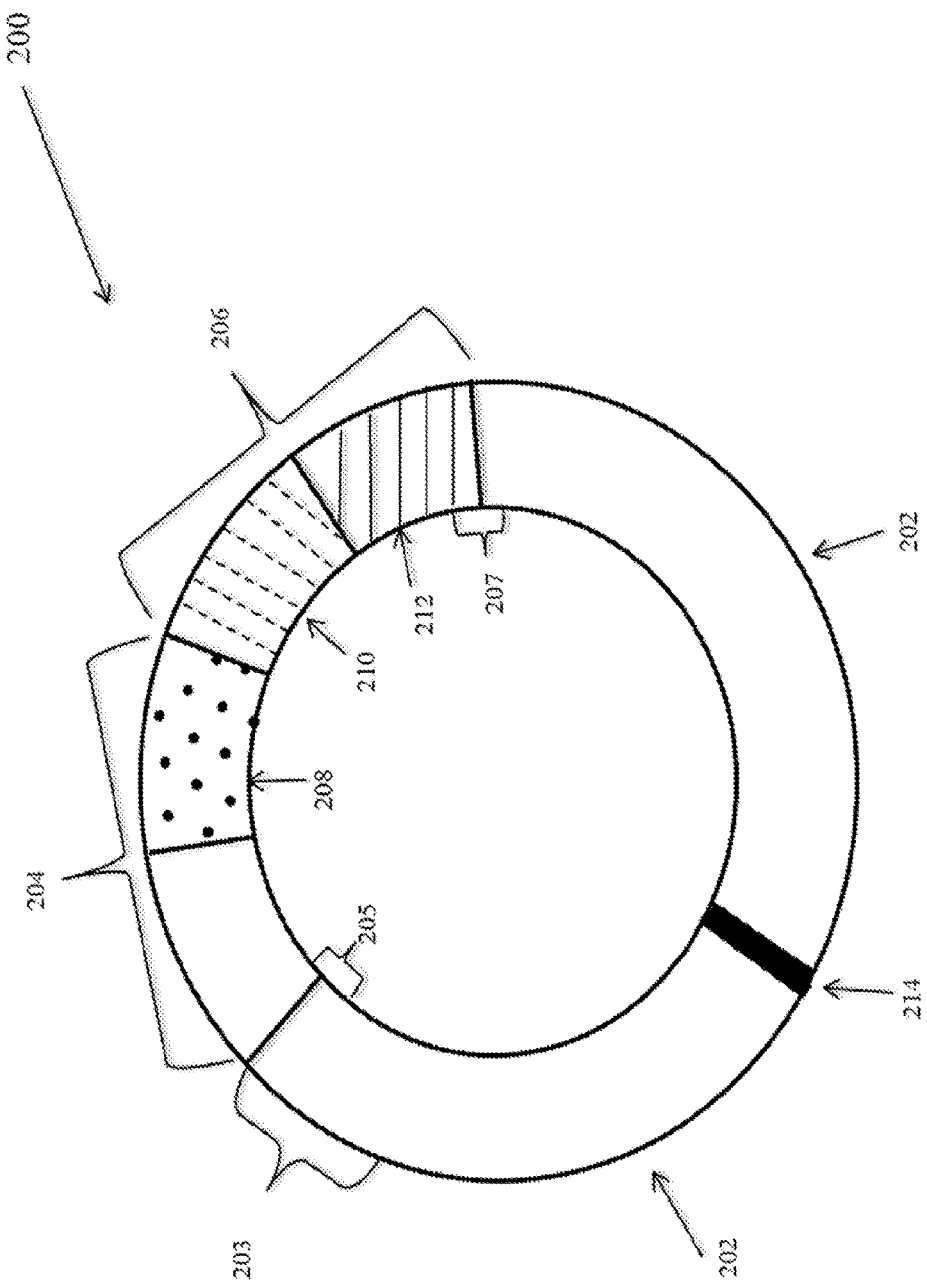
FIG. 9 is a schematic of a circular polynucleotide construct of the present invention comprising at least one spacer region.

Turning to FIG. 9, the first region of linked nucleosides 202 may comprise a spacer region 214. This spacer region 214 may be used to separate the first region of linked nucleosides 202 so that the circular construct can include more than one open reading frame, non-coding region or an open reading frame and a non-coding region.

Figure 10:
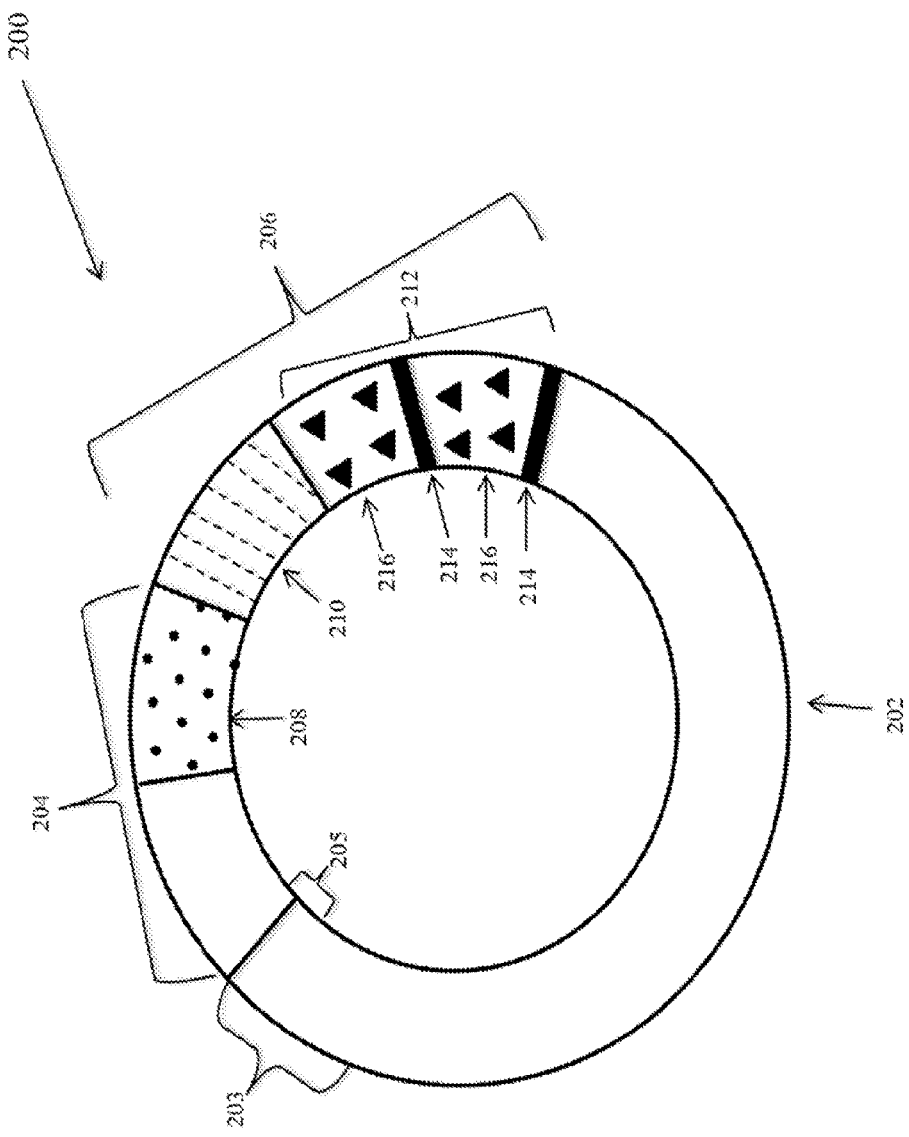
FIG. 10 is a schematic of a circular polynucleotide construct of the present invention comprising at least one sensor region.

Turning to FIG. 10, the second flanking region 206 may comprise one or more sensor regions 216 in the 3'UTR 212. These sensor sequences as discussed herein operate as pseudo-receptors (or binding sites) for ligands of the local microenvironment of the circular construct. For example, microRNA binding sites or miRNA seeds may be used as sensors such that they function as pseudoreceptors for any microRNAs present in the environment of the circular polynucleotide. As shown in FIG. 9, the one or more sensor regions 216 may be separated by a spacer region 214.

Figure 11:
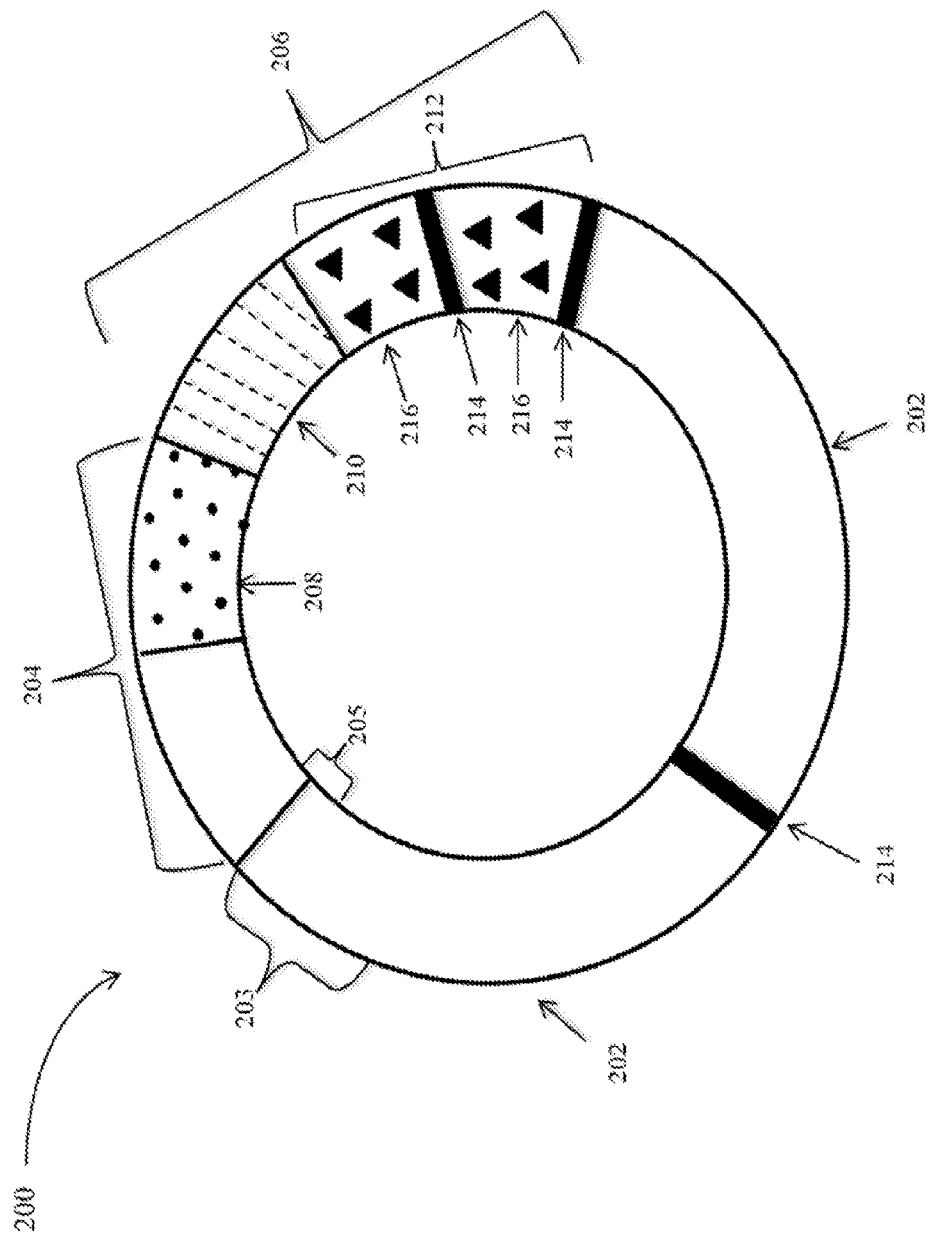
FIG. 11 is a schematic of a circular polynucleotide construct of the present invention comprising at least one sensor region and a spacer region.

As shown in FIG. 11, a circular construct 200, which includes one or more sensor regions 216, may also include a spacer region 214 in the first region of linked nucleosides 202. As discussed above for FIG. 7, this spacer region 214 may be used to separate the first region of linked nucleosides 202 so that the circular construct can include more than one open reading frame and/or more than one non-coding region.

Figure 12:
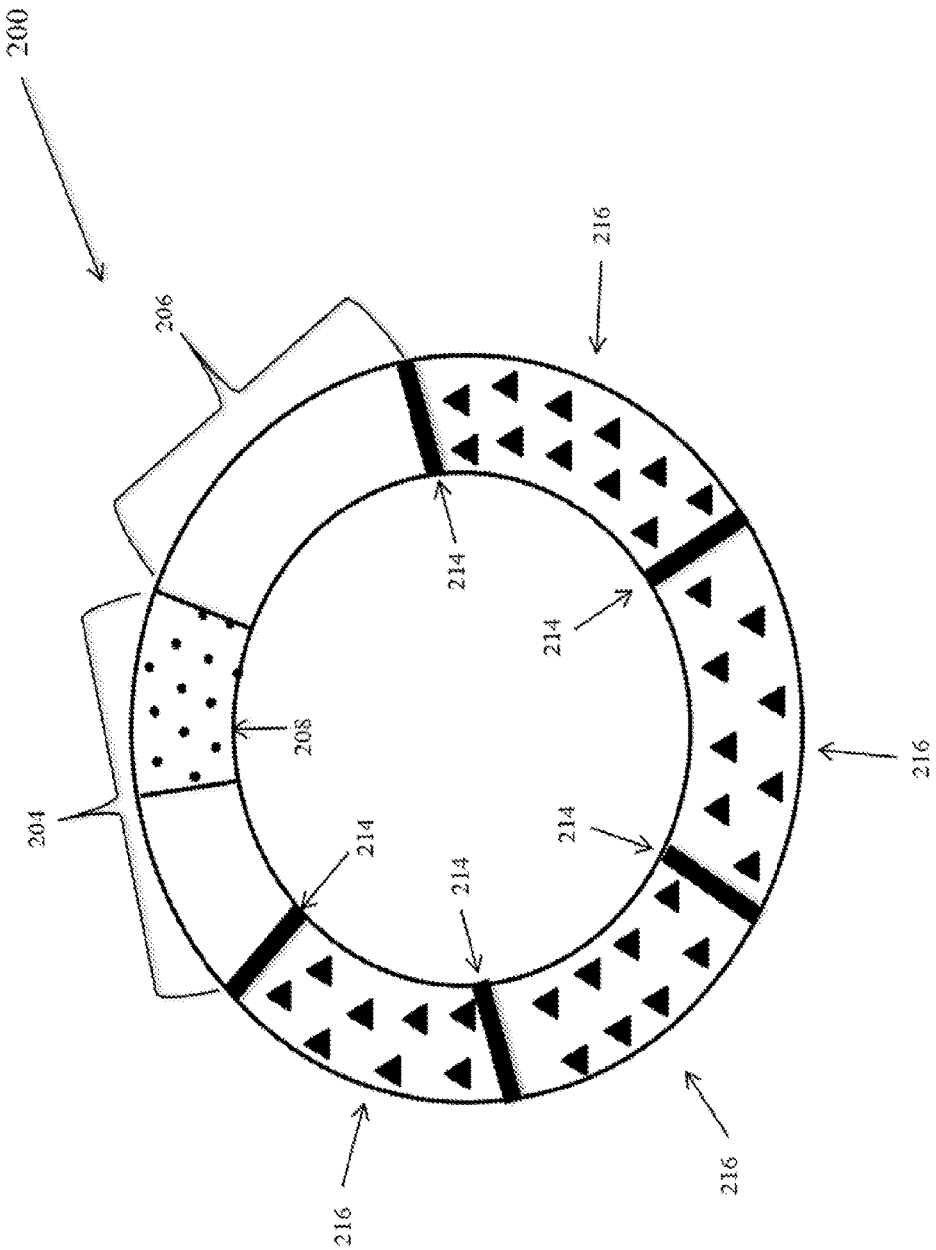
FIG. 12 is a schematic of a non-coding circular polynucleotide construct of the present invention.

Turning to FIG. 12, a circular construct 200 may be a non-coding construct known as a circSP comprising at least one non-coding region such as, but not limited to, a sensor region 216. Each of the sensor regions 216 may include, but are not limited to, a miR sequence, a miR seed, a miR binding site and/or a miR sequence without the seed.

Figure 13:
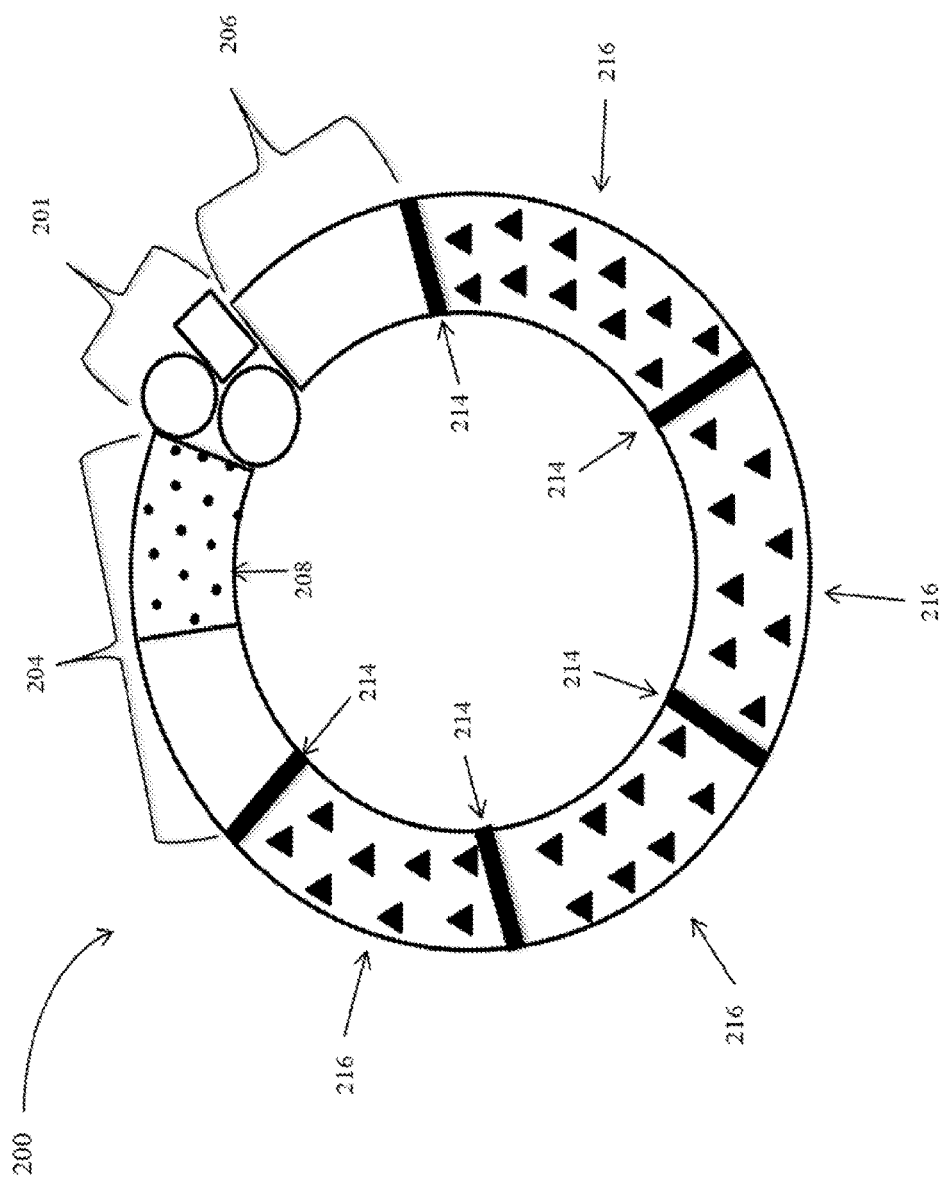
FIG. 13 is a schematic of a non-coding circular polynucleotide construct of the present invention.

Turning to FIG. 13, at least one non-nucleic acid moiety 201 may be used to prepare a circular construct 200 which is a non-coding construct. The circular construct 200 which is a non-coding construct may comprise more than one non-nucleic acid moiety wherein the additional non-nucleic acid moieties may be heterologous or homologous to the first non-nucleic acid moiety.

Circular polynucleotides, formulations and compositions comprising circular polynucleotides, and methods of making, using and administering circular polynucleotides are also described in co-pending International Patent Application No. PCT/US2014/53904 the contents of which is incorporated by reference in its entirety.

Multimers of Polynucleotides

According to the present invention, multiple distinct chimeric polynucleotides and/or IVT polynucleotides may be linked together through the 3'-end using nucleotides which are modified at the 3'-terminus. Chemical conjugation may be used to control the stoichiometry of delivery into cells. For example, the glyoxylate cycle enzymes, isocitrate lyase and malate synthase, may be supplied into cells at a 1:1 ratio to alter cellular fatty acid metabolism. This ratio may be controlled by chemically linking chimeric polynucleotides and/or IVT polynucleotides using a 3'-azido terminated nucleotide on one polynucleotides species and a C5-ethynyl or alkynyl-containing nucleotide on the opposite polynucleotide species. The modified nucleotide is added post-transcriptionally using terminal transferase (New England Biolabs, Ipswich, Mass.) according to the manufacturer's protocol. After the addition of the 3'-modified nucleotide, the two polynucleotides species may be combined in an aqueous solution, in the presence or absence of copper, to form a new covalent linkage via a click chemistry mechanism as described in the literature.

In another example, more than two chimeric polynucleotides and/or IVT polynucleotides may be linked together using a functionalized linker molecule. For example, a functionalized saccharide molecule may be chemically modified to contain multiple chemical reactive groups ($SH-$, $NH_2-$, $N_3$, etc. . . . ) to react with the cognate moiety on a 3'-functionalized mRNA molecule (i.e., a 3'-maleimide ester, 3'-NHS-ester, alkynyl). The number of reactive groups on the modified saccharide can be controlled in a stoichiometric fashion to directly control the stoichiometric ratio of conjugated chimeric polynucleotides and/or IVT polynucleotides.

In one embodiment, the chimeric polynucleotides and/or IVT polynucleotides may be linked together in a pattern. The pattern may be a simple alternating pattern such as $CD[CD]_x$ where each "C" and each "D" represent a chimeric polynucleotide, IVT polynucleotide, different chimeric polynucleotides or different IVT polynucleotides. The pattern may repeat x number of times, where x=1-300. Patterns may also be alternating multiples such as $CCDD[CCDD]_x$ (an alternating double multiple) or $CCCDDD[CCCDDD]_x$ (an alternating triple multiple) pattern. The alternating double multiple or alternating triple multiple may repeat x number of times, where x=1-300.

Conjugates and Combinations of Polynucleotides

In order to further enhance protein production, polynucleotides of the present invention can be designed to be conjugated to other polynucleotides, dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g. biotin), transport/absorption facilitators (e.g., aspirin, vitamin E, folic acid), synthetic ribonucleases, proteins, e.g., glycoproteins, or peptides, e.g., molecules having a specific affinity for a co-ligand, or antibodies e.g., an antibody, that binds to a specified cell type such as a cancer cell, endothelial cell, or bone cell, hormones and hormone receptors, non-peptidic species, such as lipids, lectins, carbohydrates, vitamins, cofactors, or a drug.

Conjugation may result in increased stability and/or half life and may be particularly useful in targeting the polynucleotides to specific sites in the cell, tissue or organism.

According to the present invention, the polynucleotides may be administered with, conjugated to or further encode one or more of RNAi agents, siRNAs, shRNAs, miRNAs, miRNA binding sites, antisense RNAs, ribozymes, catalytic DNA, tRNA, RNAs that induce triple helix formation, aptamers or vectors, and the like.

The nanoparticle formulations may comprise a phosphate conjugate. The phosphate conjugate may increase in vivo circulation times and/or increase the targeted delivery of the nanoparticle. Phosphate conjugates for use with the present invention may be made by the methods described in International Application No. WO2013033438 or US Patent Publication No. US20130196948, the contents of each of which are herein incorporated by reference in its entirety. As a non-limiting example, the phosphate conjugates may include a compound of any one of the formulas described in International Application No. WO2013033438, herein incorporated by reference in its entirety.

The nanoparticle formulation may comprise a polymer conjugate. The polymer conjugate may be a water soluble conjugate. The polymer conjugate may have a structure as described in U.S. Patent Application No. 20130059360, the contents of which are herein incorporated by reference in its entirety. In one aspect, polymer conjugates with the polynucleotides of the present invention may be made using the methods and/or segmented polymeric reagents described in U.S. Patent Application No. 20130072709, herein incorporated by reference in its entirety. In another aspect, the polymer conjugate may have pendant side groups comprising ring moieties such as, but not limited to, the polymer conjugates described in US Patent Publication No. US20130196948, the contents of which is herein incorporated by reference in its entirety.

The nanoparticle formulations may comprise a conjugate to enhance the delivery of nanoparticles of the present invention in a subject. Further, the conjugate may inhibit phagocytic clearance of the nanoparticles in a subject. In one aspect, the conjugate may be a "self" peptide designed from the human membrane protein CD47 (e.g., the "self" particles described by Rodriguez et al (Science 2013 339, 971-975), herein incorporated by reference in its entirety). As shown by Rodriguez et al. the self peptides delayed macrophage-mediated clearance of nanoparticles which enhanced delivery of the nanoparticles. In another aspect, the conjugate may be the membrane protein CD47 (e.g., see Rodriguez et al. Science 2013 339, 971-975, herein incorporated by reference in its entirety). Rodriguez et al. showed that, similarly to "self" peptides, CD47 can increase the circulating particle ratio in a subject as compared to scrambled peptides and PEG coated nanoparticles.

In one embodiment, the polynucleotides of the present invention are formulated in nanoparticles which comprise a conjugate to enhance the delivery of the nanoparticles of the present invention in a subject. The conjugate may be the CD47 membrane or the conjugate may be derived from the CD47 membrane protein, such as the "self" peptide described previously. In another aspect the nanoparticle may comprise PEG and a conjugate of CD47 or a derivative thereof. In yet another aspect, the nanoparticle may comprise both the "self" peptide described above and the membrane protein CD47.

In another aspect, a "self" peptide and/or CD47 protein may be conjugated to a virus-like particle or pseudovirion, as described herein for delivery of the polynucleotides of the present invention.

In another embodiment, pharmaceutical compositions comprising the polynucleotides of the present invention and a conjugate which may have a degradable linkage. Non-limiting examples of conjugates include an aromatic moiety comprising an ionizable hydrogen atom, a spacer moiety, and a water-soluble polymer. As a non-limiting example, pharmaceutical compositions comprising a conjugate with a degradable linkage and methods for delivering such pharmaceutical compositions are described in US Patent Publication No. US20130184443, the contents of which are herein incorporated by reference in its entirety.

Bifunctional Polynucleotides

In one embodiment of the invention are bifunctional polynucleotides (e.g., bifunctional IVT polynucleotides, bifunctional chimeric polynucleotides or bifunctional circular polynucleotides). As the name implies, bifunctional polynucleotides are those having or capable of at least two functions. These molecules may also by convention be referred to as multi-functional.

The multiple functionalities of bifunctional polynucleotides may be encoded by the RNA (the function may not manifest until the encoded product is translated) or may be a property of the polynucleotide itself. It may be structural or chemical. Bifunctional modified polynucleotides may comprise a function that is covalently or electrostatically associated with the polynucleotides. Further, the two functions may be provided in the context of a complex of a chimeric polynucleotide and another molecule.

Bifunctional polynucleotides may encode peptides which are anti-proliferative. These peptides may be linear, cyclic, constrained or random coil. They may function as aptamers, signaling molecules, ligands or mimics or mimetics thereof. Anti-proliferative peptides may, as translated, be from 3 to 50 amino acids in length. They may be 5-40, 10-30, or approximately 15 amino acids long. They may be single chain, multichain or branched and may form complexes, aggregates or any multi-unit structure once translated.

Noncoding Polynucleotides

As described herein, the polynucleotides described herein may comprise sequences that are partially or substantially not translatable, e.g., having a noncoding region. As one non-limiting example, the noncoding region may be the first region of the IVT polynucleotide or the circular polynucleotide. Alternatively, the noncoding region may be a region other than the first region. As another non-limiting example, the noncoding region may be the A, B and/or C region of the chimeric polynucleotide.

Such molecules are generally not translated, but can exert an effect on protein production by one or more of binding to and sequestering one or more translational machinery components such as a ribosomal protein or a transfer RNA (tRNA), thereby effectively reducing protein expression in the cell or modulating one or more pathways or cascades in a cell which in turn alters protein levels. The polynucleotide may contain or encode one or more long noncoding RNA (lncRNA, or lincRNA) or portion thereof, a small nucleolar RNA (sno-RNA), micro RNA (miRNA), small interfering RNA (siRNA) or Piwi-interacting RNA (piRNA). Examples of such lncRNA molecules and RNAi constructs designed to target such lncRNA any of which may be encoded in the polynucleotides are taught in International Publication, WO2012/018881 A2, the contents of which are incorporated herein by reference in their entirety.

Polypeptides of Interest

Polynucleotides of the present invention may encode one or more peptides or polypeptides of interest. The peptides or polypeptides of interest may comprise at least one mutation, e.g., a LDLR cell surface expression-enhancing mutation, a mutation increasing the residence time of LDLR at the cell surface or a mutation resulting in increased levels of LDLR at the cell surface. As a non-limiting example, the peptides or polypeptides of interest may be a LDLR protein comprising at least two mutations, e.g., a LDLR cell surface expression-enhancing mutation, a mutation increasing the residence time of LDLR at the cell surface or a mutation resulting in increased levels of LDLR at the cell surface. The polynucleotides of the present invention may also affect the levels, signaling or function of one or more peptides or polypeptides. Polypeptides of interest, include LDLR, wild type LDLR and LDLR mutants and any of those taught in Table 3, 10 and 11 herein or, for example, those listed in Table 6 of U.S. Provisional Patent Application Nos. 61/618,862, 61/681,645, 61/737,130, 61/618,866, 61/681,647, 61/737,134, 61/618,868, 61/681,648, 61/737,135, 61/618,873, 61/681,650, 61/737,147, 61/618,878, 61/681,654, 61/737,152, 61/618,885, 61/681,658, 61/737,155, 61/618,896, 61/668,157, 61/681,661, 61/737,160, 61/618,911, 61/681,667, 61/737,168, 61/618,922, 61/681,675, 61/737,174, 61/618,935, 61/681,687, 61/737,184, 61/618,945, 61/681,696, 61/737,191, 61/618,953, 61/681,704, 61/737,203; Table 6 and 7 of U.S. Provisional Patent Application Nos. 61/681,720, 61/737,213, 61/681,742; Table 6 of International Publication Nos. WO2013151666, WO2013151668, WO2013151663, WO2013151669, WO2013151670, WO2013151664, WO2013151665, WO2013151736; Tables 6 and 7 International Publication No. WO2013151672; Tables 6, 178 and 179 of International Publication No. WO2013151671; Tables 6, 28 and 29 of U.S. Provisional Patent Application No. 61/618,870; Tables 6, 56 and 57 of U.S. Provisional Patent Application No. 61/681,649; Tables 6, 186 and 187 U.S. Provisional Patent Application No. 61/737,139; Tables 6, 185 and 186 of International Publication No WO2013151667; the contents of each of which are herein incorporated by reference in their entireties.

According to the present invention, the polynucleotide may be designed to encode one or more polypeptides of interest or fragments thereof. Such polypeptide of interest may include, but is not limited to, whole polypeptides, a plurality of polypeptides or fragments of polypeptides, which independently may be encoded by one or more regions or parts or the whole of a polynucleotide. As used herein, the term "polypeptides of interest" refer to any polypeptide which is selected to be encoded within, or whose function is affected by, the polynucleotides of the present invention.

As used herein, "polypeptide" means a polymer of amino acid residues (natural or unnatural) linked together most often by peptide bonds. The term, as used herein, refers to proteins, polypeptides, and peptides of any size, structure, or function. In some instances the polypeptide encoded is smaller than about 50 amino acids and the polypeptide is then termed a peptide. If the polypeptide is a peptide, it will be at least about 2, 3, 4, or at least 5 amino acid residues long. Thus, polypeptides include gene products, naturally occurring polypeptides, synthetic polypeptides, homologs, orthologs, paralogs, fragments and other equivalents, variants, and analogs of the foregoing. A polypeptide may be a single molecule or may be a multi-molecular complex such as a dimer, trimer or tetramer. They may also comprise single chain or multichain polypeptides such as antibodies or insulin and may be associated or linked. Most commonly disulfide linkages are found in multichain polypeptides. The term polypeptide may also apply to amino acid polymers in which one or more amino acid residues are an artificial chemical analogue of a corresponding naturally occurring amino acid.

The term "polypeptide variant" refers to molecules which differ in their amino acid sequence from a native or reference sequence. The amino acid sequence variants may possess substitutions, deletions, and/or insertions at certain positions within the amino acid sequence, as compared to a native or reference sequence. Ordinarily, variants will possess at least about 50% identity (homology), at least about 60% identity, at least about 70% identity, at least about 80% identity, at least about 90% identity, at least about 95% identity, at least about 99% identity to a native or reference sequence. Preferably, they will be at least about 80%, more preferably at least about 90% identical (homologous) to a native or reference sequence.

In some embodiments "variant mimics" are provided. As used herein, the term "variant mimic" is one which contains one or more amino acids which would mimic an activated sequence. For example, glutamate may serve as a mimic for phosphoro-threonine and/or phosphoro-serine. Alternatively, variant mimics may result in deactivation or in an inactivated product containing the mimic, e.g., phenylalanine may act as an inactivating substitution for tyrosine; or alanine may act as an inactivating substitution for serine.

"Homology" as it applies to amino acid sequences is defined as the percentage of residues in the candidate amino acid sequence that are identical with the residues in the amino acid sequence of a second sequence after aligning the sequences and introducing gaps, if necessary, to achieve the maximum percent homology. Methods and computer programs for the alignment are well known in the art. It is understood that homology depends on a calculation of percent identity but may differ in value due to gaps and penalties introduced in the calculation.

By "homologs" as it applies to polypeptide sequences means the corresponding sequence of other species having substantial identity to a second sequence of a second species.

"Analogs" is meant to include polypeptide variants which differ by one or more amino acid alterations, e.g., substitutions, additions or deletions of amino acid residues that still maintain one or more of the properties of the parent or starting polypeptide.

The present invention contemplates several types of compositions which are polypeptide based including variants and derivatives. These include substitutional, insertional, deletion and covalent variants and derivatives. The term "derivative" is used synonymously with the term "variant" but generally refers to a molecule that has been modified and/or changed in any way relative to a reference molecule or starting molecule.

As such, polynucleotides encoding peptides or polypeptides containing substitutions, insertions and/or additions, deletions and covalent modifications with respect to reference sequences, in particular the polypeptide sequences disclosed herein, are included within the scope of this invention. For example, sequence tags or amino acids, such as one or more lysines, can be added to the peptide sequences of the invention (e.g., at the N-terminal or C-terminal ends). Sequence tags can be used for peptide purification or localization. Lysines can be used to increase peptide solubility or to allow for biotinylation. Alternatively, amino acid residues located at the carboxy and amino terminal regions of the amino acid sequence of a peptide or protein may optionally be deleted providing for truncated sequences. Certain amino acids (e.g., C-terminal or N-terminal residues) may alternatively be deleted depending on the use of the sequence, as for example, expression of the sequence as part of a larger sequence which is soluble, or linked to a solid support.

"Substitutional variants" when referring to polypeptides are those that have at least one amino acid residue in a native or starting sequence removed and a different amino acid inserted in its place at the same position. The substitutions may be single, where only one amino acid in the molecule has been substituted, or they may be multiple, where two or more amino acids have been substituted in the same molecule.

In one embodiment, the polynucleotides described herein encode a substitutional variant of a LDLR protein. The substitutional variant may comprise one, two, three or more than three substitutions. As a non-limiting example, one, two three or more than three of the substitutions may be located in the EGF-A domain of a LDLR protein. As another non-limiting example, the substitution or substitutions may be located in the IDOL interacting domain of a LDLR protein. As another non-limiting example, the substitution or substitutions may be located in the PCSK9 interacting domain of a LDLR protein. As yet another non-limiting example, the substitutions may be located in the IDOL interacting domain and the PCSK9 interacting domain of the LDLR protein. As yet another non-limiting example, the substitutions may be located in the EGF-A domain and the IDOL interacting domain. As yet another non-limiting example, the substitutions may be located in the EGF-A domain and the PCSK9 interacting domain. As yet another non-limiting example, the substitutions may be located in the PCSK9 interacting domain and the IDOL interacting domain.

In one embodiment, the substitutional variant is referred to as a mutation. The polynucleotides described herein may comprise one, two, three, four or more than four mutations. As a non-limiting example, the polynucleotides encode a LDLR protein comprising at least one mutation in the EGF-A domain of the LDLR protein. As a non-limiting example, the polynucleotides encode a LDLR protein comprising at least one mutation in the IDOL interacting domain of the LDLR protein. As a non-limiting example, the polynucleotides encode a LDLR protein comprising at least one mutation in the PCSK9 binding domain of the LDLR protein. As a non-limiting example, the polynucleotides encode a LDLR protein comprising at least one mutation in the IDOL interacting domain and the PCSK9 interacting domain of the LDLR protein. As a non-limiting example, the polynucleotides encode a LDLR protein comprising at least one mutation in the EGF-A domain and the IDOL interacting domain. As a non-limiting example, the polynucleotides encode a LDLR protein comprising at least one mutation in the PCSK9 interacting domain and the IDOL interacting domain.

As used herein the term "conservative amino acid substitution" refers to the substitution of an amino acid that is normally present in the sequence with a different amino acid of similar size, charge, or polarity. Examples of conservative substitutions include the substitution of a non-polar (hydrophobic) residue such as isoleucine, valine and leucine for another non-polar residue. Likewise, examples of conservative substitutions include the substitution of one polar (hydrophilic) residue for another such as between arginine and lysine, between glutamine and asparagine, and between glycine and serine. Additionally, the substitution of a basic residue such as lysine, arginine or histidine for another, or the substitution of one acidic residue such as aspartic acid or glutamic acid for another acidic residue are additional examples of conservative substitutions. Examples of non-conservative substitutions include the substitution of a non-polar (hydrophobic) amino acid residue such as isoleucine, valine, leucine, alanine, methionine for a polar (hydrophilic) residue such as cysteine, glutamine, glutamic acid or lysine and/or a polar residue for a non-polar residue.

"Insertional variants" when referring to polypeptides are those with one or more amino acids inserted immediately adjacent to an amino acid at a particular position in a native or starting sequence. "Immediately adjacent" to an amino acid means connected to either the alpha-carboxy or alpha-amino functional group of the amino acid.

"Deletional variants" when referring to polypeptides are those with one or more amino acids in the native or starting amino acid sequence removed. Ordinarily, deletional variants will have one or more amino acids deleted in a particular region of the molecule.

"Covalent derivatives" when referring to polypeptides include modifications of a native or starting protein with an organic proteinaceous or non-proteinaceous derivatizing agent, and/or post-translational modifications. Covalent modifications are traditionally introduced by reacting targeted amino acid residues of the protein with an organic derivatizing agent that is capable of reacting with selected side-chains or terminal residues, or by harnessing mechanisms of post-translational modifications that function in selected recombinant host cells. The resultant covalent derivatives are useful in programs directed at identifying residues important for biological activity, for immunoassays, or for the preparation of anti-protein antibodies for immunoaffinity purification of the recombinant glycoprotein. Such modifications are within the ordinary skill in the art and are performed without undue experimentation.

Certain post-translational modifications are the result of the action of recombinant host cells on the expressed polypeptide. Glutaminyl and asparaginyl residues are frequently post-translationally deamidated to the corresponding glutamyl and aspartyl residues. Alternatively, these residues are deamidated under mildly acidic conditions. Either form of these residues may be present in the polypeptides produced in accordance with the present invention.

Other post-translational modifications include hydroxylation of proline and lysine, phosphorylation of hydroxyl groups of seryl or threonyl residues, methylation of the alpha-amino groups of lysine, arginine, and histidine side chains (T. E. Creighton, Proteins: Structure and Molecular Properties, W.H. Freeman & Co., San Francisco, pp. 79-86 (1983)).

"Features" when referring to polypeptides are defined as distinct amino acid sequence-based components of a molecule. Features of the polypeptides encoded by the polynucleotides of the present invention include surface manifestations, local conformational shape, folds, loops, half-loops, domains, half-domains, sites, termini or any combination thereof.

As used herein when referring to polypeptides the term "surface manifestation" refers to a polypeptide based component of a protein appearing on an outermost surface.

As used herein when referring to polypeptides the term "local conformational shape" means a polypeptide based structural manifestation of a protein which is located within a definable space of the protein.

As used herein when referring to polypeptides the term "fold" refers to the resultant conformation of an amino acid sequence upon energy minimization. A fold may occur at the secondary or tertiary level of the folding process. Examples of secondary level folds include beta sheets and alpha helices. Examples of tertiary folds include domains and regions formed due to aggregation or separation of energetic forces. Regions formed in this way include hydrophobic and hydrophilic pockets, and the like.

As used herein the term "turn" as it relates to protein conformation means a bend which alters the direction of the backbone of a peptide or polypeptide and may involve one, two, three or more amino acid residues.

As used herein when referring to polypeptides the term "loop" refers to a structural feature of a polypeptide which may serve to reverse the direction of the backbone of a peptide or polypeptide. Where the loop is found in a polypeptide and only alters the direction of the backbone, it may comprise four or more amino acid residues. Oliva et al. have identified at least 5 classes of protein loops (J. Mol Biot 266 (4): 814-830; 1997). Loops may be open or closed. Closed loops or "cyclic" loops may comprise 2, 3, 4, 5, 6, 7, 8, 9, 10 or more amino acids between the bridging moieties. Such bridging moieties may comprise a cysteine-cysteine bridge (Cys-Cys) typical in polypeptides having disulfide bridges or alternatively bridging moieties may be non-protein based such as the dibromozylyl agents used herein.

As used herein when referring to polypeptides the term "half-loop" refers to a portion of an identified loop having at least half the number of amino acid resides as the loop from which it is derived. It is understood that loops may not always contain an even number of amino acid residues. Therefore, in those cases where a loop contains or is identified to comprise an odd number of amino acids, a half-loop of the odd-numbered loop will comprise the whole number portion or next whole number portion of the loop (number of amino acids of the loop/2+/−0.5 amino acids). For example, a loop identified as a 7 amino acid loop could produce half-loops of 3 amino acids or 4 amino acids (7/2=3.5+/−0.5 being 3 or 4).

As used herein when referring to polypeptides the term "domain" refers to a motif of a polypeptide having one or more identifiable structural or functional characteristics or properties (e.g., binding capacity, serving as a site for protein-protein interactions).

As used herein when referring to polypeptides the term "half-domain" means a portion of an identified domain having at least half the number of amino acid resides as the domain from which it is derived. It is understood that domains may not always contain an even number of amino acid residues. Therefore, in those cases where a domain contains or is identified to comprise an odd number of amino acids, a half-domain of the odd-numbered domain will comprise the whole number portion or next whole number portion of the domain (number of amino acids of the domain/2+/−0.5 amino acids). For example, a domain identified as a 7 amino acid domain could produce half-domains of 3 amino acids or 4 amino acids (7/2=3.5+/−0.5 being 3 or 4). It is also understood that subdomains may be identified within domains or half-domains, these subdomains possessing less than all of the structural or functional properties identified in the domains or half domains from which they were derived. It is also understood that the amino acids that comprise any of the domain types herein need not be contiguous along the backbone of the polypeptide (i.e., nonadjacent amino acids may fold structurally to produce a domain, half-domain or subdomain).

As used herein when referring to polypeptides the terms "site" as it pertains to amino acid based embodiments is used synonymously with "amino acid residue" and "amino acid side chain." A site represents a position within a peptide or polypeptide that may be modified, manipulated, altered, derivatized or varied within the polypeptide based molecules of the present invention.

As used herein the terms "termini" or "terminus" when referring to polypeptides refers to an extremity of a peptide or polypeptide. Such extremity is not limited only to the first or final site of the peptide or polypeptide but may include additional amino acids in the terminal regions. The polypeptide based molecules of the present invention may be characterized as having both an N-terminus (terminated by an amino acid with a free amino group (NH2)) and a C-terminus (terminated by an amino acid with a free carboxyl group (COOH)). Proteins of the invention are in some cases made up of multiple polypeptide chains brought together by disulfide bonds or by non-covalent forces (multimers, oligomers). These sorts of proteins will have multiple N- and C-termini. Alternatively, the termini of the polypeptides may be modified such that they begin or end, as the case may be, with a non-polypeptide based moiety such as an organic conjugate.

Once any of the features have been identified or defined as a desired component of a polypeptide to be encoded by the polynucleotide of the invention, any of several manipulations and/or modifications of these features may be performed by moving, swapping, inverting, deleting, randomizing or duplicating. Furthermore, it is understood that manipulation of features may result in the same outcome as a modification to the molecules of the invention. For example, a manipulation which involved deleting a domain would result in the alteration of the length of a molecule just as modification of a nucleic acid to encode less than a full length molecule would.

Modifications and manipulations can be accomplished by methods known in the art such as, but not limited to, site directed mutagenesis or a priori incorporation during chemical synthesis. The resulting modified molecules may then be tested for activity using in vitro or in vivo assays such as those described herein or any other suitable screening assay known in the art.

According to the present invention, the polypeptides may comprise a consensus sequence which is discovered through rounds of experimentation. As used herein a "consensus" sequence is a single sequence which represents a collective population of sequences allowing for variability at one or more sites.

As recognized by those skilled in the art, protein fragments, functional protein domains, and homologous proteins are also considered to be within the scope of polypeptides of interest of this invention. For example, provided herein is any protein fragment (meaning a polypeptide sequence at least one amino acid residue shorter than a reference polypeptide sequence but otherwise identical) of a reference protein 10, 20, 30, 40, 50, 60, 70, 80, 90, 100 or greater than 100 amino acids in length. In another example, any protein that includes a stretch of about 20, about 30, about 40, about 50, or about 100 amino acids which are about 40%, about 50%, about 60%, about 70%, about 80%, about 90%, about 95%, or about 100% identical to any of the sequences described herein can be utilized in accordance with the invention. In certain embodiments, a polypeptide to be utilized in accordance with the invention includes 2, 3, 4, 5, 6, 7, 8, 9, 10, or more mutations as shown in any of the sequences provided or referenced herein.

Types of Polypeptides of Interest

The polynucleotides of the present invention may be designed to encode polypeptides of interest selected from any of several target categories including, but not limited to, biologics, antibodies, vaccines, therapeutic proteins or peptides, cell penetrating peptides, secreted proteins, plasma membrane proteins, cytoplasmic or cytoskeletal proteins, intracellular membrane bound proteins, nuclear proteins, proteins associated with human disease, targeting moieties or those proteins encoded by the human genome for which no therapeutic indication has been identified but which nonetheless have utility in areas of research and discovery. As a non-limiting example, the polynucleotides of the present invention may be designed to encode biologics, antibodies, vaccines, therapeutic proteins or peptides, cell penetrating peptides, secreted proteins, plasma membrane proteins, cytoplasmic or cytoskeletal proteins, intracellular membrane bound proteins, nuclear proteins, proteins associated with human disease as described in International Patent Publication No. WO2013151666, the contents of which is herein incorporated by reference in its entirety.

In one embodiment, polynucleotides may encode variant polypeptides which have a certain identity with a reference polypeptide sequence. As used herein, a "reference polypeptide sequence" refers to a starting polypeptide sequence. Reference sequences may be wild type sequences or any sequence to which reference is made in the design of another sequence. A "reference polypeptide sequence" may, e.g., be a LDLR protein such as wild-type LDLR or a LDLR comprising at least one mutation (e.g., a LDLR cell surface expression-enhancing mutation, a mutation increasing the residence time of LDLR at the cell surface or a mutation resulting in increased levels of LDLR at the cell surface), any of the polypeptides described in Table 3, Table 10 and Table 11 herein or any one of those polypeptides disclosed in Table 6 of U.S. Provisional Patent Application Nos. 61/618,862, 61/681,645, 61/737,130, 61/618,866, 61/681, 647, 61/737,134, 61/618,868, 61/681,648, 61/737,135, 61/618,873, 61/681,650, 61/737,147, 61/618,878, 61/681, 654, 61/737,152, 61/618,885, 61/681,658, 61/737,155, 61/618,896, 61/668,157, 61/681,661, 61/737,160, 61/618, 911, 61/681,667, 61/737,168, 61/618,922, 61/681,675, 61/737,174, 61/618,935, 61/681,687, 61/737,184, 61/618, 945, 61/681,696, 61/737,191, 61/618,953, 61/681,704, 61/737,203; Table 6 and 7 of U.S. Provisional Patent Application Nos. 61/681,720, 61/737,213, 61/681,742; Table 6 of International Publication Nos. WO2013151666, WO2013151668, WO2013151663, WO2013151669, WO2013151670, WO2013151664, WO2013151665, WO2013151736; Tables 6 and 7 International Publication No. WO2013151672; Tables 6, 178 and 179 of International Publication No. WO2013151671; Tables 6, 28 and 29 of U.S. Provisional Patent Application No. 61/618,870; Tables 6, 56 and 57 of U.S. Provisional Patent Application No. 61/681,649; Tables 6, 186 and 187 U.S. Provisional Patent Application No. 61/737,139; Tables 6, 185 and 186 of International Publication No WO2013151667; the contents of each of which are herein incorporated by reference in their entireties. As a non-limiting example, the reference polypeptide sequence may any encoding low density lipoprotein receptor (LDLR) or variants thereof.

Reference molecules (polypeptides or polynucleotides) may share a certain identity with the designed molecules (polypeptides or polynucleotides). The term "identity" as known in the art, refers to a relationship between the sequences of two or more peptides, polypeptides or polynucleotides, as determined by comparing the sequences. In the art, identity also means the degree of sequence relatedness between them as determined by the number of matches between strings of two or more amino acid residues or nucleosides. Identity measures the percent of identical matches between the smaller of two or more sequences with gap alignments (if any) addressed by a particular mathematical model or computer program (i.e., "algorithms"). Identity of related peptides can be readily calculated by known methods. Such methods include, but are not limited to, those described in Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part 1, Griffin, A. M., and Griffin, H. G., eds., Humana Press, New Jersey, 1994; Sequence Analysis in Molecular Biology, von Heinje, G., Academic Press, 1987; Sequence Analysis Primer, Gribskov, M. and Devereux, J., eds., M. Stockton Press, New York, 1991; and Carillo et al., SIAM J. Applied Math. 48, 1073 (1988).

In some embodiments, the encoded polypeptide variant may have the same or a similar activity as the reference polypeptide. Alternatively, the variant may have an altered activity (e.g., increased or decreased) relative to a reference polypeptide. Generally, variants of a particular polynucleotide or polypeptide of the invention will have at least about 40%, 45%, 50%, 55%, 60%, 65%, 70%, 75%, 80%, 85%, 90%, 91%, 92%, 93%, 94%, 95%, 96%, 97%, 98%, 99% but less than 100% sequence identity to that particular reference polynucleotide or polypeptide as determined by sequence alignment programs and parameters described herein and known to those skilled in the art. Such tools for alignment include those of the BLAST suite (Stephen F. Altschul, Thomas L. Madden, Alejandro A. Schäffer, Jinghui Zhang, Zheng Zhang, Webb Miller, and David J. Lipman (1997), "Gapped BLAST and PSI-BLAST: a new generation of protein database search programs", Nucleic Acids Res. 25:3389-3402.) Other tools are described herein, specifically in the definition of "Identity."

Default parameters in the BLAST algorithm include, for example, an expect threshold of 10, Word size of 28, Match/Mismatch Scores 1, -2, Gap costs Linear. Any filter can be applied as well as a selection for species specific repeats, e.g., *Homo sapiens*.

Targeting Moieties

In some embodiments, the invention, the polynucleotides are provided to express a targeting moiety. These include a protein-binding partner or a receptor on the surface of the cell, which functions to target the cell to a specific tissue space or to interact with a specific moiety, either in vivo or in vitro. Suitable protein-binding partners include, but are not limited to, antibodies and functional fragments thereof, scaffold proteins, or peptides. Additionally, polynucleotides can be employed to direct the synthesis and extracellular localization of lipids, carbohydrates, or other biological moieties or biomolecules.

Polypeptide Libraries

In one embodiment, the polynucleotides may be used to produce polypeptide libraries. These libraries may arise from the production of a population of polynucleotides, each containing various structural or chemical modification designs. In this embodiment, a population of polynucleotides may comprise a plurality of encoded polypeptides, including but not limited to, an antibody or antibody fragment, protein binding partner, scaffold protein, and other polypeptides taught herein or known in the art. In one embodiment, the polynucleotides may be suitable for direct introduction into a target cell or culture which in turn may synthesize the encoded polypeptides.

In certain embodiments, multiple variants of a protein, each with different amino acid modification(s), may be produced and tested to determine the best variant in terms of pharmacokinetics, stability, biocompatibility, and/or biological activity, or a biophysical property such as expression level. Such a library may contain 10, $10^2$, $10^3$, $10^4$, $10^5$, $10^6$, $10^7$, $10^8$, $10^9$, or over $10^9$ possible variants (including, but not limited to, substitutions, deletions of one or more residues, and insertion of one or more residues).

Anti Microbial and Anti-Viral Polypeptides

The polynucleotides of the present invention may be designed to encode one or more antimicrobial peptides (AMP) or antiviral peptides (AVP). AMPs and AVPs have been isolated and described from a wide range of animals such as, but not limited to, microorganisms, invertebrates, plants, amphibians, birds, fish, and mammals (Wang et al., *Nucleic Acids Res*. 2009; 37 (Database issue):D933-7).

Anti-microbial and anti-viral polypeptides are described in International Publication No. WO2013151666, the contents of which are herein incorporated by reference. As a non-limiting example, anti-microbial polypeptides are described in paragraphs [000189]-[000199] of International Publication No. WO2013151666, the contents of which are herein incorporated by reference. As another non-limiting example, anti-viral polypeptides are described in paragraphs [000189]-[000195] and [000200] of International Publication No. WO2013151666, the contents of which are herein incorporated by reference.

Polynucleotide Regions

In some embodiments, polynucleotides may be designed to comprise regions, subregions or parts which function in a similar manner as known regions or parts of other nucleic acid based molecules. Such regions include those mRNA regions discussed herein as well as noncoding regions. Noncoding regions may be at the level of a single nucleoside such as the case when the region is or incorporates one or more cytotoxic nucleosides.

Cytotoxic Nucleosides

In one embodiment, the polynucleotides of the present invention may incorporate one or more cytotoxic nucleosides. For example, cytotoxic nucleosides may be incorporated into polynucleotides such as bifunctional modified RNAs or mRNAs. Cytotoxic nucleoside anti-cancer agents include, but are not limited to, adenosine arabinoside, cytarabine, cytosine arabinoside, 5-fluorouracil, fludarabine, floxuridine, FTORAFUR® (a combination of tegafur and uracil), tegafur ((RS)-5-fluoro-1-(tetrahydrofuran-2-yl)pyrimidine-2,4(1H,3H)-dione), and 6-mercaptopurine.

A number of cytotoxic nucleoside analogues are in clinical use, or have been the subject of clinical trials, as anticancer agents. Examples of such analogues include, but are not limited to, cytarabine, gemcitabine, troxacitabine, decitabine, tezacitabine, 2'-deoxy-2'-methylidenecytidine (DMDC), cladribine, clofarabine, 5-azacytidine, 4'-thio-ara-cytidine, cyclopentenylcytosine and 1-(2-C-cyano-2-deoxy-beta-D-arabino-pentofuranosyl)-cytosine. Another example of such a compound is fludarabine phosphate. These compounds may be administered systemically and may have side effects which are typical of cytotoxic agents such as, but not limited to, little or no specificity for tumor cells over proliferating normal cells.

A number of prodrugs of cytotoxic nucleoside analogues are also reported in the art. Examples include, but are not limited to, N4-behenoyl-1-beta-D-arabinofuranosylcytosine, N4-octadecyl-1-beta-D-arabinofuranosylcytosine, N4-palmitoyl-1-(2-C-cyano-2-deoxy-beta-D-arabino-pentofuranosyl) cytosine, and P-4055 (cytarabine 5'-elaidic acid ester). In general, these prodrugs may be converted into the active drugs mainly in the liver and systemic circulation and display little or no selective release of active drug in the tumor tissue. For example, capecitabine, a prodrug of 5'-deoxy-5-fluorocytidine (and eventually of 5-fluorouracil), is metabolized both in the liver and in the tumor tissue. A series of capecitabine analogues containing "an easily hydrolysable radical under physiological conditions" has been claimed by Fujiu et al. (U.S. Pat. No. 4,966,891) and is herein incorporated by reference. The series described by Fujiu includes N4 alkyl and aralkyl carbamates of 5'-deoxy-5-fluorocytidine and the implication that these compounds will be activated by hydrolysis under normal physiological conditions to provide 5'-deoxy-5-fluorocytidine.

A series of cytarabine N4-carbamates has been by reported by Fadl et al (*Pharmazie*. 1995, 50, 382-7, herein incorporated by reference in its entirety) in which compounds were designed to convert into cytarabine in the liver and plasma. WO 2004/041203, herein incorporated by reference in its entirety, discloses prodrugs of gemcitabine, where some of the prodrugs are N4-carbamates. These compounds were designed to overcome the gastrointestinal toxicity of gemcitabine and were intended to provide gemcitabine by hydrolytic release in the liver and plasma after absorption of the intact prodrug from the gastrointestinal tract. Nomura et al (*Bioorg Med. Chem*. 2003, 11, 2453-61, herein incorporated by reference in its entirety) have described acetal derivatives of 1-(3-C-ethynyl-β-D-ribopentofaranosyl) cytosine which, on bioreduction, produced an intermediate that required further hydrolysis under acidic conditions to produce a cytotoxic nucleoside compound.

Cytotoxic nucleotides which may be chemotherapeutic also include, but are not limited to, pyrazolo [3,4-D]-pyrimidines, allopurinol, azathioprine, capecitabine, cytosine arabinoside, fluorouracil, mercaptopurine, 6-thioguanine, acyclovir, ara-adenosine, ribavirin, 7-deaza-adenosine, 7-deaza-guanosine, 6-aza-uracil, 6-aza-cytidine, thymidine ribonucleotide, 5-bromodeoxyuridine, 2-chloro-purine, and inosine, or combinations thereof.

Polynucleotides Having Untranslated Regions (UTRs)

The polynucleotides of the present invention may comprise one or more regions or parts which act or function as an untranslated region. Where polynucleotides are designed to encode at least one polypeptide of interest, the polynucleotides may comprise one or more of these untranslated regions.

By definition, wild type untranslated regions (UTRs) of a gene are transcribed but not translated. In mRNA, the 5'UTR starts at the transcription start site and continues to the start codon but does not include the start codon; whereas, the 3'UTR starts immediately following the stop codon and continues until the transcriptional termination signal. There is growing body of evidence about the regulatory roles played by the UTRs in terms of stability of the nucleic acid molecule and translation. The regulatory features of a UTR can be incorporated into the polynucleotides of the present invention to, among other things, enhance the stability of the molecule. The specific features can also be incorporated to ensure controlled down-regulation of the transcript in case they are misdirected to undesired organs sites.

Tables 1 and 2 provide a listing of exemplary UTRs which may be utilized in the polynucleotides of the present invention. Shown in Table 1 is a listing of a 5'-untranslated region of the invention. Variants of 5' UTRs may be utilized wherein one or more nucleotides are added or removed to the termini, including A, T, C or G.

TABLE 1

5'-Untranslated Regions

| 5' UTR Identifier | Name/ Description | Sequence | SEQ ID NO. |
| --- | --- | --- | --- |
| 5UTR-001 | Upstream UTR | GGGAAATAAGAGAGAAAAGAAGAGTAAGAAG AAATATAAGAGCCACC | 3 |
| 5UTR-002 | Upstream UTR | GGGAGATCAGAGAGAAAAGAAGAGTAAGAAG AAATATAAGAGCCACC | 4 |
| 5UTR-003 | Upstream UTR | GGAATAAAAGTCTCAACACAACATATACAAAA CAAACGAATCTCAAGCAATCAAGCATTCTACT TCTATTGCAGCAATTTAAATCATTTCTTTTAAA GCAAAAGCAATTTTCTGAAAATTTTCACCATTT ACGAACGATAGCAAC | 5 |
| 5UTR-004 | Upstream UTR | GGGAGACAAGCUUGGCAUUCCGGUACUGUUG GUAAAGCCACC | 6 |
| 5UTR-005 | Upstream UTR | GGGAGATCAGAGAGAAAAGAAGAGTAAGAAG AAATATAAGAGCCACC | 7 |
| 5UTR-006 | Upstream UTR | GGAATAAAAGTCTCAACACAACATATACAAAA CAAACGAATCTCAAGCAATCAAGCATTCTACT TCTATTGCAGCAATTTAAATCATTTCTTTTAAA GCAAAAGCAATTTTCTGAAAATTTTCACCATTT ACGAACGATAGCAAC | 8 |
| 5UTR-007 | Upstream UTR | GGGAGACAAGCUUGGCAUUCCGGUACUGUUG GUAAAGCCACC | 9 |
| 5UTR-008 | Upstream UTR | GGGAATTAACAGAGAAAAGAAGAGTAAGAAG AAATATAAGAGCCACC | 10 |
| 5UTR-009 | Upstream UTR | GGGAAATTAGACAGAAAAGAAGAGTAAGAAG AAATATAAGAGCCACC | 11 |
| 5UTR-010 | Upstream UTR | GGGAAATAAGAGAGTAAAGAACAGTAAGAAG AAATATAAGAGCCACC | 12 |
| 5UTR-011 | Upstream UTR | GGGAAAAAAGAGAGAAAAGAAGACTAAGAAG AAATATAAGAGCCACC | 13 |
| 5UTR-012 | Upstream UTR | GGGAAATAAGAGAGAAAAGAAGAGTAAGAAG ATATATAAGAGCCACC | 14 |
| 5UTR-013 | Upstream UTR | GGGAAATAAGAGACAAAACAAGAGTAAGAAG AAATATAAGAGCCACC | 15 |
| 5UTR-014 | Upstream UTR | GGGAAATTAGAGAGTAAAGAACAGTAAGTAG AATTAAAAGAGCCACC | 16 |
| 5UTR-015 | Upstream UTR | GGGAAATAAGAGAGAATAGAAGAGTAAGAAG AAATATAAGAGCCACC | 17 |
| 5UTR-016 | Upstream UTR | GGGAAATAAGAGAGAAAAGAAGAGTAAGAAG AAAATTAAGAGCCACC | 18 |
| 5UTR-017 | Upstream UTR | GGGAAATAAGAGAGAAAAGAAGAGTAAGAAG AAATTTAAGAGCCACC | 19 |

Shown in Table 2 is a listing of 3'-untranslated regions of the invention. Variants of 3' UTRs may be utilized wherein one or more nucleotides are added or removed to the termini, including A, T, C or G.

TABLE 2

3'-Untranslated Regions

| 3' UTR Identifier | Name/ Description | Sequence | SEQ ID NO. |
|---|---|---|---|
| 3UTR-001 | Creatine Kinase | GCGCCTGCCCACCTGCCACCGACTGCTGGAACCCAGC CAGTGGGAGGGCCTGGCCCACCAGAGTCCTGCTCCCT CACTCCTCGCCCCGCCCCCTGTCCCAGAGTCCCACCTG GGGGCTCTCTCCACCCTTCTCAGAGTTCCAGTTTCAAC CAGAGTTCCAACCAATGGGCTCCATCCTCTGGATTCTG GCCAATGAAATATCTCCCTGGCAGGGTCCTCTTCTTTT CCCAGAGCTCCACCCCAACCAGGAGCTCTAGTTAATG GAGAGCTCCCAGCACACTCGGAGCTTGTGCTTTGTCTC CACGCAAAGCGATAAATAAAAGCATTGGTGGCCTTTG GTCTTTGAATAAAGCCTGAGTAGGAAGTCTAGA | 20 |
| 3UTR-002 | Myoglobin | GCCCCTGCCGCTCCCACCCCCACCCATCTGGGCCCCGG GTTCAAGAGAGAGCGGGGTCTGATCTCGTGTAGCCAT ATAGAGTTTGCTTCTGAGTGTCTGCTTTGTTTAGTAGA GGTGGGCAGGAGGAGCTGAGGGGCTGGGGCTGGGGT GTTGAAGTTGGCTTTGCATGCCCAGCGATGCGCCTCCC TGTGGGATGTCATCACCCTGGGAACCGGGAGTGGCCC TTGGCTCACTGTGTTCTGCATGGTTTGGATCTGAATTA ATTGTCCTTTCTTCTAAATCCCAACCGAACTTCTTCCA ACCTCCAAACTGGCTGTAACCCCAAATCCAAGCCATT AACTACACCTGACAGTAGCAATTGTCTGATTAATCACT GGCCCCTTGAAGACAGCAGAATGTCCCTTTGCAATGA GGAGGAGATCTGGGCTGGGCGGGCCAGCTGGGGAAG CATTTGACTATCTGGAACTTGTGTGTGCCTCCTCAGGT ATGGCAGTGACTCACCTGGTTTTAATAAAACAACCTG CAACATCTCATGGTCTTTGAATAAAGCCTGAGTAGGA AGTCTAGA | 21 |
| 3UTR-003 | α-actin | ACACACTCCACCTCCAGCACGCGACTTCTCAGGACGA CGAATCTTCTCAATGGGGGGCGGCTGAGCTCCAGCC ACCCCGCAGTCACTTTCTTTGTAACAACTTCCGTTGCT GCCATCGTAAACTGACACAGTGTTTATAACGTGTACAT ACATTAACTTATTACCTCATTTTGTTATTTTTCGAAACA AAGCCCTGTGGAAGAAAATGGAAAACTTGAAGAAGC ATTAAAGTCATTCTGTTAAGCTGCGTAAATGGTCTTTG AATAAAGCCTGAGTAGGAAGTCTAGA | 22 |
| 3UTR-004 | Albumin | CATCACATTTAAAAGCATCTCAGCCTACCATGAGAAT AAGAGAAAGAAAATGAAGATCAAAAGCTTATTCATCT GTTTTTCTTTTTCGTTGGTGTAAAGCCAACACCCTGTCT AAAAAACATAAATTTCTTTAATCATTTTGCCTCTTTTCT CTGTGCTTCAATTAATAAAAAATGGAAAGAATCTAAT AGAGTGGTACAGCACTGTTATTTTTCAAAGATGTGTTG CTATCCTGAAAATTCTGTAGGTTCTGTGGAAGTTCCAG TGTTCTCTCTTATTCCACTTCGGTAGAGGATTTCTAGTT TCTTGTGGGCTAATTAAATAAATCATTAATACTCTTCT AATGGTCTTTGAATAAAGCCTGAGTAGGAAGTCTAGA | 23 |
| 3UTR-005 | α-globin | GCTGCCTTCTGCGGGGCTTGCCTTCTGGCCATGCCCTT CTTCTCTCCCTTGCACCTGTACCTCTTGGTCTTTGAATA AAGCCTGAGTAGGAAGGCGGCCGCTCGAGCATGCATC TAGA | 24 |
| 3UTR-006 | G-CSF | GCCAAGCCCTCCCCATCCCATGTATTTATCTCTATTTA ATATTTATGTCTATTTAAGCCTCATATTTAAAGACAGG GAAGAGCAGAACGGAGCCCCAGGCCTCTGTGTCCTTC CCTGCATTTCTGAGTTTCATTCTCCTGCCTGTAGCAGT GAGAAAAAGCTCCTGTCCTCCCATCCCCTGGACTGGG AGGTAGATAGGTAAATACCAAGTATTTATTACTATGA CTGCTCCCCAGCCCTGGCTCTGCAATGGGCACTGGGAT GAGCCGCTGTGAGCCCCTGGTCCTGAGGGTCCCCACC TGGGACCCTTGAGAGTATCAGGTCTCCCACGTGGGAG ACAAGAAATCCCTGTTTAATATTTAAACAGCAGTGTTC CCCATCTGGGTCCTTGCACCCCTCACTCTGGCCTCAGC CGACTGCACAGCGGCCCCTGCATCCCCTTGGCTGTGA GGCCCCTGGACAAGCAGAGGTGGCCAGAGCTGGGAG GCATGGCCCTGGGGTCCCACGAATTTGCTGGGGAATC TCGTTTTTCTTCTTAAGACTTTTGGGACATGGTTTGACT | 25 |

TABLE 2-continued

3'-Untranslated Regions

| 3' UTR Identifier | Name/ Description | Sequence | SEQ ID NO. |
|---|---|---|---|
| | | CCCGAACATCACCGACGCGTCTCCTGTTTTTCTGGGTG GCCTCGGGACACCTGCCCTGCCCCCACGAGGGTCAGG ACTGTGACTCTTTTTAGGGCCAGGCAGGTGCCTGGAC ATTTGCCTTGCTGGACGGGGACTGGGGATGTGGGAGG GAGCAGACAGGAGGAATCATGTCAGGCCTGTGTGTGA AAGGAAGCTCCACTGTCACCCTCCACCTCTTCACCCCC CACTCACCAGTGTCCCCTCCACTGTCACATTGTAACTG AACTTCAGGATAATAAAGTGTTTGCCTCCATGGTCTTT GAATAAAGCCTGAGTAGGAAGGCGGCCGCTCGAGCAT GCATCTAGA | |
| 3UTR-007 | Col1a2; collagen, type I, alpha 2 | ACTCAATCTAAATTAAAAAGAAAGAAATTTGAAAAA ACTTTCTCTTTGCCATTTCTTCTTCTTCTTTTTTAACTGA AAGCTGAATCCTTCCATTTCTTCTGCACATCTACTTGC TTAAATTGTGGGCAAAAGAGAAAAAGAAGGATTGATC AGAGCATTGTGCAATACAGTTTCATTAACTCCTTCCCC CGCTCCCCCAAAAATTTGAATTTTTTTTTCAACACTCTT ACACCTGTTATGGAAAATGTCAACCTTTGTAAGAAAA CCAAAATAAAAATTGAAAAATAAAAACCATAAACATT TGCACCACTTGTGGCTTTTGAATATCTTCCACAGAGGG AAGTTTAAAACCCAAACTTCCAAAGGTTTAAACTACC TCAAAACACTTTCCCATGAGTGTGATCCACATTGTTAG GTGCTGACCTAGACAGAGATGAACTGAGGTCCTTGTT TTGTTTTGTTCATAATACAAAGGTGCTAATTAATAGTA TTTCAGATACTTGAAGAATGTTGATGGTGCTAGAAGA ATTTGAGAAGAAATACTCCTGTATTGAGTTGTATCGTG TGGTGTATTTTTAAAAAATTTGATTTAGCATTCATAT TTTCCATCTTATTCCCAATTAAAAGTATGCAGATTATT TGCCCAAATCTTCTTCAGATTCAGCATTTGTTCTTTGCC AGTCTCATTTTCATCTTCTTCCATGGTTCCACAGAAGC TTTGTTTCTTGGGCAAGCAGAAAAATTAAATTGTACCT ATTTTGTATATGTGAGATGTTTAAATAAATTGTGAAAA AAATGAAATAAAGCATGTTTGGTTTTCCAAAAGAACA TAT | 26 |
| 3UTR-008 | Col6a2; collagen, type VI, alpha 2 | CGCCGCCGCCCGGGCCCCGCAGTCGAGGGTCGTGAGC CCACCCCGTCCATGGTGCTAAGCGGGCCCGGGTCCCA CACGGCCAGCACCGCTGCTCACTCGGACGACGCCCTG GGCCTGCACCTCTCCAGCTCCTCCCACGGGGTCCCCGT AGCCCCGGCCCCCGCCCAGCCCCAGGTCTCCCCAGGC CCTCCGCAGGCTGCCCGGCCTCCCTCCCCCTGCAGCCA TCCCAAGGCTCCTGACCTACCTGGCCCCTGAGCTCTGG AGCAAGCCCTGACCCAATAAAGGCTTTGAACCCAT | 27 |
| 3UTR-009 | RPN1; ribophorin I | GGGGCTAGAGCCCTCTCCGCACAGCGTGGAGACGGGG CAAGGAGGGGGGTTATTAGGATTGGTGGTTTTGTTTTG CTTTGTTTAAAGCCGTGGGAAAATGGCACAACTTTACC TCTGTGGGAGATGCAACACTGAGAGCCAAGGGGTGGG AGTTGGGATAATTTTTTATATAAAAGAAGTTTTTCCACT TTGAATTGCTAAAAGTGGCATTTTTCCTATGTGCAGTC ACTCCTCTCATTTCTAAAATAGGGACGTGGCCAGGCA CGGTGGCTCATGCCTGTAATCCCAGCACTTTGGGAGG CCGAGGCAGGCGGCTCACGAGGTCAGGAGATCGAGA CTATCCTGGCTAACACGGTAAAACCCTGTCTCTACTAA AAGTACAAAAAATTAGCTGGGCGTGGTGGTGGGCACC TGTAGTCCCAGCTACTCGGGAGGCTGAGGCAGGAGAA AGGCATGAATCCAAGAGGCAGAGCTTGCAGTGAGCTG AGATCACGCCATTGCACTCCAGCCTGGGCAACAGTGT TAAGACTCTGTCTCAAATATAAATAAATAAATAAATA AATAAATAAATAAATAAAAATAAAGCGAGATGTTGCC CTCAAA | 28 |
| 3UTR-010 | LRP1; low density lipoprotein receptor- related protein 1 | GGCCCTGCCCCGTCGGACTGCCCCCAGAAAGCCTCCT GCCCCCTGCCAGTGAAGTCCTTCAGTGAGCCCCTCCCC AGCCAGCCCTTCCCTGGCCCCGCCGGATGTATAAATGT AAAAATGAAGGAATTACATTTTATATGTGAGCGAGCA AGCCGGCAAGCGAGCACAGTATTATTTCTCCATCCCCT CCCTGCCTGCTCCTTGGCACCCCCATGCTGCCTTCAGG GAGACAGGCAGGGAGGGCTTGGGGCTGCACCTCCTAC CCTCCCACCAGAACGCACCCCACTGGGAGAGCTGGTG GTGCAGCCTTCCCCTCCCTGTATAAGCACTTTGCCAA GGCTCTCCCCTCTCGCCCCATCCCTGCTTGCCCGCTCC CACAGCTTCCTGAGGGCTAATTCTGGGAAGGGGAGAGT TCTTTGCTGCCCCTGTCTGGAAGACGTGGCTCTGGGTG | 29 |

TABLE 2-continued

3'-Untranslated Regions

| 3' UTR Identifier | Name/ Description | Sequence | SEQ ID NO. |
|---|---|---|---|
| | | AGGTAGGCGGGAAAGGATGGAGTGTTTTAGTTCTTGG GGGAGGCCACCCCAAACCCCAGCCCCAACTCCAGGGG CACCTATGAGATGGCCATGCTCAACCCCCCTCCCAGA CAGGCCCTCCCTGTCTCCAGGGCCCCCACCGAGGTTCC CAGGGCTGGAGACTTCCTCTGGTAAACATTCCTCCAGC CTCCCCTCCCCTGGGGACGCCAAGGAGGTGGGCCACA CCCAGGAAGGGAAAGCGGGCAGCCCCGTTTTGGGGAC GTGAACGTTTTAATAATTTTTGCTGAATTCCTTTACAA CTAAATAACACAGATATTGTTATAAATAAAATTGT | |
| 3UTR-011 | Nnt1; cardiotrophin-like cytokine factor 1 | ATATTAAGGATCAAGCTGTTAGCTAATAATGCCACCTC TGCAGTTTTGGGAACAGGCAAATAAAGTATCAGTATA CATGGTGATGTACATCTGTAGCAAAGCTCTTGGAGAA AATGAAGACTGAAGAAAGCAAAGCAAAAACTGTATA GAGAGATTTTTCAAAAGCAGTAATCCCTCAATTTTAAA AAAGGATTGAAAATTCTAAATGTCTTTCTGTGCATATT TTTTGTGTTAGGAATCAAAAGTATTTTATAAAAGGAG AAAGAACAGCCTCATTTTAGATGTAGTCCTGTTGGATT TTTTATGCCTCCTCAGTAACCAGAAATGTTTTAAAAAA CTAAGTGTTTAGGATTTCAAGACAACATTATACATGGC TCTGAAATATCTGACACAATGTAAACATTGCAGGCAC CTGCATTTTATGTTTTTTTTTCAACAAATGTGACTAAT TTGAAACTTTTATGAACTTCTGAGCTGTCCCCTTGCAA TTCAACCGCAGTTTGAATTAATCATATCAAATCAGTTT TAATTTTTTAAATTGTACTTCAGAGTCTATATTTCAAG GGCACATTTTCTCACTACTATTTTAATACATTAAAGGA CTAAATAATCTTTCAGAGATGCTGGAAACAAATCATTT GCTTTATATGTTTCATTAGAATACCAATGAAACATACA ACTTGAAAATTAGTAATAGTATTTTTGAAGATCCCATT TCTAATTGGAGATCTCTTTAATTTCGATCAACTTATAA TGTGTAGTACTATATTAAGTGCACTTGAGTGGAATTCA ACATTTGACTAATAAAATGAGTTCATCATGTTGGCAA GTGATGTGGCAATTATCTCTGGTGACAAAAGAGTAAA ATCAAATATTTCTGCCTGTTACAAATATCAAGGAAGA CCTGCTACTATGAAATAGATGACATTAATCTGTCTTCA CTGTTTATAATACGGATGGATTTTTTTCAAATCAGTG TGTGTTTTGAGGTCTTATGTAATTGATGACATTTGAGA GAAATGGTGGCTTTTTTTAGCTACCTCTTTGTTCATTTA AGCACCAGTAAAGATCATGTCTTTTTATAGAAGTGTA GATTTTCTTTGTGACTTTGCTATCGTGCCTAAAGCTCT AAATATAGGTGAATGTGTGATGAATACTCAGATTATTT GTCTCTCTATATAATTAGTTTGGTACTAAGTTTCTCAA AAAATTATTAACACATGAAAGACAATCTCTAAACCAG AAAAAGAAGTAGTACAAATTTTGTTACTGTAATGCTC GCGTTTAGTGAGTTTAAAACACACAGTATCTTTTGGTT TTATAATCAGTTTCTATTTTGCTGTGCCTGAGATTAAG ATCTGTGTATGTGTGTGTGTGTGTGCGTTTGTGT GTTAAAGCAGAAAAGACTTTTTTAAAAGTTTTAAGTG ATAAATGCAATTTGTTAATTGATCTTAGATCACTAGTA AACTCAGGGCTGAATTATACCATGTATATTCTATTAGA AGAAAGTAAACACCATCTTTATTCCTGCCCTTTTTCTT CTCTCAAAGTAGTTGTAGTTATATCTAGAAAGAAGCA ATTTTGATTTCTTGAAAAGGTAGTTCCTGCACTCAGTT TAAACTAAAAATAATCATACTTGGATTTTATTTATTTT TGTCATAGTAAAAATTTTAATTTATATATATTTTTATTT AGTATTATCTTATTCTTTGCTATTTGCCAATCCTTTGTC ATCAATTGTGTTAAATGAATTGAAAATTCATGCCCTGT TCATTTTATTTTACTTTATTGGTTAGGATATTTAAAGG ATTTTTGTATATAATTTCTTAAATTAATATTCCAAA AGGTTAGTGGACTTAGATTATAAATTATGGCAAAAAT CTAAAAACAACAAAAATGATTTTTATACATTCTATTTC ATTATTCCTCTTTTTCCAATAAGTCATACAATTGGTAG ATATGACTTATTTTATTTTTGTATTATTCACTATATCTT TATGATATTTAAGTATAAATAATTAAAAAAATTTATTG TACCTTATAGTCTGTCACCAAAAAAAAAAAATTATCT GTAGGTAGTGAAATGCTAATGTTGATTTGTCTTTAAGG GCTTGTTAACTATCCTTTATTTTCTCATTTGTCTTAAAT TAGGAGTTTGTGTTTAAATTACTCATCTAAGCAAAAAA TGTATATAAATCCCATTACTGGGTATATACCCAAAGG ATTATAAATCATGCTGCTATAAAGACACATGCACACG TATGTTTATTGCAGCACTATTCACAATAGCAAAGACTT GGAACCAACCCAAATGTCCATCAATGATAGACTTGAT TAAGAAAATGTGCACATATACACCATGGAATACTATG CAGCCATAAAAAAGGATGAGTTCATGTCCTTTGTAGG | 30 |

TABLE 2-continued

3'-Untranslated Regions

| 3' UTR Identifier | Name/ Description | Sequence | SEQ ID NO. |
|---|---|---|---|
| | | GACATGGATAAAGCTGGAAACCATCATTCTGAGCAAA CTATTGCAAGGACAGAAAACCAAACACTGCATGTTCT CACTCATAGGTGGGAATTGAACAATGAGAACACTTGG ACACAAGGTGGGGAACACCACACACCAGGGCCTGTCA TGGGGTGGGGGGAGTGGGGAGGGATAGCATTAGGAG ATATACCTAATGTAAATGATGAGTTAATGGGTGCAGC ACACCAACATGGCACATGTATACATATGTAGCAAACC TGCACGTTGTGCACATGTACCCTAGAACTTAAAGTATA ATTAAAAAAAAAAAGAAAACAGAAGCTATTTATAAA GAAGTTATTTGCTGAAATAAATGTGATCTTTCCCATTA AAAAAATAAAGAAATTTTGGGGTAAAAAAACACAAT ATATTGTATTCTTGAAAAATTCTAAGAGAGTGGATGTG AAGTGTTCTCACCACAAAAGTGATAACTAATTGAGGT AATGCACATATTAATTAGAAAGATTTTGTCATTCCACA ATGTATATATACTTAAAAATATGTTATACACAATAAAT ACATACATTAAAAAATAAGTAAATGTA | |
| 3UTR-012 | Col6a1; collagen, type VI, alpha 1 | CCCACCCTGCACGCCGGCACCAAACCCTGTCCTCCCAC CCCTCCCCACTCATCACTAAACAGAGTAAAATGTGAT GCGAATTTTCCCGACCAACCTGATTCGCTAGATTTTTT TTAAGGAAAAGCTTGGAAAGCCAGGACACAACGCTGC TGCCTGCTTTGTGCAGGGTCCTCCGGGGCTCAGCCCTG AGTTGGCATCACCTGCGCAGGGCCCTCTGGGGCTCAG CCCTGAGCTAGTGTCACCTGCACAGGGCCCTCTGAGG CTCAGCCCTGAGCTGGCGTCACCTGTGCAGGGCCCTCT GGGGCTCAGCCCTGAGCTGGCCTCACCTGGGTTCCCC ACCCCGGGCTCTCCTGCCCTGCCCTCCTGCCCGCCCTC CCTCCTGCCTGCGCAGCTCCTTCCCTAGGCACCTCTGT GCTGCATCCCACCAGCCTGAGCAAGACGCCCTCTCGG GGCCTGTGCCGCACTAGCCTCCCTCTCCTCTGTCCCCA TAGCTGGTTTTTCCCACCAATCCTCACCTAACAGTTAC TTTACAATTAAACTCAAAGCAAGCTCTTCTCCTCAGCT TGGGGCAGCCATTGGCCTCTGTCTCGTTTTGGGAAACC AAGGTCAGGAGGCCGTTGCAGACATAAATCTCGGCGA CTCGGCCCCGTCTCCTGAGGGTCCTGCTGGTGACCGGC CTGGACCTTGGCCCTACAGCCCTGGAGGCCGCTGCTG ACCAGCACTGACCCCGACCTCAGAGAGTACTCGCAGG GGCGCTGGCTGCACTCAAGACCCTCGAGATTAACGGT GCTAACCCCGTCTGCTCCTCCCTCCCGCAGAGACTGGG GCCTGGACTGGACATGAGAGCCCCTTGGTGCCACAGA GGGCTGTGTCTTACTAGAAACAACGCAAACCTCTCCTT CCTCAGAATAGTGATGTGTTCGACGTTTTATCAAAGGC CCCCTTTCTATGTTCATGTTAGTTTTGCTCCTTCTGTGT TTTTTTCTGAACCATATCCATGTTGCTGACTTTTCCAAA TAAAGGTTTTCACTCCTCTC | 31 |
| 3UTR-013 | Calr-; calreticulin | AGAGGCCTGCCTCCAGGGCTGGACTGAGGCCTGAGCG CTCCTGCCGCAGAGCTGGCCGCGCCAAATAATGTCTCT GTGAGACTCGAGAACTTTCATTTTTTTCCAGGCTGGTT CGGATTTGGGGTGGATTTTGGTTTTGTTCCCCTCCTCC ACTCTCCCCCACCCCCTCCCCGCCCTTTTTTTTTTTTT TTTTAAACTGGTATTTTATCTTTGATTCTCCTTCAGCCC TCACCCCTGGTTCTCATCTTTCTTGATCAACATCTTTTC TTGCCTCTGTCCCCTTCTCTCATCTCTTAGCTCCCCTCC AACCTGGGGGCAGTGGTGTGGAGAAGCCACAGGCCT GAGATTTCATCTGCTCTCCTTCCTGGAGCCCAGAGGAG GGCAGCAGAAGGGGGTGGTGTCTCCAACCCCCCAGCA CTGAGGAAGAACGGGGCTCTTCTCATTTCACCCCTCCC TTTCTCCCCTGCCCCAGGACTGGGCCACTTCTGGGTG GGGCAGTGGGTCCCAGATTGGCTCACACTGAGAATGT AAGAACTACAAACAAAATTTCTATTAAATTAAATTTTG TGTCTCC | 32 |
| 3UTR-014 | Col1a1; collagen, type I, alpha 1 | CTCCCTCCATCCCAACCTGGCTCCCTCCCACCCAACCA ACTTTCCCCCAACCCGGAAACAGACAAGCAACCCAA ACTGAACCCCCTCAAAAGCCAAAAAATGGGAGACAAT TTCACATGGACTTTGGAAAATATTTTTTCCTTTGCATT CATCTCTCAAACTTAGTTTTTATCTTTGACCAACCGAA CATGACCAAAACCAAAAGTGCATTCAACCTTACCAA AAAAAAAAAAAAAAAGAATAAATAAATAACTTTTT AAAAAGGAAGCTTGGTCCACTTGCTTGAAGACCCAT GCGGGGGTAAGTCCCTTTCTGCCCGTTGGGCTTATGAA ACCCCAATGCTGCCCTTTCTGCTCCTTTCTCCACACCC CCCTTGGGGCCTCCCCTCCACTCCTTCCCAAATCTGTC | 33 |

TABLE 2-continued

3'-Untranslated Regions

| 3' UTR Identifier | Name/ Description | Sequence | SEQ ID NO. |
|---|---|---|---|
| | | TCCCCAGAAGACACAGGAAACAATGTATTGTCTGCCC AGCAATCAAAGGCAATGCTCAAACACCCAAGTGGCCC CCACCCTCAGCCCGCTCCTGCCCGCCCAGCACCCCCAG GCCCTGGGGGACCTGGGGTTCTCAGACTGCCAAAGAA GCCTTGCCATCTGGCGCTCCCATGGCTCTTGCAACATC TCCCCTTCGTTTTTGAGGGGGTCATGCCGGGGGAGCCA CCAGCCCCTCACTGGGTTCGGAGGAGAGTCAGGAAGG GCCACGACAAAGCAGAAACATCGGATTTGGGGAACGC GTGTCAATCCCTTGTGCCGCAGGGCTGGGCGGGAGAG ACTGTTCTGTTCCTTGTGTAACTGTGTTGCTGAAAGAC TACCTCGTTCTTGTCTTGATGTGTCACCGGGGCAACTG CCTGGGGGCGGGGATGGGGGCAGGGTGGAAGCGGCT CCCCATTTTATACCAAAGGTGCTACATCTATGTGATGG GTGGGGTGGGGAGGGAATCACTGGTGCTATAGAAATT GAGATGCCCCCCCAGGCCAGCAAATGTTCCTTTTTGTT CAAAGTCTATTTTTATTCCTTGATATTTTTCTTTTTTTT TTTTTTTTTTGTGGATGGGGACTTGTGAATTTTTCTAAA GGTGCTATTTAACATGGGAGGAGAGCGTGTGCGGCTC CAGCCCAGCCCGCTGCTCACTTTCCACCCTCTCTCCAC CTGCCTCTGGCTTCTCAGGCCTCTGCTCTCCGACCTCT CTCCTCTGAAACCCTCCTCCACAGCTGCAGCCCATCCT CCCGGCTCCCTCCTAGTCTGTCCTGCGTCCTCTGTCCC CGGGTTTCAGAGACAACTTCCCAAAGCACAAAGCAGT TTTTCCCCCTAGGGGTGGGAGGAAGCAAAAGACTCTG TACCTATTTTGTATGTGTATAATAATTTGAGATGTTTTT AATTATTTTGATTGCTGGAATAAAGCATGTGGAAATG ACCCAAACATAATCCGCAGTGGCCTCCTAATTTCCTTC TTTGGAGTTGGGGGAGGGGTAGACATGGGGAAGGGG CTTTGGGGTGATGGGCTTGCCTTCCATTCCTGCCCTTT CCCTCCCCACTATTCTCTTCTAGATCCCTCCATAACCC CACTCCCCTTTCTCTCACCCTTCTTATACCGCAAACCTT TCTACTTCCTCTTTCATTTTCTATTCTTGCAATTTCCTT GCACCTTTTCCAAATCCTCTTCTCCCCTGCAATACCAT ACAGGCAATCCACGTGCACAACACACACACACACTCT TCACATCTGGGGTTGTCCAAACCTCATACCCACTCCCC TTCAAGCCCATCCACTCTCCACCCCCTGGATGCCCTGC ACTTGGTGGCGGTGGGATGCTCATGGATACTGGGAGG GTGAGGGGAGTGGAACCCGTGAGGAGGACCTGGGGG CCTCTCCTTGAACTGACATGAAGGGTCATCTGGCCTCT GCTCCCTTCTCACCCACGCTGACCTCCTGCCGAAGGAG CAACGCAACAGGAGAGGGGTCTGCTGAGCCTGGCGAG GGTCTGGGAGGGACCAGGAGGAAGGCGTGCTCCCTGC TCGCTGTCCTGGCCCTGGGGGAGTGAGGGAGACAGAC ACCTGGGAGAGCTGTGGGGAAGGCACTCGCACCGTGC TCTTGGGAAGGAAGGAGACCTGGCCCTGCTCACCACG GACTGGGTGCCTCGACCTCCTGAATCCCCAGAACACA ACCCCCCTGGGCTGGGTGGTCTGGGGAACCATCGTGT CCCCCGCCTCCCGCCTACTCCTTTTTAAGCTT | |
| 3UTR-015 | Plod1; procollagen-lysine, 2-oxoglutarate 5-dioxygenase 1 | TTGGCCAGGCCTGACCCTCTTGGACCTTTCTTCTTTGC CGACAACCACTGCCCAGCAGCCTCTGGGACCTCGGGG TCCCAGGGAACCCAGTCCAGCCTCCTGGCTGTTGACTT CCCATTGCTCTTGGAGCCACCAATCAAAGAGATTCAA AGAGATTCCTGCAGGCCAGAGGCGGAACACACCTTTA TGGCTGGGCTCTCCGTGGTGTTCTGGACCCAGCCCCT GGAGACACCATTCACTTTTACTGCTTTGTAGTGACTCG TGCTCTCCAACCTGTCTTCCTGAAAAACCAAGGCCCCC TTCCCCCACCTCTTCCATGGGGTGAGACTTGAGCAGAA CAGGGGCTTCCCCAAGTTGCCCAGAAAGACTGTCTGG GTGAGAAGCCATGGCCAGAGCTTCTCCCAGGCACAGG TGTTGCACCAGGGACTTCTGCTTCAAGTTTTGGGGTAA AGACACCTGGATCAGACTCCAAGGGCTGCCCTGAGTC TGGGACTTCTGCCTCCATGGCTGGTCATGAGAGCAAA CCGTAGTCCCCTGGAGACAGCGACTCCAGAGAACCTC TTGGGAGACAGAAGAGGCATCTGTGCACAGCTCGATC TTCTACTTGCCTGTGGGAGGGGAGTGACAGGTCCAC ACACCACACTGGGTCACCCTGTCCTGGATGCCTCTGAA GAGAGGGACAGACCGTCAGAAACTGGAGAGTTTCTAT TAAAGGTCATTTAAACCA | 34 |
| 3UTR-016 | Nucb1; nucleobindin 1 | TCCTCCGGGACCCCAGCCCTCAGGATTCCTGATGCTCC AAGGCGACTGATGGGCGCTGGATGAAGTGGCACAGTC AGCTTCCCTGGGGGCTGGTGTCATGTTGGGCTCCTGGG GCGGGGGCACGGCCTGGCATTTCACGCATTGCTGCCA | 35 |

TABLE 2-continued

3'-Untranslated Regions

| 3' UTR Identifier | Name/ Description | Sequence | SEQ ID NO. |
|---|---|---|---|
| | | CCCCAGGTCCACCTGTCTCCACTTTCACAGCCTCCAAG<br>TCTGTGGCTCTTCCCTTCTGTCCTCCGAGGGGCTTGCC<br>TTCTCTCGTGTCCAGTGAGGTGCTCAGTGATCGGCTTA<br>ACTTAGAGAAGCCCGCCCCTCCCCTTCTCCGTCTGTC<br>CCAAGAGGGTCTGCTCTGAGCCTGCGTTCCTAGGTGG<br>CTCGGCCTCAGCTGCCTGGGTTGTGGCCGCCCTAGCAT<br>CCTGTATGCCCACAGCTACTGGAATCCCCGCTGCTGCT<br>CCGGGCCAAGCTTCTGGTTGATTAATGAGGGCATGGG<br>GTGGTCCCTCAAGACCTTCCCCTACCTTTTGTGGAACC<br>AGTGATGCCTCAAAGACAGTGTCCCCTCCACAGCTGG<br>GTGCCAGGGGCAGGGGATCCTCAGTATAGCCGGTGAA<br>CCCTGATACCAGGAGCCTGGGCCTCCCTGAACCCCTG<br>GCTTCCAGCCATCTCATCGCCAGCCTCCTCCTGGACCT<br>CTTGGCCCCCAGCCCCTTCCCCACACAGCCCCAGAAG<br>GGTCCCAGAGCTGACCCCACTCCAGGACCTAGGCCCA<br>GCCCCTCAGCCTCATCTGGAGCCCCTGAAGACCAGTC<br>CCACCCACCTTTCTGGCCTCATCTGACACTGCTCCGCA<br>TCCTGCTGTGTGTCCTGTTCCATGTTCCGGTTCCATCCA<br>AATACACTTTCTGGAACAAA | |
| 3UTR-017 | α-globin | CGTGGAGCCTCGGTGGCCATGCTTCTTGCCCCTTGGGC<br>CTCCCCCCAGCCCCTCCTCCCCTTCCTGCACCCGTACC<br>CCCGTGGTCTTTGAATAAAGTCTGAGTGGGCGGC | 36 |

5' UTR and Translation Initiation

Natural 5'UTRs bear features which play roles in translation initiation. They harbor signatures like Kozak sequences which are commonly known to be involved in the process by which the ribosome initiates translation of many genes. Kozak sequences have the consensus CCR(A/G) CCAUGG, where R is a purine (adenine or guanine) three bases upstream of the start codon (AUG), which is followed by another 'G'. 5'UTR also have been known to form secondary structures which are involved in elongation factor binding.

By engineering the features typically found in abundantly expressed genes of specific target organs, one can enhance the stability and protein production of the polynucleotides of the invention. For example, introduction of 5' UTR of liver-expressed mRNA, such as albumin, serum amyloid A, Apolipoprotein AB/E, transferrin, alpha fetoprotein, erythropoietin, or Factor VIII, could be used to enhance expression of a nucleic acid molecule, such as a polynucleotides, in hepatic cell lines or liver. Likewise, use of 5' UTR from other tissue-specific mRNA to improve expression in that tissue is possible for muscle (MyoD, Myosin, Myoglobin, Myogenin, Herculin), for endothelial cells (Tie-1, CD36), for myeloid cells (C/EBP, AML1, G-CSF, GM-CSF, CD11b, MSR, Fr-1, i-NOS), for leukocytes (CD45, CD18), for adipose tissue (CD36, GLUT4, ACRP30, adiponectin) and for lung epithelial cells (SP-A/B/C/D). Untranslated regions useful in the design and manufacture of polynucleotides include, but are not limited to those disclosed in co-pending, International Patent Application No. PCT/US2014/021522, the contents of which is incorporated herein by reference in its entirety.

Other non-UTR sequences may also be used as regions or subregions within the polynucleotides. For example, introns or portions of introns sequences may be incorporated into regions of the polynucleotides of the invention. Incorporation of intronic sequences may increase protein production as well as polynucleotide levels.

Combinations of features may be included in flanking regions and may be contained within other features. For example, the ORF may be flanked by a 5' UTR which may contain a strong Kozak translational initiation signal and/or a 3' UTR which may include an oligo(dT) sequence for templated addition of a poly-A tail. 5'UTR may comprise a first polynucleotide fragment and a second polynucleotide fragment from the same and/or different genes such as the 5'UTRs described in US Patent Application Publication No. 20100293625, herein incorporated by reference in its entirety.

Co-pending, co-owned International Patent Application No. PCT/US2014/021522 provides a listing of exemplary UTRs which may be utilized in the polynucleotide of the present invention as flanking regions. Variants of 5' or 3' UTRs may be utilized wherein one or more nucleotides are added or removed to the termini, including A, T, C or G.

It should be understood that any UTR from any gene may be incorporated into the regions of the polynucleotide. Furthermore, multiple wild-type UTRs of any known gene may be utilized. It is also within the scope of the present invention to provide artificial UTRs which are not variants of wild type regions. These UTRs or portions thereof may be placed in the same orientation as in the transcript from which they were selected or may be altered in orientation or location. Hence a 5' or 3' UTR may be inverted, shortened, lengthened, made with one or more other 5' UTRs or 3' UTRs. As used herein, the term "altered" as it relates to a UTR sequence, means that the UTR has been changed in some way in relation to a reference sequence. For example, a 3' or 5' UTR may be altered relative to a wild type or native UTR by the change in orientation or location as taught above or may be altered by the inclusion of additional nucleotides, deletion of nucleotides, swapping or transposition of nucleotides. Any of these changes producing an "altered" UTR (whether 3' or 5') comprise a variant UTR.

In one embodiment, a double, triple or quadruple UTR such as a 5' or 3' UTR may be used. As used herein, a "double" UTR is one in which two copies of the same UTR are encoded either in series or substantially in series. For example, a double beta-globin 3' UTR may be used as described in US Patent publication 20100129877, the contents of which are incorporated herein by reference in its entirety.

It is also within the scope of the present invention to have patterned UTRs. As used herein "patterned UTRs" are those UTRs which reflect a repeating or alternating pattern, such as ABABAB or AABBAABBAABB or ABCABCABC or variants thereof repeated once, twice, or more than 3 times. In these patterns, each letter, A, B, or C represent a different UTR at the nucleotide level.

In one embodiment, flanking regions are selected from a family of transcripts whose proteins share a common function, structure, feature of property. For example, polypeptides of interest may belong to a family of proteins which are expressed in a particular cell, tissue or at some time during development. The UTRs from any of these genes may be swapped for any other UTR of the same or different family of proteins to create a new polynucleotide. As used herein, a "family of proteins" is used in the broadest sense to refer to a group of two or more polypeptides of interest which share at least one function, structure, feature, localization, origin, or expression pattern.

In one embodiment, flanking regions may be heterologous.

In one embodiment, the 5' untranslated region may be derived from a different species than the 3' untranslated region.

The untranslated region may also include translation enhancer elements (TEE). As a non-limiting example, the TEE may include those described in US Application No. 20090226470, herein incorporated by reference in its entirety, and those known in the art.

3' UTR and the AU Rich Elements

Natural or wild type 3' UTRs are known to have stretches of Adenosines and Uridines embedded in them. These AU rich signatures are particularly prevalent in genes with high rates of turnover. Based on their sequence features and functional properties, the AU rich elements (AREs) can be separated into three classes (Chen et al, 1995): Class I AREs contain several dispersed copies of an AUUUA motif within U-rich regions. C-Myc and MyoD contain class I AREs. Class II AREs possess two or more overlapping UUAUUUA (U/A)(U/A) nonamers. Molecules containing this type of AREs include GM-CSF and TNF-a. Class III ARES are less well defined. These U rich regions do not contain an AUUUA motif. c-Jun and Myogenin are two well-studied examples of this class. Most proteins binding to the AREs are known to destabilize the messenger, whereas members of the ELAV family, most notably HuR, have been documented to increase the stability of mRNA. HuR binds to AREs of all the three classes. Engineering the HuR specific binding sites into the 3' UTR of nucleic acid molecules will lead to HuR binding and thus, stabilization of the message in vivo.

Introduction, removal or modification of 3' UTR AU rich elements (AREs) can be used to modulate the stability of polynucleotides of the invention. When engineering specific polynucleotides, one or more copies of an ARE can be introduced to make polynucleotides of the invention less stable and thereby curtail translation and decrease production of the resultant protein. Likewise, AREs can be identified and removed or mutated to increase the intracellular stability and thus increase translation and production of the resultant protein. Transfection experiments can be conducted in relevant cell lines, using polynucleotides of the invention and protein production can be assayed at various time points post-transfection. For example, cells can be transfected with different ARE-engineering molecules and by using an ELISA kit to the relevant protein and assaying protein produced at 6 hour, 12 hour, 24 hour, 48 hour, and 7 days post-transfection.

microRNA Binding Sites microRNAs (or miRNA) are 19-25 nucleotide long non-coding RNAs that bind to the 3'UTR of nucleic acid molecules and down-regulate gene expression either by reducing nucleic acid molecule stability or by inhibiting translation. The polynucleotides of the invention may comprise one or more microRNA target sequences, microRNA seqences, or microRNA seeds. Such sequences may correspond to any known microRNA such as those taught in US Publication US2005/0261218 and US Publication US2005/0059005, the contents of which are incorporated herein by reference in their entirety.

A microRNA sequence comprises a "seed" region, i.e., a sequence in the region of positions 2-8 of the mature microRNA, which sequence has perfect Watson-Crick complementarity to the miRNA target sequence. A microRNA seed may comprise positions 2-8 or 2-7 of the mature microRNA. In some embodiments, a microRNA seed may comprise 7 nucleotides (e.g., nucleotides 2-8 of the mature microRNA), wherein the seed-complementary site in the corresponding miRNA target is flanked by an adenine (A) opposed to microRNA position 1. In some embodiments, a microRNA seed may comprise 6 nucleotides (e.g., nucleotides 2-7 of the mature microRNA), wherein the seed-complementary site in the corresponding miRNA target is flanked byan adenine (A) opposed to microRNA position 1. See for example, Grimson A, Farh K K, Johnston W K, Garrett-Engele P, Lim L P, Bartel D P; Mol Cell. 2007 Jul. 6; 27(1):91-105; each of which is herein incorporated by reference in their entirety. The bases of the microRNA seed have complete complementarity with the target sequence. By engineering microRNA target sequences into the polynucleotides (e.g., in a 3'UTR like region or other region) of the invention one can target the molecule for degradation or reduced translation, provided the microRNA in question is available. This process will reduce the hazard of off target effects upon nucleic acid molecule delivery. Identification of microRNA, microRNA target regions, and their expression patterns and role in biology have been reported (Bonauer et al., Curr Drug Targets 2010 11:943-949; Anand and Cheresh Curr Opin Hematol 2011 18:171-176; Contreras and Rao Leukemia 2012 26:404-413 (2011 Dec. 20. doi: 10.1038/leu.2011.356); Bartel Cell 2009 136:215-233; Landgraf et al, Cell, 2007 129:1401-1414; each of which is herein incorporated by reference in its entirety).

For example, if the nucleic acid molecule is an mRNA and is not intended to be delivered to the liver but ends up there, then miR-122, a microRNA abundant in liver, can inhibit the expression of the gene of interest if one or multiple target sites of miR-122 are engineered into the 3' UTR region of the polynucleotides. Introduction of one or multiple binding sites for different microRNA can be engineered to further decrease the longevity, stability, and protein translation of polynucleotides.

As used herein, the term "microRNA site" refers to a microRNA target site or a microRNA recognition site, or any nucleotide sequence to which a microRNA binds or associates. It should be understood that "binding" may follow traditional Watson-Crick hybridization rules or may reflect any stable association of the microRNA with the target sequence at or adjacent to the microRNA site.

Conversely, for the purposes of the polynucleotides of the present invention, microRNA binding sites can be engineered out of (i.e. removed from) sequences in which they occur, e.g., in order to increase protein expression in specific tissues. For example, miR-122 binding sites may be removed to improve protein expression in the liver. Regulation of expression in multiple tissues can be accomplished through introduction or removal or one or several microRNA binding sites.

Examples of tissues where microRNA are known to regulate mRNA, and thereby protein expression, include, but are not limited to, liver (miR-122), muscle (miR-133, miR-206, miR-208), endothelial cells (miR-17-92, miR-126), myeloid cells (miR-142-3p, miR-142-5p, miR-16, miR-21, miR-223, miR-24, miR-27), adipose tissue (let-7, miR-30c), heart (miR-1d, miR-149), kidney (miR-192, miR-194, miR-204), and lung epithelial cells (let-7, miR-133, miR-126). MicroRNA can also regulate complex biological processes such as angiogenesis (miR-132) (Anand and Cheresh Curr Opin Hematol 2011 18:171-176; herein incorporated by reference in its entirety).

Expression profiles, microRNA and cell lines useful in the present invention include those taught in for example, in International Patent Publication Nos. WO2014113089 and WO2014081507, the contents of each of which are incorporated by reference in their entirety.

In the polynucleotides of the present invention, binding sites for microRNAs that are involved in such processes may be removed or introduced, in order to tailor the expression of the polynucleotides expression to biologically relevant cell types or to the context of relevant biological processes. A listing of microRNA, miR sequences and miR binding sites is listed in Table 9 of U.S. Provisional Application No. 61/753,661 filed Jan. 17, 2013, in Table 9 of U.S. Provisional Application No. 61/754,159 filed Jan. 18, 2013, and in Table 7 of U.S. Provisional Application No. 61/758,921 filed Jan. 31, 2013, each of which are herein incorporated by reference in their entireties.

Examples of use of microRNA to drive tissue or disease-specific gene expression are listed (Getner and Naldini, Tissue Antigens. 2012, 80:393-403; herein incorporated by reference in its entirety). In addition, microRNA seed sites can be incorporated into mRNA to decrease expression in certain cells which results in a biological improvement. An example of this is incorporation of miR-142 sites into a UGT1A1-expressing lentiviral vector. The presence of miR-142 seed sites reduced expression in hematopoietic cells, and as a consequence reduced expression in antigen-presenting cells, leading to the absence of an immune response against the virally expressed UGT1A1 (Schmitt et al., Gastroenterology 2010; 139:999-1007; Gonzalez-Asequinolaza et al. Gastroenterology 2010, 139:726-729; both herein incorporated by reference in its entirety). Incorporation of miR-142 sites into modified mRNA could not only reduce expression of the encoded protein in hematopoietic cells, but could also reduce or abolish immune responses to the mRNA-encoded protein. Incorporation of miR-142 seed sites (one or multiple) into mRNA would be important in the case of treatment of patients with complete protein deficiencies (UGT1A1 type I, LDLR-deficient patients, CRIM-negative Pompe patients, etc.).

Lastly, through an understanding of the expression patterns of microRNA in different cell types, polynucleotides can be engineered for more targeted expression in specific cell types or only under specific biological conditions. Through introduction of tissue-specific microRNA binding sites, polynucleotides could be designed that would be optimal for protein expression in a tissue or in the context of a biological condition.

Transfection experiments can be conducted in relevant cell lines, using engineered polynucleotides and protein production can be assayed at various time points post-transfection. For example, cells can be transfected with different microRNA binding site-engineering polynucleotides and by using an ELISA kit to the relevant protein and assaying protein produced at 6 hour, 12 hour, 24 hour, 48 hour, 72 hour and 7 days post-transfection. In vivo experiments can also be conducted using microRNA-binding site-engineered molecules to examine changes in tissue-specific expression of formulated polynucleotides.

In one embodiment, the polynucleotides may comprise at least one miR sequence or variant thereof. A non-exhaustive listing of miR sequences for use in polynucleotides is described in Table 9 of co-pending International Patent Application No. PCT/US13/62531 (M037.20), the contents of which are herein incorporated by reference in its entirety.

In one embodiment, the polynucleotides may comprise at least one miR sequence that bind and inhibit the untranslated region of HMG-CoA reductase or PCSK9. Non-limiting examples of the miR sequences that bind and inhibit the untranslated region of HMG-CoA reductase or PCSK9 are described in International Patent Publication No. WO2013154766, the contents of which are herein incorporated by reference in its entirety. As a non-limiting example, the polynucleotides may comprise a miR sequence that comprises miR-520d-5p, miR-224 or variants thereof (see e.g., International Patent Publication No. WO2013154766, the contents of which are herein incorporated by reference in its entirety). As another non-limiting example, the polynucleotides may comprise a miR sequence that comprises or encodes SEQ ID NO: 1, SEQ ID NO: 2, SEQ ID NO: 10 and/or SEQ ID NO: 11 of International Patent Publication No. WO2013154766, the contents of which are herein incorporated by reference in its entirety. As yet another non-limiting example, the polynucleotides may comprise a miR sequence that comprises miR-224 or variants thereof (see e.g., International Patent Publication No. WO2013154766, the contents of which are herein incorporated by reference in its entirety). As another non-limiting example, the polynucleotides may comprise a miR sequence that comprises miR-520d-5p and miR-224 or variants thereof (see e.g., International Patent Publication No. WO2013154766, the contents of which are herein incorporated by reference in its entirety).

Regions Having a 5' Cap

The 5' cap structure of a natural mRNA is involved in nuclear export, increasing mRNA stability and binds the mRNA Cap Binding Protein (CBP), which is responsible for mRNA stability in the cell and translation competency through the association of CBP with poly(A) binding protein to form the mature cyclic mRNA species. The cap further assists the removal of 5' proximal introns removal during mRNA splicing.

Endogenous mRNA molecules may be 5'-end capped generating a 5'-ppp-5'-triphosphate linkage between a terminal guanosine cap residue and the 5'-terminal transcribed sense nucleotide of the mRNA molecule. This 5'-guanylate cap may then be methylated to generate an N7-methyl-guanylate residue. The ribose sugars of the terminal and/or anteterminal transcribed nucleotides of the 5' end of the mRNA may optionally also be 2'-O-methylated. 5'-decapping through hydrolysis and cleavage of the guanylate cap structure may target a nucleic acid molecule, such as an mRNA molecule, for degradation.

In some embodiments, polynucleotides may be designed to incorporate a cap moiety. Modifications to the polynucleotides of the present invention may generate a non-hydrolyzable cap structure preventing decapping and thus increasing mRNA half-life. Because cap structure hydrolysis requires cleavage of 5'-ppp-5' phosphorodiester linkages, modified nucleotides may be used during the capping reaction. For example, a Vaccinia Capping Enzyme from New England Biolabs (Ipswich, Mass.) may be used with α-thioguanosine nucleotides according to the manufacturer's instructions to create a phosphorothioate linkage in the 5'-ppp-5' cap. Additional modified guanosine nucleotides may be used such as α-methyl-phosphonate and selenophosphate nucleotides.

Additional modifications include, but are not limited to, 2'-O-methylation of the ribose sugars of 5'-terminal and/or 5'-anteterminal nucleotides of the polynucleotide (as mentioned above) on the 2'-hydroxyl group of the sugar ring. Multiple distinct 5'-cap structures can be used to generate the 5'-cap of a nucleic acid molecule, such as a polynucleotide which functions as an mRNA molecule.

Cap analogs, which herein are also referred to as synthetic cap analogs, chemical caps, chemical cap analogs, or structural or functional cap analogs, differ from natural (i.e. endogenous, wild-type or physiological) 5'-caps in their chemical structure, while retaining cap function. Cap analogs may be chemically (i.e. non-enzymatically) or enzymatically synthesized and/or linked to the polynucleotides of the invention.

For example, the Anti-Reverse Cap Analog (ARCA) cap contains two guanines linked by a 5'-5'-triphosphate group, wherein one guanine contains an N7 methyl group as well as a 3'-O-methyl group (i.e., N7,3'-O-dimethyl-guanosine-5'-triphosphate-5'-guanosine ($m^7$G-3'mppp-G; which may equivalently be designated 3' O-Me-m7G(5)ppp(5')G). The 3'-O atom of the other, unmodified, guanine becomes linked to the 5'-terminal nucleotide of the capped polynucleotide. The N7- and 3'-O-methlyated guanine provides the terminal moiety of the capped polynucleotide.

Another exemplary cap is mCAP, which is similar to ARCA but has a 2'-O-methyl group on guanosine (i.e., N7,2'-O-dimethyl-guanosine-5'-triphosphate-5'-guanosine, $m^7$Gm-ppp-G).

In one embodiment, the cap is a dinucleotide cap analog. As a non-limiting example, the dinucleotide cap analog may be modified at different phosphate positions with a boranophosphate group or a phophoroselenoate group such as the dinucleotide cap analogs described in U.S. Pat. No. 8,519, 110, the contents of which are herein incorporated by reference in its entirety.

In another embodiment, the cap is a cap analog is a N7-(4-chlorophenoxyethyl) substituted dicucleotide form of a cap analog known in the art and/or described herein. Non-limiting examples of a N7-(4-chlorophenoxyethyl) substituted dicucleotide form of a cap analog include a N7-(4-chlorophenoxyethyl)-G(5')ppp(5')G and a N7-(4-chlorophenoxyethyl)-$m^{3'-O}$G(5')ppp(5')G cap analog (See e.g., the various cap analogs and the methods of synthesizing cap analogs described in Kore et al. Bioorganic & Medicinal Chemistry 2013 21:4570-4574; the contents of which are herein incorporated by reference in its entirety). In another embodiment, a cap analog of the present invention is a 4-chloro/bromophenoxyethyl analog.

While cap analogs allow for the concomitant capping of a polynucleotide or a region thereof, in an in vitro transcription reaction, up to 20% of transcripts can remain uncapped. This, as well as the structural differences of a cap analog from an endogenous 5'-cap structures of nucleic acids produced by the endogenous, cellular transcription machinery, may lead to reduced translational competency and reduced cellular stability.

Polynucleotides of the invention may also be capped post-manufacture (whether IVT or chemical synthesis), using enzymes, in order to generate more authentic 5'-cap structures. As used herein, the phrase "more authentic" refers to a feature that closely mirrors or mimics, either structurally or functionally, an endogenous or wild type feature. That is, a "more authentic" feature is better representative of an endogenous, wild-type, natural or physiological cellular function and/or structure as compared to synthetic features or analogs, etc., of the prior art, or which outperforms the corresponding endogenous, wild-type, natural or physiological feature in one or more respects. Non-limiting examples of more authentic 5'cap structures of the present invention are those which, among other things, have enhanced binding of cap binding proteins, increased half life, reduced susceptibility to 5' endonucleases and/or reduced 5'decapping, as compared to synthetic 5'cap structures known in the art (or to a wild-type, natural or physiological 5'cap structure). For example, recombinant Vaccinia Virus Capping Enzyme and recombinant 2'-O-methyltransferase enzyme can create a canonical 5'-5'-triphosphate linkage between the 5'-terminal nucleotide of a polynucleotide and a guanine cap nucleotide wherein the cap guanine contains an N7 methylation and the 5'-terminal nucleotide of the mRNA contains a 2'-O-methyl. Such a structure is termed the Cap1 structure. This cap results in a higher translational-competency and cellular stability and a reduced activation of cellular pro-inflammatory cytokines, as compared, e.g., to other 5'cap analog structures known in the art. Cap structures include, but are not limited to, 7mG(5')ppp(5')N,pN2p (cap 0), 7mG(5')ppp(5')NlmpNp (cap 1), and 7mG(5')-ppp(5')NlmpN2mp (cap 2).

As a non-limiting example, capping chimeric polynucleotides post-manufacture may be more efficient as nearly 100% of the chimeric polynucleotides may be capped. This is in contrast to ~80% when a cap analog is linked to a chimeric polynucleotide in the course of an in vitro transcription reaction.

According to the present invention, 5' terminal caps may include endogenous caps or cap analogs. According to the present invention, a 5' terminal cap may comprise a guanine analog. Useful guanine analogs include, but are not limited to, inosine, N1-methyl-guanosine, 2'fluoro-guanosine, 7-deaza-guanosine, 8-oxo-guanosine, 2-amino-guanosine, LNA-guanosine, and 2-azido-guanosine.

Viral Sequences

Additional viral sequences such as, but not limited to, the translation enhancer sequence of the barley yellow dwarf virus (BYDV-PAV), the Jaagsiekte sheep retrovirus (JSRV) and/or the Enzootic nasal tumor virus (See e.g., International Pub. No. WO2012129648; herein incorporated by reference in its entirety) can be engineered and inserted in the polynucleotides of the invention and can stimulate the translation of the construct in vitro and in vivo. Transfection experiments can be conducted in relevant cell lines at and protein production can be assayed by ELISA at 12 hr, 24 hr, 48 hr, 72 hr and day 7 post-transfection.

IRES Sequences

Further, provided are polynucleotides which may contain an internal ribosome entry site (IRES). First identified as a feature Picorna virus RNA, IRES plays an important role in initiating protein synthesis in absence of the 5' cap structure. An IRES may act as the sole ribosome binding site, or may serve as one of multiple ribosome binding sites of an mRNA. Polynucleotides containing more than one functional ribosome binding site may encode several peptides or polypeptides that are translated independently by the ribosomes ("multicistronic nucleic acid molecules"). When polynucleotides are provided with an IRES, further optionally provided is a second translatable region. Examples of IRES sequences that can be used according to the invention include without limitation, those from picornaviruses (e.g. FMDV), pest viruses (CFFV), polio viruses (PV), encephalomyocarditis viruses (ECMV), foot-and-mouth disease viruses (FMDV), hepatitis C viruses (HCV), classical swine fever viruses (CSFV), murine leukemia virus (MLV), simian immune deficiency viruses (SIV) or cricket paralysis viruses (CrPV).

Poly-A Tails

During RNA processing, a long chain of adenine nucleotides (poly-A tail) may be added to a polynucleotide such as an mRNA molecule in order to increase stability. Immediately after transcription, the 3' end of the transcript may be cleaved to free a 3' hydroxyl. Then poly-A polymerase adds a chain of adenine nucleotides to the RNA. The process, called polyadenylation, adds a poly-A tail that can be between, for example, approximately 80 to approximately 250 residues long, including approximately 80, 90, 100, 110, 120, 130, 140, 150, 160, 170, 180, 190, 200, 210, 220, 230, 240 or 250 residues long.

PolyA tails may also be added after the construct is exported from the nucleus.

According to the present invention, terminal groups on the poly A tail may be incorporated for stabilization. Polynucleotides of the present invention may include des-3' hydroxyl tails. They may also include structural moieties or 2'-Omethyl modifications as taught by Junjie Li, et al. (Current Biology, Vol. 15, 1501-1507, Aug. 23, 2005, the contents of which are incorporated herein by reference in its entirety).

The polynucleotides of the present invention may be designed to encode transcripts with alternative polyA tail structures including histone mRNA. According to Norbury, "Terminal uridylation has also been detected on human replication-dependent histone mRNAs. The turnover of these mRNAs is thought to be important for the prevention of potentially toxic histone accumulation following the completion or inhibition of chromosomal DNA replication. These mRNAs are distinguished by their lack of a 3' poly(A) tail, the function of which is instead assumed by a stable stem-loop structure and its cognate stem-loop binding protein (SLBP); the latter carries out the same functions as those of PABP on polyadenylated mRNAs" (Norbury, "Cytoplasmic RNA: a case of the tail wagging the dog," Nature Reviews Molecular Cell Biology; AOP, published online 29 Aug. 2013; doi:10.1038/nrm3645) the contents of which are incorporated herein by reference in its entirety.

Unique poly-A tail lengths provide certain advantages to the polynucleotides of the present invention.

Generally, the length of a poly-A tail, when present, is greater than 30 nucleotides in length. In another embodiment, the poly-A tail is greater than 35 nucleotides in length (e.g., at least or greater than about 35, 40, 45, 50, 55, 60, 70, 80, 90, 100, 120, 140, 160, 180, 200, 250, 300, 350, 400, 450, 500, 600, 700, 800, 900, 1,000, 1,100, 1,200, 1,300, 1,400, 1,500, 1,600, 1,700, 1,800, 1,900, 2,000, 2,500, and 3,000 nucleotides). In some embodiments, the polynucleotide or region thereof includes from about 30 to about 3,000 nucleotides (e.g., from 30 to 50, from 30 to 100, from 30 to 250, from 30 to 500, from 30 to 750, from 30 to 1,000, from 30 to 1,500, from 30 to 2,000, from 30 to 2,500, from 50 to 100, from 50 to 250, from 50 to 500, from 50 to 750, from 50 to 1,000, from 50 to 1,500, from 50 to 2,000, from 50 to 2,500, from 50 to 3,000, from 100 to 500, from 100 to 750, from 100 to 1,000, from 100 to 1,500, from 100 to 2,000, from 100 to 2,500, from 100 to 3,000, from 500 to 750, from 500 to 1,000, from 500 to 1,500, from 500 to 2,000, from 500 to 2,500, from 500 to 3,000, from 1,000 to 1,500, from 1,000 to 2,000, from 1,000 to 2,500, from 1,000 to 3,000, from 1,500 to 2,000, from 1,500 to 2,500, from 1,500 to 3,000, from 2,000 to 3,000, from 2,000 to 2,500, and from 2,500 to 3,000).

In one embodiment, the poly-A tail is designed relative to the length of the overall polynucleotide or the length of a particular region of the polynucleotide. This design may be based on the length of a coding region, the length of a particular feature or region or based on the length of the ultimate product expressed from the polynucleotides.

In this context the poly-A tail may be 10, 20, 30, 40, 50, 60, 70, 80, 90, or 100% greater in length than the polynucleotide or feature thereof. The poly-A tail may also be designed as a fraction of the polynucleotides to which it belongs. In this context, the poly-A tail may be 10, 20, 30, 40, 50, 60, 70, 80, or 90% or more of the total length of the construct, a construct region or the total length of the construct minus the poly-A tail. Further, engineered binding sites and conjugation of polynucleotides for Poly-A binding protein may enhance expression.

Additionally, multiple distinct polynucleotides may be linked together via the PABP (Poly-A binding protein) through the 3'-end using modified nucleotides at the 3'-terminus of the poly-A tail. Transfection experiments can be conducted in relevant cell lines at and protein production can be assayed by ELISA at 12 hr, 24 hr, 48 hr, 72 hr and day 7 post-transfection.

In one embodiment, the polynucleotides of the present invention are designed to include a polyA-G Quartet region. The G-quartet is a cyclic hydrogen bonded array of four guanine nucleotides that can be formed by G-rich sequences in both DNA and RNA. In this embodiment, the G-quartet is incorporated at the end of the poly-A tail. The resultant polynucleotide is assayed for stability, protein production and other parameters including half-life at various time points. It has been discovered that the polyA-G quartet results in protein production from an mRNA equivalent to at least 75% of that seen using a poly-A tail of 120 nucleotides alone.

Start Codon Region

In some embodiments, the polynucleotides of the present invention may have regions that are analogous to or function like a start codon region.

In one embodiment, the translation of a polynucleotide may initiate on a codon which is not the start codon AUG. Translation of the polynucleotide may initiate on an alternative start codon such as, but not limited to, ACG, AGG, AAG, CTG/CUG, GTG/GUG, ATA/AUA, ATT/AUU, TTG/UUG (see Touriol et al. Biology of the Cell 95 (2003) 169-178 and Matsuda and Mauro PLoS ONE, 2010 5:11; the contents of each of which are herein incorporated by reference in its entirety). As a non-limiting example, the translation of a polynucleotide begins on the alternative start codon ACG. As another non-limiting example, polynucleotide translation begins on the alternative start codon CTG or CUG. As yet another non-limiting example, the translation of a polynucleotide begins on the alternative start codon GTG or GUG.

Nucleotides flanking a codon that initiates translation such as, but not limited to, a start codon or an alternative start codon, are known to affect the translation efficiency, the length and/or the structure of the polynucleotide. (See e.g., Matsuda and Mauro PLoS ONE, 2010 5:11; the contents of which are herein incorporated by reference in its entirety). Masking any of the nucleotides flanking a codon that initiates translation may be used to alter the position of translation initiation, translation efficiency, length and/or structure of a polynucleotide.

In one embodiment, a masking agent may be used near the start codon or alternative start codon in order to mask or hide the codon to reduce the probability of translation initiation at the masked start codon or alternative start codon. Non-limiting examples of masking agents include antisense locked nucleic acids (LNA) polynucleotides and exon-junction complexes (EJCs) (See e.g., Matsuda and Mauro describing masking agents LNA polynucleotides and EJCs (PLoS ONE, 2010 5:11); the contents of which are herein incorporated by reference in its entirety).

In another embodiment, a masking agent may be used to mask a start codon of a polynucleotide in order to increase the likelihood that translation will initiate on an alternative start codon.

In one embodiment, a masking agent may be used to mask a first start codon or alternative start codon in order to increase the chance that translation will initiate on a start codon or alternative start codon downstream to the masked start codon or alternative start codon.

In one embodiment, a start codon or alternative start codon may be located within a perfect complement for a miR binding site. The perfect complement of a miR binding site may help control the translation, length and/or structure of the polynucleotide similar to a masking agent. As a non-limiting example, the start codon or alternative start codon may be located in the middle of a perfect complement for a miR-122 binding site. The start codon or alternative start codon may be located after the first nucleotide, second nucleotide, third nucleotide, fourth nucleotide, fifth nucleotide, sixth nucleotide, seventh nucleotide, eighth nucleotide, ninth nucleotide, tenth nucleotide, eleventh nucleotide, twelfth nucleotide, thirteenth nucleotide, fourteenth nucleotide, fifteenth nucleotide, sixteenth nucleotide, seventeenth nucleotide, eighteenth nucleotide, nineteenth nucleotide, twentieth nucleotide or twenty-first nucleotide.

In another embodiment, the start codon of a polynucleotide may be removed from the polynucleotide sequence in order to have the translation of the polynucleotide begin on a codon which is not the start codon. Translation of the polynucleotide may begin on the codon following the removed start codon or on a downstream start codon or an alternative start codon. In a non-limiting example, the start codon ATG or AUG is removed as the first 3 nucleotides of the polynucleotide sequence in order to have translation initiate on a downstream start codon or alternative start codon. The polynucleotide sequence where the start codon was removed may further comprise at least one masking agent for the downstream start codon and/or alternative start codons in order to control or attempt to control the initiation of translation, the length of the polynucleotide and/or the structure of the polynucleotide.

Stop Codon Region

In one embodiment, the polynucleotides of the present invention may include at least two stop codons before the 3' untranslated region (UTR). The stop codon may be selected from TGA, TAA and TAG. In one embodiment, the polynucleotides of the present invention include the stop codon TGA and one additional stop codon. In a further embodiment the addition stop codon may be TAA. In another embodiment, the polynucleotides of the present invention include three stop codons.

Signal Sequences

The polynucleotides may also encode additional features which facilitate trafficking of the polypeptides to therapeutically relevant sites. One such feature which aids in protein trafficking is the signal sequence. As used herein, a "signal sequence" or "signal peptide" is a polynucleotide or polypeptide, respectively, which is from about 9 to 200 nucleotides (3-60 amino acids) in length which is incorporated at the 5' (or N-terminus) of the coding region or polypeptide encoded, respectively. Addition of these sequences result in trafficking of the encoded polypeptide to the endoplasmic reticulum through one or more secretory pathways. Some signal peptides are cleaved from the protein by signal peptidase after the proteins are transported.

Additional signal sequences which may be utilized in the present invention include those taught in, for example, databases such as those found at www.signalpeptide.de/ or proline.bic.nus.edu.sg/spdb/. Those described in U.S. Pat. Nos. 8,124,379; 7,413,875 and 7,385,034 are also within the scope of the invention and the contents of each are incorporated herein by reference in their entirety.

Target Selection

According to the present invention, the polynucleotide may comprise at least a first region of linked nucleosides encoding at least one polypeptide of interest. The polypeptides of interest or "Targets" of the present invention are listed in Table 3 below. Shown in Table 3, in addition to the name and description of the gene encoding the polypeptide of interest are the ENSEMBL Transcript ID (ENST), the ENSEMBL Protein ID (ENSP) and when available the optimized sequence ID (OPT SEQ ID). For any particular gene there may exist one or more variants or isoforms. Where these exist, they are shown in the table as well. It will be appreciated by those of skill in the art that disclosed in the Table are potential flanking regions. These are encoded in each ENST transcript either to the 5' (upstream) or 3' (downstream) of the ORF or coding region. The coding region is definitively and specifically disclosed by teaching the ENSP sequence. Consequently, the sequences taught flanking that encoding the protein are considered flanking regions. It is also possible to further characterize the 5' and 3' flanking regions by utilizing one or more available databases or algorithms. Databases have annotated the features contained in the flanking regions of the ENST transcripts and these are available in the art.

TABLE 3

Targets

| Target No | Gene | Description | ENSP | Protein SEQ ID NO | ENST | Transcript SEQ ID NO |
|---|---|---|---|---|---|---|
| 1 | LDLR | low density lipoprotein receptor | 397829 | 37 | 455727 | 56, 70, 75, 82, 89, 96, 103 |
| 2 | LDLR | low density lipoprotein receptor | 440520 | 38 | 535915 | 57, 71, 76, 83, 90, 97, 104 |
| 3 | LDLR | low density lipoprotein receptor | 437639 | 39 | 545707 | 58, 72, 77, 84, 91, 98, 105 |
| 4 | LDLR | low density lipoprotein receptor | 453346 | 40 | 558013 | 59, 73, 78, 85, 92, 99, 106 |
| 5 | LDLR | low density lipoprotein receptor | 252444 | 41 | 252444 | 60, 79, 86, 93, 100, 107 |
| 6 | LDLR | low density lipoprotein receptor | 454147 | 42 | 561343 | 61, 80, 87, 94, 101, 108 |
| 7 | LDLR | low density lipoprotein receptor | 454071 | 43 | 558518 | 62, 74, 81, 88, 95, 102, 109-718 |
| 8 | LDLR | low density lipoprotein receptor | none | — | | 63 |
| 9 | LDLR1_D331E PCSK9 mutant | low density lipoprotein receptor/PCSK9 mutant | none | 44 | none | 64 |
| 10 | LDLR1_L339D PCSK9 mutant | low density lipoprotein receptor/PCSK9 mutant | none | 45 | none | 65 |
| 11 | LDLR1_N316A PCSK9 Mutant | low density lipoprotein receptor/PCSK9 mutant | none | 46 | none | 66 |
| 12 | LDLR1_E317A PCSK9 Mutant | low density lipoprotein receptor/PCSK9 mutant | none | 47 | none | 67 |
| 13 | LDLR1_Y336A PCSK9 Mutant | low density lipoprotein receptor/PCSK9 mutant | none | 48 | none | 68 |
| 14 | LDLR1_4A | low density lipoprotein receptor/PCSK9 mutant | none | 49 | none | 69 |
| 15 | LDLR_N316A, K830R, C839A | low density lipoprotein receptor/PCSK9/ubiquitation mutant | none | 50 | none | — |
| 16 | LDLR_N316A, K816R, K830R, C839A | low density lipoprotein receptor/PCSK9/ubiquitation mutant | none | 51 | none | — |
| 17 | LDLR_L339D, K830R, C839A | low density lipoprotein receptor/PCSK9/ubiquitation mutant | none | 52 | none | — |
| 18 | LDLR_L339D, K816R, K830R, C839A | low density lipoprotein receptor/PCSK9/ubiquitation mutant | none | 53 | none | — |
| 19 | LDLR_K830R, C839A | low density lipoprotein receptor/ubiquitation mutant | none | 54 | none | — |
| 20 | LDLR_K816R, K830R, C839A | low density lipoprotein receptor/ubiquitation mutant | none | 55 | none | — |

Table 3 shows human LDLR protein sequences including LDLR protein sequences comprising at least one mutation (e.g., a LDLR cell surface expression-enhancing mutation, a mutation increasing the residence time of LDLR at the cell surface or a mutation resulting in increased levels of LDLR at the cell surface) and the corresponding DNA and/or mRNA constructs.

Protein Cleavage Signals and Sites

In one embodiment, the polypeptides of the present invention may include at least one protein cleavage signal containing at least one protein cleavage site. The protein cleavage site may be located at the N-terminus, the C-terminus, at any space between the N- and the C-termini such as, but not limited to, half-way between the N- and C-termini, between the N-terminus and the half way point, between the half way point and the C-terminus, and combinations thereof.

The polypeptides of the present invention may include, but is not limited to, a proprotein convertase (or prohormone convertase), thrombin or Factor Xa protein cleavage signal. Proprotein convertases are a family of nine proteinases, comprising seven basic amino acid-specific subtilisin-like serine proteinases related to yeast kexin, known as prohormone convertase 1/3 (PC1/3), PC2, furin, PC4, PC5/6, paired basic amino-acid cleaving enzyme 4 (PACE4) and PC7, and two other subtilases that cleave at non-basic residues, called subtilisin kexin isozyme 1 (SKI-1) and proprotein convertase subtilisin kexin 9 (PCSK9).

In one embodiment, the polynucleotides of the present invention may be engineered such that the polynucleotide contains at least one encoded protein cleavage signal. The encoded protein cleavage signal may be located in any region including but not limited to before the start codon, after the start codon, before the coding region, within the coding region such as, but not limited to, half way in the coding region, between the start codon and the half way point, between the half way point and the stop codon, after the coding region, before the stop codon, between two stop codons, after the stop codon and combinations thereof.

In one embodiment, the polynucleotides of the present invention may include at least one encoded protein cleavage signal containing at least one protein cleavage site. The encoded protein cleavage signal may include, but is not limited to, a proprotein convertase (or prohormone convertase), thrombin and/or Factor Xa protein cleavage signal.

As a non-limiting example, U.S. Pat. No. 7,374,930 and U.S. Pub. No. 20090227660, herein incorporated by reference in their entireties, use a furin cleavage site to cleave the N-terminal methionine of GLP-1 in the expression product from the Golgi apparatus of the cells. In one embodiment, the polypeptides of the present invention include at least one protein cleavage signal and/or site with the proviso that the polypeptide is not GLP-1.

Insertions and Substitutions

In one embodiment, the 5'UTR of the polynucleotide may be replaced by the insertion of at least one region and/or string of nucleosides of the same base. The region and/or string of nucleotides may include, but is not limited to, at least 3, at least 4, at least 5, at least 6, at least 7 or at least 8 nucleotides and the nucleotides may be natural and/or unnatural. As a non-limiting example, the group of nucleotides may include 5-8 adenine, cytosine, thymine, a string of any of the other nucleotides disclosed herein and/or combinations thereof.

In one embodiment, the 5'UTR of the polynucleotide may be replaced by the insertion of at least two regions and/or strings of nucleotides of two different bases such as, but not limited to, adenine, cytosine, thymine, any of the other nucleotides disclosed herein and/or combinations thereof. For example, the 5'UTR may be replaced by inserting 5-8 adenine bases followed by the insertion of 5-8 cytosine bases. In another example, the 5'UTR may be replaced by inserting 5-8 cytosine bases followed by the insertion of 5-8 adenine bases.

In one embodiment, the polynucleotide may include at least one substitution and/or insertion downstream of the transcription start site which may be recognized by an RNA polymerase. As a non-limiting example, at least one substitution and/or insertion may occur downstream the transcription start site by substituting at least one nucleic acid in the region just downstream of the transcription start site (such as, but not limited to, +1 to +6). Changes to region of nucleotides just downstream of the transcription start site may affect initiation rates, increase apparent nucleotide triphosphate (NTP) reaction constant values, and increase the dissociation of short transcripts from the transcription complex curing initial transcription (Brieba et al, Biochemistry (2002) 41: 5144-5149; herein incorporated by reference in its entirety). The modification, substitution and/or insertion of at least one nucleoside may cause a silent mutation of the sequence or may cause a mutation in the amino acid sequence.

In one embodiment, the polynucleotide may include the substitution of at least 1, at least 2, at least 3, at least 4, at least 5, at least 6, at least 7, at least 8, at least 9, at least 10, at least 11, at least 12 or at least 13 guanine bases downstream of the transcription start site.

In one embodiment, the polynucleotide may include the substitution of at least 1, at least 2, at least 3, at least 4, at least 5 or at least 6 guanine bases in the region just downstream of the transcription start site. As a non-limiting example, if the nucleotides in the region are GGGAGA the guanine bases may be substituted by at least 1, at least 2, at least 3 or at least 4 adenine nucleotides. In another non-limiting example, if the nucleotides in the region are GGGAGA the guanine bases may be substituted by at least 1, at least 2, at least 3 or at least 4 cytosine bases. In another non-limiting example, if the nucleotides in the region are GGGAGA the guanine bases may be substituted by at least 1, at least 2, at least 3 or at least 4 thymine, and/or any of the nucleotides described herein.

In one embodiment, the polynucleotide may include at least one substitution and/or insertion upstream of the start codon. For the purpose of clarity, one of skill in the art would appreciate that the start codon is the first codon of the protein coding region whereas the transcription start site is the site where transcription begins. The polynucleotide may include, but is not limited to, at least 1, at least 2, at least 3, at least 4, at least 5, at least 6, at least 7 or at least 8 substitutions and/or insertions of nucleotide bases. The nucleotide bases may be inserted or substituted at 1, at least 1, at least 2, at least 3, at least 4 or at least 5 locations upstream of the start codon. The nucleotides inserted and/or substituted may be the same base (e.g., all A or all C or all T or all G), two different bases (e.g., A and C, A and T, or C and T), three different bases (e.g., A, C and T or A, C and T) or at least four different bases. As a non-limiting example, the guanine base upstream of the coding region in the polynucleotide may be substituted with adenine, cytosine, thymine, or any of the nucleotides described herein. In another non-limiting example the substitution of guanine bases in the polynucleotide may be designed so as to leave one guanine base in the region downstream of the transcription start site and before the start codon (see Esvelt et al. Nature (2011) 472(7344): 499-503; the contents of which is herein incorporated by reference in its entirety). As a non-limiting example, at least 5 nucleotides may be inserted at 1 location downstream of the transcription start site but upstream of the start codon and the at least 5 nucleotides may be the same base type.

Incorporating Post Transcriptional Control Modulators

In one embodiment, the polynucleotides of the present invention may include at least one post transcriptional control modulator. These post transcriptional control modulators may be, but are not limited to, small molecules, compounds and regulatory sequences. As a non-limiting example, post transcriptional control may be achieved using small molecules identified by PTC Therapeutics Inc. (South Plainfield, N.J.) using their GEMS' (Gene Expression Modulation by Small-Moleclues) screening technology.

The post transcriptional control modulator may be a gene expression modulator which is screened by the method detailed in or a gene expression modulator described in International Publication No. WO2006022712, herein incorporated by reference in its entirety. Methods identifying RNA regulatory sequences involved in translational control are described in International Publication No. WO2004067728, herein incorporated by reference in its entirety; methods identifying compounds that modulate untranslated region dependent expression of a gene are described in International Publication No. WO2004065561, herein incorporated by reference in its entirety.

In one embodiment, the polynucleotides of the present invention may include at least one post transcriptional control modulator is located in the 5' and/or the 3' untranslated region of the polynucleotides of the present invention.

In another embodiment, the polynucleotides of the present invention may include at least one post transcription control modulator to modulate premature translation termination.

The post transcription control modulators may be compounds described in or a compound found by methods outlined in International Publication Nos. WO2004010106, WO2006044456, WO2006044682, WO2006044503 and WO2006044505, each of which is herein incorporated by reference in its entirety. As a non-limiting example, the compound may bind to a region of the 28S ribosomal RNA in order to modulate premature translation termination (See e.g., WO2004010106, herein incorporated by reference in its entirety).

In one embodiment, polynucleotides of the present invention may include at least one post transcription control modulator to alter protein expression. As a non-limiting example, the expression of VEGF may be regulated using the compounds described in or a compound found by the methods described in International Publication Nos. WO2005118857, WO2006065480, WO2006065479 and WO2006058088, each of which is herein incorporated by reference in its entirety.

The polynucleotides of the present invention may include at least one post transcription control modulator to control translation. In one embodiment, the post transcription control modulator may be a RNA regulatory sequence. As a non-limiting example, the RNA regulatory sequence may be identified by the methods described in International Publication No. WO2006071903, herein incorporated by reference in its entirety.

II. Design, Synthesis and Quantitation of Polynucleotides
Design-Codon Optimization The polynucleotides, their regions or parts or subregions may be codon optimized. Codon optimization methods are known in the art and may be useful in efforts to achieve one or more of several goals. These goals include to match codon frequencies in target and host organisms to ensure proper folding, bias GC content to increase mRNA stability or reduce secondary structures, minimize tandem repeat codons or base runs that may impair gene construction or expression, customize transcriptional and translational control regions, insert or remove protein trafficking sequences, remove/add post translation modification sites in encoded protein (e.g. glycosylation sites), add, remove or shuffle protein domains, insert or delete restriction sites, modify ribosome binding sites and mRNA degradation sites, to adjust translational rates to allow the various domains of the protein to fold properly, or to reduce or eliminate problem secondary structures within the polynucleotide. Codon optimization tools, algorithms and services are known in the art, non-limiting examples include services from GeneArt (Life Technologies), DNA2.0 (Menlo Park Calif.) and/or proprietary methods. In one embodiment, the ORF sequence is optimized using optimization algorithms. Codon options for each amino acid are given in Table 4.

TABLE 4

| Amino Acid | Single Letter Code | Codon Options |
|---|---|---|
| Isoleucine | I | ATT, ATC, ATA |
| Leucine | L | CTT, CTC, CTA, CTG, TTA, TTG |
| Valine | V | GTT, GTC, GTA, GTG |
| Phenylalanine | F | TTT, TTC |
| Methionine | M | ATG |
| Cysteine | C | TGT, TGC |
| Alanine | A | GCT, GCC, GCA, GCG |
| Glycine | G | GGT, GGC, GGA, GGG |
| Proline | P | CCT, CCC, CCA, CCG |
| Threonine | T | ACT, ACC, ACA, ACG |
| Serine | S | TCT, TCC, TCA, TCG, AGT, AGC |
| Tyrosine | Y | TAT, TAC |
| Tryptophan | W | TGG |
| Glutamine | Q | CAA, CAG |
| Asparagine | N | AAT, AAC |
| Histidine | H | CAT, CAC |
| Glutamic acid | E | GAA, GAG |
| Aspartic acid | D | GAT, GAC |
| Lysine | K | AAA, AAG |
| Arginine | R | CGT, CGC, CGA, CGG, AGA, AGG |
| Selenocysteine | Sec | UGA in mRNA in presence of Selenocysteine insertion element (SECIS) |
| Stop codons | Stop | TAA, TAG, TGA |

Features, which may be considered beneficial in some embodiments of the present invention, may be encoded by regions of the polynucleotide and such regions may be upstream (5') or downstream (3') to a region which encodes a polypeptide. These regions may be incorporated into the polynucleotide before and/or after codon optimization of the protein encoding region or open reading frame (ORF). It is not required that a polynucleotide contain both a 5' and 3' flanking region. Examples of such features include, but are not limited to, untranslated regions (UTRs), Kozak sequences, an oligo(dT) sequence, and detectable tags and may include multiple cloning sites which may have XbaI recognition.

In some embodiments, a 5' UTR and/or a 3' UTR region may be provided as flanking regions. Multiple 5' or 3' UTRs may be included in the flanking regions and may be the same or of different sequences. Any portion of the flanking regions, including none, may be codon optimized and any may independently contain one or more different structural or chemical modifications, before and/or after codon optimization.

After optimization (if desired), the polynucleotides components are reconstituted and transformed into a vector such as, but not limited to, plasmids, viruses, cosmids, and artificial chromosomes. For example, the optimized polynucleotide may be reconstituted and transformed into chemically competent E. coli, yeast, neurospora, maize, drosophila, etc. where high copy plasmid-like or chromosome structures occur by methods described herein.

Synthetic polynucleotides and their nucleic acid analogs play an important role in the research and studies of biochemical processes. Various enzyme-assisted and chemical-based methods have been developed to synthesize polynucleotides and nucleic acids.

Enzymatic methods include in vitro transcription which uses RNA polymerases to synthesize the polynucleotides of the present invention. Enzymatic methods and RNA polymerases for transcription are described in International Patent Application No. PCT/US2014/53907, the contents of which are herein incorporated by reference in its entirety, such as in paragraphs [000276]-[000297].

Solid-phase chemical synthesis may be used to manufacture the polynucleotides described herein or portions thereof. Solid-phase chemical synthesis manufacturing of the polynucleotides described herein are described in International Patent Application No. PCT/US2014/53907, the contents of which are herein incorporated by reference in its entirety, such as in paragraphs [000298]-[000307].

Liquid phase chemical synthesis may be used to manufacture the polynucleotides described herein or portions thereof. Liquid phase chemical synthesis manufacturing of the polynucleotides described herein are described in International Patent Application No. PCT/US2014/53907, the contents of which are herein incorporated by reference in its entirety, such as in paragraph [000308].

Combinations of different synthetic methods may be used to manufacture the polynucleotides described herein or portions thereof. These combinations are described in International Patent Application No. PCT/US2014/53907, the contents of which are herein incorporated by reference in its entirety, such as in paragraphs [000309]-[000312].

Small region synthesis which may be used for regions or subregions of the polynucleotides of the present invention. These synthesis methods are described in International Patent Application No. PCT/US2014/53907, the contents of which are herein incorporated by reference in its entirety, such as in paragraphs [000313]-[000314].

Ligation of polynucleotide regions or subregions may be used to prepare the polynucleotides described herein. These ligation methods are described in International Patent Application No. PCT/US2014/53907, the contents of which are herein incorporated by reference in its entirety, such as in paragraphs [000315]-[000322].

Modified and Conjugated Polynucleotides

Non-natural modified nucleotides may be introduced to polynucleotides or nucleic acids during synthesis or post-synthesis of the chains to achieve desired functions or properties. The modifications may be on internucleotide lineage, the purine or pyrimidine bases, or sugar. The modification may be introduced at the terminal of a chain or anywhere else in the chain; with chemical synthesis or with a polymerase enzyme. For example, hexitol nucleic acids (HNAs) are nuclease resistant and provide strong hybridization to RNA. Short messenger RNAs (mRNAs) with hexitol residues in two codons have been constructed (Lavrik et al., *Biochemistry*, 40, 11777-11784 (2001), the contents of which are incorporated herein by reference in their entirety). The antisense effects of a chimeric HNA gapmer oligonucleotide comprising a phosphorothioate central sequence flanked by 5' and 3' HNA sequences have also been studied (See e.g., Kang et al., *Nucleic Acids Research*, vol. 32(4), 4411-4419 (2004), the contents of which are incorporated herein by reference in their entirety). The preparation and uses of modified nucleotides comprising 6-member rings in RNA interference, antisense therapy or other applications are disclosed in US Pat. Application No. 2008/0261905, US Pat. Application No. 2010/0009865, and PCT Application No. WO97/30064 to Herdewijn et al.; the contents of each of which are herein incorporated by reference in their entireties). Modified nucleic acids and their synthesis are disclosed in co-pending International Patent Publication No. WO2013052523, the contents of which are incorporated herein by reference for their entirety. The synthesis and strategy of modified polynucleotides is reviewed by Verma and Eckstein in *Annual Review of Biochemistry*, vol. 76, 99-134 (1998), the contents of which are incorporated herein by reference in their entirety.

Either enzymatic or chemical ligation methods can be used to conjugate polynucleotides or their regions with different functional blocks, such as fluorescent labels, liquids, nanoparticles, delivery agents, etc. The conjugates of polynucleotides and modified polynucleotides are reviewed by Goodchild in *Bioconjugate Chemistry*, vol. 1(3), 165-187 (1990), the contents of which are incorporated herein by reference in their entirety. U.S. Pat. No. 6,835,827 and U.S. Pat. No. 6,525,183 to Vinayak et al. (the contents of each of which are herein incorporated by reference in their entireties) teach synthesis of labeled oligonucleotides using a labeled solid support.

Quantification

In one embodiment, the polynucleotides of the present invention may be quantified in exosomes or when derived from one or more bodily fluid. As used herein "bodily fluids" include peripheral blood, serum, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, and umbilical cord blood. Alternatively, exosomes may be retrieved from an organ selected from the group consisting of lung, heart, pancreas, stomach, intestine, bladder, kidney, ovary, testis, skin, colon, breast, prostate, brain, esophagus, liver, and placenta.

In the exosome quantification method, a sample of not more than 2 mL is obtained from the subject and the exosomes isolated by size exclusion chromatography, density gradient centrifugation, differential centrifugation, nanomembrane ultrafiltration, immunoabsorbent capture, affinity purification, microfluidic separation, or combinations thereof. In the analysis, the level or concentration of a polynucleotide may be an expression level, presence, absence, truncation or alteration of the administered construct. It is advantageous to correlate the level with one or more clinical phenotypes or with an assay for a human disease biomarker. The assay may be performed using construct specific probes, cytometry, qRT-PCR, real-time PCR, PCR, flow cytometry, electrophoresis, mass spectrometry, or combinations thereof while the exosomes may be isolated using immunohistochemical methods such as enzyme linked immunosorbent assay (ELISA) methods. Exosomes may also be isolated by size exclusion chromatography, density gradient centrifugation, differential centrifugation, nanomembrane ultrafiltration, immunoabsorbent capture, affinity purification, microfluidic separation, or combinations thereof.

These methods afford the investigator the ability to monitor, in real time, the level of polynucleotides remaining or delivered. This is possible because the polynucleotides of the present invention differ from the endogenous forms due to the structural or chemical modifications.

In one embodiment, the polynucleotide may be quantified using methods such as, but not limited to, ultraviolet visible spectroscopy (UV/Vis). A non-limiting example of a UV/Vis spectrometer is a NANODROP® spectrometer (Thermo-Fisher, Waltham, Mass.). The quantified polynucleotide may be analyzed in order to determine if the polynucleotide may be of proper size, check that no degradation of the polynucleotide has occurred. Degradation of the polynucleotide may be checked by methods such as, but not limited to, agarose gel electrophoresis, HPLC based purification methods such as, but not limited to, strong anion exchange HPLC, weak anion exchange HPLC, reverse phase HPLC (RP-HPLC), and hydrophobic interaction HPLC (HIC-HPLC), liquid chromatography-mass spectrometry (LCMS), capillary electrophoresis (CE) and capillary gel electrophoresis (CGE).

Purification

Purification of the polynucleotides described herein may include, but is not limited to, polynucleotide clean-up, quality assurance and quality control. Clean-up may be performed by methods known in the arts such as, but not limited to, AGENCOURT® beads (Beckman Coulter Genomics, Danvers, Mass.), poly-T beads, LNA™ oligo-T capture probes (EXIQON® Inc, Vedbaek, Denmark) or HPLC based purification methods such as, but not limited to, strong anion exchange HPLC, weak anion exchange HPLC, reverse phase HPLC (RP-HPLC), and hydrophobic interaction HPLC (HIC-HPLC). The term "purified" when used in relation to a polynucleotide such as a "purified polynucleotide" refers to one that is separated from at least one contaminant. As used herein, a "contaminant" is any substance which makes another unfit, impure or inferior. Thus, a purified polynucleotide (e.g., DNA and RNA) is present in a form or setting different from that in which it is found in nature, or a form or setting different from that which existed prior to subjecting it to a treatment or purification method.

A quality assurance and/or quality control check may be conducted using methods such as, but not limited to, gel electrophoresis, UV absorbance, or analytical HPLC.

In another embodiment, the polynucleotides may be sequenced by methods including, but not limited to reverse-transcriptase-PCR.

III. Modifications

As used herein in a polynucleotide (such as a chimeric polynucleotide, IVT polynucleotide or a circular polynucleotide), the terms "chemical modification" or, as appropriate, "chemically modified" refer to modification with respect to adenosine (A), guanosine (G), uridine (U), thymidine (T) or cytidine (C) ribo- or deoxyribonucleosides in one or more of their position, pattern, percent or population. Generally, herein, these terms are not intended to refer to the ribonucleotide modifications in naturally occurring 5'-terminal mRNA cap moieties.

In a polypeptide, the term "modification" refers to a modification as compared to the canonical set of 20 amino acids.

The modifications may be various distinct modifications. In some embodiments, the regions may contain one, two, or more (optionally different) nucleoside or nucleotide modifications. In some embodiments, a modified polynucleotide, introduced to a cell may exhibit reduced degradation in the cell, as compared to an unmodified polynucleotide.

Modifications which are useful in the present invention include, but are not limited to those in Table 5. Noted in the table are the symbol of the modification, the nucleobase type and whether the modification is naturally occurring or not.

TABLE 5

Modifications

| Name | Symbol | Base | Naturally Occurring |
|---|---|---|---|
| 2-methylthio-N6-(cis-hydroxyisopentenyl)adenosine | ms2i6A | A | YES |
| 2-methylthio-N6-methyladenosine | ms2m6A | A | YES |
| 2-methylthio-N6-threonyl carbamoyladenosine | ms2t6A | A | YES |
| N6-glycinylcarbamoyladenosine | g6A | A | YES |
| N6-isopentenyladenosine | i6A | A | YES |
| N6-methyladenosine | m6A | A | YES |
| N6-threonylcarbamoyladenosine | t6A | A | YES |
| 1,2'-O-dimethyladenosine | m1Am | A | YES |
| 1-methyladenosine | m1A | A | YES |
| 2'-O-methyladenosine | Am | A | YES |
| 2'-O-ribosyladenosine (phosphate) | Ar(p) | A | YES |
| 2-methyladenosine | m2A | A | YES |
| 2-methylthio-N6 isopentenyladenosine | ms2i6A | A | YES |
| 2-methylthio-N6-hydroxynorvalyl carbamoyladenosine | ms2hn6A | A | YES |
| 2'-O-methyladenosine | m6A | A | YES |
| 2'-O-ribosyladenosine (phosphate) | Ar(p) | A | YES |
| isopentenyladenosine | Iga | A | YES |
| N6-(cis-hydroxyisopentenyl)adenosine | io6A | A | YES |
| N6,2'-O-dimethyladenosine | m6Am | A | YES |
| $N^6$,2'-O-dimethyladenosine | $m^6Am$ | A | YES |
| N6,N6,2'-O-trimethyladenosine | m62Am | A | YES |
| N6,N6-dimethyladenosine | m62A | A | YES |
| N6-acetyladenosine | ac6A | A | YES |
| N6-hydroxynorvalylcarbamoyladenosine | hn6A | A | YES |
| N6-methyl-N6-threonylcarbamoyladenosine | m6t6A | A | YES |
| 2-methyladenosine | $m^2A$ | A | YES |
| 2-methylthio-$N^6$-isopentenyladenosine | $ms^2i^6A$ | A | YES |
| 7-deaza-adenosine | — | A | NO |
| N1-methyl-adenosine | — | A | NO |
| N6,N6 (dimethyl)adenine | — | A | NO |
| N6-cis-hydroxy-isopentenyl-adenosine | — | A | NO |
| α-thio-adenosine | — | A | NO |
| 2 (amino)adenine | — | A | NO |
| 2 (aminopropyl)adenine | — | A | NO |
| 2 (methylthio) N6 (isopentenyl)adenine | — | A | NO |
| 2-(alkyl)adenine | — | A | NO |
| 2-(aminoalkyl)adenine | — | A | NO |
| 2-(aminopropyl)adenine | — | A | NO |
| 2-(halo)adenine | — | A | NO |
| 2-(halo)adenine | — | A | NO |
| 2-(propyl)adenine | — | A | NO |
| 2'-Amino-2'-deoxy-ATP | — | A | NO |
| 2'-Azido-2'-deoxy-ATP | — | A | NO |

TABLE 5-continued

Modifications

| Name | Symbol | Base | Naturally Occurring |
|---|---|---|---|
| 2'-Deoxy-2'-a-aminoadenosine TP | — | A | NO |
| 2'-Deoxy-2'-a-azidoadenosine TP | — | A | NO |
| 6 (alkyl)adenine | — | A | NO |
| 6 (methyl)adenine | — | A | NO |
| 6-(alkyl)adenine | — | A | NO |
| 6-(methyl)adenine | — | A | NO |
| 7 (deaza)adenine | — | A | NO |
| 8 (alkenyl)adenine | — | A | NO |
| 8 (alkynyl)adenine | — | A | NO |
| 8 (amino)adenine | — | A | NO |
| 8 (thioalkyl)adenine | — | A | NO |
| 8-(alkenyl)adenine | — | A | NO |
| 8-(alkyl)adenine | — | A | NO |
| 8-(alkynyl)adenine | — | A | NO |
| 8-(amino)adenine | — | A | NO |
| 8-(halo)adenine | — | A | NO |
| 8-(hydroxyl)adenine | — | A | NO |
| 8-(thioalkyl)adenine | — | A | NO |
| 8-(thiol)adenine | — | A | NO |
| 8-azido-adenosine | — | A | NO |
| aza adenine | — | A | NO |
| deaza adenine | — | A | NO |
| N6 (methyl)adenine | — | A | NO |
| N6-(isopentyl)adenine | — | A | NO |
| 7-deaza-8-aza-adenosine | — | A | NO |
| 7-methyladenine | — | A | NO |
| 1-Deazaadenosine TP | — | A | NO |
| 2'Fluoro-N6-Bz-deoxyadenosine TP | — | A | NO |
| 2'-OMe-2-Amino-ATP | — | A | NO |
| 2'O-methyl-N6-Bz-deoxyadenosine TP | — | A | NO |
| 2'-a-Ethynyladenosine TP | — | A | NO |
| 2-aminoadenine | — | A | NO |
| 2-Aminoadenosine TP | — | A | NO |
| 2-Amino-ATP | — | A | NO |
| 2'-a-Trifluoromethyladenosine TP | — | A | NO |
| 2-Azidoadenosine TP | — | A | NO |
| 2'-b-Ethynyladenosine TP | — | A | NO |
| 2-Bromoadenosine TP | — | A | NO |
| 2'-b-Trifluoromethyladenosine TP | — | A | NO |
| 2-Chloroadenosine TP | — | A | NO |
| 2'-Deoxy-2',2'-difluoroadenosine TP | — | A | NO |
| 2'-Deoxy-2'-a-mercaptoadenosine TP | — | A | NO |
| 2'-Deoxy-2'-a-thiomethoxyadenosine TP | — | A | NO |
| 2'-Deoxy-2'-b-aminoadenosine TP | — | A | NO |
| 2'-Deoxy-2'-b-azidoadenosine TP | — | A | NO |
| 2'-Deoxy-2'-b-bromoadenosine TP | — | A | NO |
| 2'-Deoxy-2'-b-chloroadenosine TP | — | A | NO |
| 2'-Deoxy-2'-b-fluoroadenosine TP | — | A | NO |
| 2'-Deoxy-2'-b-iodoadenosine TP | — | A | NO |
| 2'-Deoxy-2'-b-mercaptoadenosine TP | — | A | NO |
| 2'-Deoxy-2'-b-thiomethoxyadenosine TP | — | A | NO |
| 2-Fluoroadenosine TP | — | A | NO |
| 2-Iodoadenosine TP | — | A | NO |
| 2-Mercaptoadenosine TP | — | A | NO |
| 2-methoxy-adenine | — | A | NO |
| 2-methylthio-adenine | — | A | NO |
| 2-Trifluoromethyladenosine TP | — | A | NO |
| 3-Deaza-3-bromoadenosine TP | — | A | NO |
| 3-Deaza-3-chloroadenosine TP | — | A | NO |
| 3-Deaza-3-fluoroadenosine TP | — | A | NO |
| 3-Deaza-3-iodoadenosine TP | — | A | NO |
| 3-Deazaadenosine TP | — | A | NO |
| 4'-Azidoadenosine TP | — | A | NO |
| 4'-Carbocyclic adenosine TP | — | A | NO |
| 4'-Ethynyladenosine TP | — | A | NO |
| 5'-Homo-adenosine TP | — | A | NO |
| 8-Aza-ATP | — | A | NO |
| 8-bromo-adenosine TP | — | A | NO |
| 8-Trifluoromethyladenosine TP | — | A | NO |
| 9-Deazaadenosine TP | — | A | NO |
| 2-aminopurine | — | A/G | NO |
| 7-deaza-2,6-diaminopurine | — | A/G | NO |
| 7-deaza-8-aza-2,6-diaminopurine | — | A/G | NO |
| 7-deaza-8-aza-2-aminopurine | — | A/G | NO |
| 2,6-diaminopurine | — | A/G | NO |

TABLE 5-continued

Modifications

| Name | Symbol | Base | Naturally Occurring |
|---|---|---|---|
| 7-deaza-8-aza-adenine, 7-deaza-2-aminopurine | — | A/G | NO |
| 2-thiocytidine | s2C | C | YES |
| 3-methylcytidine | m3C | C | YES |
| 5-formylcytidine | f5C | C | YES |
| 5-hydroxymethylcytidine | hm5C | C | YES |
| 5-methylcytidine | m5C | C | YES |
| N4-acetylcytidine | ac4C | C | YES |
| 2'-O-methylcytidine | Cm | C | YES |
| 2'-O-methylcytidine | Cm | C | YES |
| 5,2'-O-dimethylcytidine | m5 Cm | C | YES |
| 5-formyl-2'-O-methylcytidine | f5Cm | C | YES |
| lysidine | k2C | C | YES |
| N4,2'-O-dimethylcytidine | m4Cm | C | YES |
| N4-acetyl-2'-O-methylcytidine | ac4Cm | C | YES |
| N4-methylcytidine | m4C | C | YES |
| N4,N4-Dimethyl-2'-OMe-Cytidine TP | — | C | YES |
| 4-methylcytidine | — | C | NO |
| 5-aza-cytidine | — | C | NO |
| Pseudo-iso-cytidine | — | C | NO |
| pyrrolo-cytidine | — | C | NO |
| α-thio-cytidine | — | C | NO |
| 2-(thio)cytosine | — | C | NO |
| 2'-Amino-2'-deoxy-CTP | — | C | NO |
| 2'-Azido-2'-deoxy-CTP | — | C | NO |
| 2'-Deoxy-2'-a-aminocytidine TP | — | C | NO |
| 2'-Deoxy-2'-a-azidocytidine TP | — | C | NO |
| 3 (deaza) 5 (aza)cytosine | — | C | NO |
| 3 (methyl)cytosine | — | C | NO |
| 3-(alkyl)cytosine | — | C | NO |
| 3-(deaza) 5 (aza)cytosine | — | C | NO |
| 3-(methyl)cytidine | — | C | NO |
| 4,2'-O-dimethylcytidine | — | C | NO |
| 5 (halo)cytosine | — | C | NO |
| 5 (methyl)cytosine | — | C | NO |
| 5 (propynyl)cytosine | — | C | NO |
| 5 (trifluoromethyl)cytosine | — | C | NO |
| 5-(alkyl)cytosine | — | C | NO |
| 5-(alkynyl)cytosine | — | C | NO |
| 5-(halo)cytosine | — | C | NO |
| 5-(propynyl)cytosine | — | C | NO |
| 5-(trifluoromethyl)cytosine | — | C | NO |
| 5-bromo-cytidine | — | C | NO |
| 5-iodo-cytidine | — | C | NO |
| 5-propynyl cytosine | — | C | NO |
| 6-(azo)cytosine | — | C | NO |
| 6-aza-cytidine | — | C | NO |
| aza cytosine | — | C | NO |
| deaza cytosine | — | C | NO |
| N4 (acetyl)cytosine | — | C | NO |
| 1-methyl-1-deaza-pseudoisocytidine | — | C | NO |
| 1-methyl-pseudoisocytidine | — | C | NO |
| 2-methoxy-5-methyl-cytidine | — | C | NO |
| 2-methoxy-cytidine | — | C | NO |
| 2-thio-5-methyl-cytidine | — | C | NO |
| 4-methoxy-1-methyl-pseudoisocytidine | — | C | NO |
| 4-methoxy-pseudoisocytidine | — | C | NO |
| 4-thio-1-methyl-1-deaza-pseudoisocytidine | — | C | NO |
| 4-thio-1-methyl-pseudoisocytidine | — | C | NO |
| 4-thio-pseudoisocytidine | — | C | NO |
| 5-aza-zebularine | — | C | NO |
| 5-methyl-zebularine | — | C | NO |
| pyrrolo-pseudoisocytidine | — | C | NO |
| zebularine | — | C | NO |
| (E)-5-(2-Bromo-vinyl)cytidine TP | — | C | NO |
| 2,2'-anhydro-cytidine TP hydrochloride | — | C | NO |
| 2'Fluor-N4-Bz-cytidine TP | — | C | NO |
| 2'Fluoro-N4-Acetyl-cytidine TP | — | C | NO |
| 2'-O-Methyl-N4-Acetyl-cytidine TP | — | C | NO |
| 2'O-methyl-N4-Bz-cytidine TP | — | C | NO |
| 2'-a-Ethynylcytidine TP | — | C | NO |
| 2'-a-Trifluoromethylcytidine TP | — | C | NO |
| 2'-b-Ethynylcytidine TP | — | C | NO |
| 2'-b-Trifluoromethylcytidine TP | — | C | NO |
| 2'-Deoxy-2',2'-difluorocytidine TP | — | C | NO |
| 2'-Deoxy-2'-a-mercaptocytidine TP | — | C | NO |

TABLE 5-continued

Modifications

| Name | Symbol | Base | Naturally Occurring |
|---|---|---|---|
| 2'-Deoxy-2'-a-thiomethoxycytidine TP | — | C | NO |
| 2'-Deoxy-2'-b-aminocytidine TP | — | C | NO |
| 2'-Deoxy-2'-b-azidocytidine TP | — | C | NO |
| 2'-Deoxy-2'-b-bromocytidine TP | — | C | NO |
| 2'-Deoxy-2'-b-chlorocytidine TP | — | C | NO |
| 2'-Deoxy-2'-b-fluorocytidine TP | — | C | NO |
| 2'-Deoxy-2'-b-iodocytidine TP | — | C | NO |
| 2'-Deoxy-2'-b-mercaptocytidine TP | — | C | NO |
| 2'-Deoxy-2'-b-thiomethoxycytidine TP | — | C | NO |
| 2'-O-Methyl-5-(1-propynyl)cytidine TP | — | C | NO |
| 3'-Ethynylcytidine TP | — | C | NO |
| 4'-Azidocytidine TP | — | C | NO |
| 4'-Carbocyclic cytidine TP | — | C | NO |
| 4'-Ethynylcytidine TP | — | C | NO |
| 5-(1-Propynyl)ara-cytidine TP | — | C | NO |
| 5-(2-Chloro-phenyl)-2-thiocytidine TP | — | C | NO |
| 5-(4-Amino-phenyl)-2-thiocytidine TP | — | C | NO |
| 5-Aminoallyl-CTP | — | C | NO |
| 5-Cyanocytidine TP | — | C | NO |
| 5-Ethynylara-cytidine TP | — | C | NO |
| 5-Ethynylcytidine TP | — | C | NO |
| 5'-Homo-cytidine TP | — | C | NO |
| 5-Methoxycytidine TP | — | C | NO |
| 5-Trifluoromethyl-Cytidine TP | — | C | NO |
| N4-Amino-cytidine TP | — | C | NO |
| N4-Benzoyl-cytidine TP | — | C | NO |
| pseudoisocytidine | — | C | NO |
| 7-methylguanosine | m7G | G | YES |
| N2,2'-O-dimethylguanosine | m2Gm | G | YES |
| N2-methylguanosine | m2G | G | YES |
| wyosine | imG | G | YES |
| 1,2'-O-dimethylguanosine | m1Gm | G | YES |
| 1-methylguanosine | m1G | G | YES |
| 2'-O-methylguanosine | Gm | G | YES |
| 2'-O-ribosylguanosine (phosphate) | Gr(p) | G | YES |
| 2'-O-methylguanosine | Gm | G | YES |
| 2'-O-ribosylguanosine (phosphate) | Gr(p) | G | YES |
| 7-aminomethyl-7-deazaguanosine | preQ1 | G | YES |
| 7-cyano-7-deazaguanosine | preQ0 | G | YES |
| archaeosine | G+ | G | YES |
| methylwyosine | mimG | G | YES |
| N2,7-dimethylguanosine | m2,7G | G | YES |
| N2,N2,2'-O-trimethylguanosine | m22Gm | G | YES |
| N2,N2,7-trimethylguanosine | m2,2,7G | G | YES |
| N2,N2-dimethylguanosine | m22G | G | YES |
| $N^2$,7,2'-O-trimethylguanosine | $m^{2,7}Gm$ | G | YES |
| 6-thio-guanosine | — | G | NO |
| 7-deaza-guanosine | — | G | NO |
| 8-oxo-guanosine | — | G | NO |
| N1-methyl-guanosine | — | G | NO |
| α-thio-guanosine | — | G | NO |
| 2 (propyl)guanine | — | G | NO |
| 2-(alkyl)guanine | — | G | NO |
| 2'-Amino-2'-deoxy-GTP | — | G | NO |
| 2'-Azido-2'-deoxy-GTP | — | G | NO |
| 2'-Deoxy-2'-a-aminoguanosine TP | — | G | NO |
| 2'-Deoxy-2'-a-azidoguanosine TP | — | G | NO |
| 6 (methyl)guanine | — | G | NO |
| 6-(alkyl)guanine | — | G | NO |
| 6-(methyl)guanine | — | G | NO |
| 6-methyl-guanosine | — | G | NO |
| 7 (alkyl)guanine | — | G | NO |
| 7 (deaza)guanine | — | G | NO |
| 7 (methyl)guanine | — | G | NO |
| 7-(alkyl)guanine | — | G | NO |
| 7-(deaza)guanine | — | G | NO |
| 7-(methyl)guanine | — | G | NO |
| 8 (alkyl)guanine | — | G | NO |
| 8 (alkynyl)guanine | — | G | NO |
| 8 (halo)guanine | — | G | NO |
| 8 (thioalkyl)guanine | — | G | NO |
| 8-(alkenyl)guanine | — | G | NO |
| 8-(alkyl)guanine | — | G | NO |
| 8-(alkynyl)guanine | — | G | NO |
| 8-(amino)guanine | — | G | NO |

TABLE 5-continued

Modifications

| Name | Symbol | Base | Naturally Occurring |
|---|---|---|---|
| 8-(halo)guanine | — | G | NO |
| 8-(hydroxyl)guanine | — | G | NO |
| 8-(thioalkyl)guanine | — | G | NO |
| 8-(thiol)guanine | — | G | NO |
| aza guanine | — | G | NO |
| deaza guanine | — | G | NO |
| N (methyl)guanine | — | G | NO |
| N-(methyl)guanine | — | G | NO |
| 1-methyl-6-thio-guanosine | — | G | NO |
| 6-methoxy-guanosine | — | G | NO |
| 6-thio-7-deaza-8-aza-guanosine | — | G | NO |
| 6-thio-7-deaza-guanosine | — | G | NO |
| 6-thio-7-methyl-guanosine | — | G | NO |
| 7-deaza-8-aza-guanosine | — | G | NO |
| 7-methyl-8-oxo-guanosine | — | G | NO |
| N2,N2-dimethyl-6-thio-guanosine | — | G | NO |
| N2-methyl-6-thio-guanosine | — | G | NO |
| 1-Me-GTP | — | G | NO |
| 2'Fluoro-N2-isobutyl-guanosine TP | — | G | NO |
| 2'O-methyl-N2-isobutyl-guanosine TP | — | G | NO |
| 2'-a-Ethynylguanosine TP | — | G | NO |
| 2'-a-Trifluoromethylguanosine TP | — | G | NO |
| 2'-b-Ethynylguanosine TP | — | G | NO |
| 2'-b-Trifluoromethylguanosine TP | — | G | NO |
| 2'-Deoxy-2',2'-difluoroguanosine TP | — | G | NO |
| 2'-Deoxy-2'-a-mercaptoguanosine TP | — | G | NO |
| 2'-Deoxy-2'-a-thiomethoxyguanosine TP | — | G | NO |
| 2'-Deoxy-2'-b-aminoguanosine TP | — | G | NO |
| 2'-Deoxy-2'-b-azidoguanosine TP | — | G | NO |
| 2'-Deoxy-2'-b-bromoguanosine TP | — | G | NO |
| 2'-Deoxy-2'-b-chloroguanosine TP | — | G | NO |
| 2'-Deoxy-2'-b-fluoroguanosine TP | — | G | NO |
| 2'-Deoxy-2'-b-iodoguanosine TP | — | G | NO |
| 2'-Deoxy-2'-b-mercaptoguanosine TP | — | G | NO |
| 2'-Deoxy-2'-b-thiomethoxyguanosine TP | — | G | NO |
| 4'-Azidoguanosine TP | — | G | NO |
| 4'-Carbocyclic guanosine TP | — | G | NO |
| 4'-Ethynylguanosine TP | — | G | NO |
| 5'-Homo-guanosine TP | — | G | NO |
| 8-bromo-guanosine TP | — | G | NO |
| 9-Deazaguanosine TP | — | G | NO |
| N2-isobutyl-guanosine TP | — | G | NO |
| 1-methylinosine | m1I | I | YES |
| inosine | I | I | YES |
| 1,2'-O-dimethylinosine | m1Im | I | YES |
| 2'-O-methylinosine | Im | I | YES |
| 7-methylinosine | | I | NO |
| 2'-O-methylinosine | Im | I | YES |
| epoxyqueuosine | oQ | Q | YES |
| galactosyl-queuosine | galQ | Q | YES |
| mannosylqueuosine | manQ | Q | YES |
| queuosine | Q | Q | YES |
| allyamino-thymidine | — | T | NO |
| aza thymidine | — | T | NO |
| deaza thymidine | — | T | NO |
| deoxy-thymidine | — | T | NO |
| 2'-O-methyluridine | — | U | YES |
| 2-thiouridine | s2U | U | YES |
| 3-methyluridine | m3U | U | YES |
| 5-carboxymethyluridine | cm5U | U | YES |
| 5-hydroxyuridine | ho5U | U | YES |
| 5-methyluridine | m5U | U | YES |
| 5-taurinomethyl-2-thiouridine | τm5s2U | U | YES |
| 5-taurinomethyluridine | τm5U | U | YES |
| dihydrouridine | D | U | YES |
| pseudouridine | Ψ | U | YES |
| (3-(3-amino-3-carboxypropyl)uridine | acp3U | U | YES |
| 1-methyl-3-(3-amino-5-carboxypropyl)pseudouridine | m1acp3Ψ | U | YES |
| 1-methylpseduouridine | m1Ψ | U | YES |
| 1-methyl-pseudouridine | — | U | YES |
| 2'-O-methyluridine | Um | U | YES |
| 2'-O-methylpseudouridine | Ψm | U | YES |
| 2'-O-methyluridine | Um | U | YES |
| 2-thio-2'-O-methyluridine | s2Um | U | YES |
| 3-(3-amino-3-carboxypropyl)uridine | acp3U | U | YES |

TABLE 5-continued

Modifications

| Name | Symbol | Base | Naturally Occurring |
|---|---|---|---|
| 3,2'-O-dimethyluridine | m3Um | U | YES |
| 3-Methyl-pseudo-Uridine TP | — | U | YES |
| 4-thiouridine | s4U | U | YES |
| 5-(carboxyhydroxymethyl)uridine | chm5U | U | YES |
| 5-(carboxyhydroxymethyl)uridine methyl ester | mchm5U | U | YES |
| 5,2'-O-dimethyluridine | m5Um | U | YES |
| 5,6-dihydro-uridine | — | U | YES |
| 5-aminomethyl-2-thiouridine | nm5s2U | U | YES |
| 5-carbamoylmethyl-2'-O-methyluridine | ncm5Um | U | YES |
| 5-carbamoylmethyluridine | ncm5U | U | YES |
| 5-carboxyhydroxymethyluridine | — | U | YES |
| 5-carboxyhydroxymethyluridine methyl ester | — | U | YES |
| 5-carboxymethylaminomethyl-2'-O-methyluridine | cmnm5Um | U | YES |
| 5-carboxymethylaminomethyl-2-thiouridine | cmnm5s2U | U | YES |
| 5-carboxymethylaminomethyl-2-thiouridine | — | U | YES |
| 5-carboxymethylaminomethyluridine | cmnm5U | U | YES |
| 5-carboxymethylaminomethyluridine | — | U | YES |
| 5-Carbamoylmethyluridine TP | — | U | YES |
| 5-methoxycarbonylmethyl-2'-O-methyluridine | mcm5Um | U | YES |
| 5-methoxycarbonylmethyl-2-thiouridine | mcm5s2U | U | YES |
| 5-methoxycarbonylmethyluridine | mcm5U | U | YES |
| 5-methoxyuridine | mo5U | U | YES |
| 5-methyl-2-thiouridine | m5s2U | U | YES |
| 5-methylaminomethyl-2-selenouridine | mnm5se2U | U | YES |
| 5-methylaminomethyl-2-thiouridine | mnm5s2U | U | YES |
| 5-methylaminomethyluridine | mnm5U | U | YES |
| 5-Methyldihydrouridine | — | U | YES |
| 5-Oxyacetic acid-Uridine TP | — | U | YES |
| 5-Oxyacetic acid-methyl ester-Uridine TP | — | U | YES |
| N1-methyl-pseudo-uridine | — | U | YES |
| uridine 5-oxyacetic acid | cmo5U | U | YES |
| uridine 5-oxyacetic acid methyl ester | mcmo5U | U | YES |
| 3-(3-Amino-3-carboxypropyl)-Uridine TP | — | U | YES |
| 5-(iso-Pentenylaminomethyl)-2-thiouridine TP | — | U | YES |
| 5-(iso-Pentenylaminomethyl)-2'-O-methyluridine TP | — | U | YES |
| 5-(iso-Pentenylaminomethyl)uridine TP | — | U | YES |
| 5-propynyl uracil | — | U | NO |
| α-thio-uridine | — | U | NO |
| 1 (aminoalkylamino-carbonylethylenyl)-2(thio)-pseudouracil | — | U | NO |
| 1 (aminoalkylaminocarbonylethylenyl)-2,4-(dithio)pseudouracil | — | U | NO |
| 1 (aminoalkylaminocarbonylethylenyl)-4 (thio)pseudouracil | — | U | NO |
| 1 (aminoalkylaminocarbonylethylenyl)-pseudouracil | — | U | NO |
| 1 (aminocarbonylethylenyl)-2(thio)-pseudouracil | — | U | NO |
| 1 (aminocarbonylethylenyl)-2,4-(dithio)pseudouracil | — | U | NO |
| 1 (aminocarbonylethylenyl)-4 (thio)pseudouracil | — | U | NO |
| 1 (aminocarbonylethylenyl)-pseudouracil | — | U | NO |
| 1 substituted 2(thio)-pseudouracil | — | U | NO |
| 1 substituted 2,4-(dithio)pseudouracil | — | U | NO |
| 1 substituted 4 (thio)pseudouracil | — | U | NO |
| 1 substituted pseudouracil | — | U | NO |
| 1-(aminoalkylamino-carbonylethylenyl)-2-(thio)-pseudouracil | — | U | NO |
| 1-Methyl-3-(3-amino-3-carboxypropyl) pseudouridine TP | — | U | NO |
| 1-Methyl-3-(3-amino-3-carboxypropyl)pseudo-UTP | — | U | NO |
| 1-Methyl-pseudo-UTP | — | U | NO |
| 2 (thio)pseudouracil | — | U | NO |
| 2' deoxy uridine | — | U | NO |
| 2' fluorouridine | — | U | NO |
| 2-(thio)uracil | — | U | NO |
| 2,4-(dithio)psuedouracil | — | U | NO |
| 2' methyl, 2'amino, 2'azido, 2'fluro-guanosine | — | U | NO |
| 2'-Amino-2'-deoxy-UTP | — | U | NO |
| 2'-Azido-2'-deoxy-UTP | — | U | NO |
| 2'-Azido-deoxyuridine TP | — | U | NO |
| 2'-O-methylpseudouridine | — | U | NO |
| 2' deoxy uridine | 2' dU | U | NO |
| 2' fluorouridine | — | U | NO |
| 2'-Deoxy-2'-a-aminouridine TP | — | U | NO |
| 2'-Deoxy-2'-a-azidouridine TP | — | U | NO |
| 2-methylpseudouridine | m3Ψ | U | NO |
| 3 (3 amino-3 carboxypropyl)uracil | — | U | NO |
| 4 (thio)pseudouracil | — | U | NO |
| 4-(thio)pseudouracil | — | U | NO |

TABLE 5-continued

Modifications

| Name | Symbol | Base | Naturally Occurring |
|---|---|---|---|
| 4-(thio)uracil | — | U | NO |
| 4-thiouracil | — | U | NO |
| 5 (1,3-diazole-1-alkyl)uracil | — | U | NO |
| 5 (2-aminopropyl)uracil | — | U | NO |
| 5 (aminoalkyl)uracil | — | U | NO |
| 5 (dimethylaminoalkyl)uracil | — | U | NO |
| 5 (guanidiniumalkyl)uracil | — | U | NO |
| 5 (methoxycarbonylmethyl)-2-(thio)uracil | — | U | NO |
| 5 (methoxycarbonyl-methyl)uracil | — | U | NO |
| 5 (methyl) 2 (thio)uracil | — | U | NO |
| 5 (methyl) 2,4 (dithio)uracil | — | U | NO |
| 5 (methyl) 4 (thio)uracil | — | U | NO |
| 5 (methylaminomethyl)-2 (thio)uracil | — | U | NO |
| 5 (methylaminomethyl)-2,4 (dithio)uracil | — | U | NO |
| 5 (methylaminomethyl)-4 (thio)uracil | — | U | NO |
| 5 (propynyl)uracil | — | U | NO |
| 5 (trifluoromethyl)uracil | — | U | NO |
| 5-(2-aminopropyl)uracil | — | U | NO |
| 5-(alkyl)-2-(thio)pseudouracil | — | U | NO |
| 5-(alkyl)-2,4 (dithio)pseudouracil | — | U | NO |
| 5-(alkyl)-4 (thio)pseudouracil | — | U | NO |
| 5-(alkyl)pseudouracil | — | U | NO |
| 5-(alkyl)uracil | — | U | NO |
| 5-(alkynyl)uracil | — | U | NO |
| 5-(allylamino)uracil | — | U | NO |
| 5-(cyanoalkyl)uracil | — | U | NO |
| 5-(dialkylaminoalkyl)uracil | — | U | NO |
| 5-(dimethylaminoalkyl)uracil | — | U | NO |
| 5-(guanidiniumalkyl)uracil | — | U | NO |
| 5-(halo)uracil | — | U | NO |
| 5-(1,3-diazole-1-alkyl)uracil | — | U | NO |
| 5-(methoxy)uracil | — | U | NO |
| 5-(methoxycarbonylmethyl)-2-(thio)uracil | — | U | NO |
| 5-(methoxycarbonyl-methyl)uracil | — | U | NO |
| 5-(methyl) 2(thio)uracil | — | U | NO |
| 5-(methyl) 2,4 (dithio)uracil | — | U | NO |
| 5-(methyl) 4 (thio)uracil | — | U | NO |
| 5-(methyl)-2-(thio)pseudouracil | — | U | NO |
| 5-(methyl)-2,4 (dithio)pseudouracil | — | U | NO |
| 5-(methyl)-4 (thio)pseudouracil | — | U | NO |
| 5-(methyl)pseudouracil | — | U | NO |
| 5-(methylaminomethyl)-2 (thio)uracil | — | U | NO |
| 5-(methylaminomethyl)-2,4(dithio)uracil | — | U | NO |
| 5-(methylaminomethyl)-4-(thio)uracil | — | U | NO |
| 5-(propynyl)uracil | — | U | NO |
| 5-(trifluoromethyl)uracil | — | U | NO |
| 5-aminoallyl-uridine | — | U | NO |
| 5-bromo-uridine | — | U | NO |
| 5-iodo-uridine | — | U | NO |
| 5-uracil | — | U | NO |
| 6 (azo)uracil | — | U | NO |
| 6-(azo)uracil | — | U | NO |
| 6-aza-uridine | — | U | NO |
| allyamino-uracil | — | U | NO |
| aza uracil | — | U | NO |
| deaza uracil | — | U | NO |
| N3 (methyl)uracil | — | U | NO |
| Pseudo-UTP-1-2-ethanoic acid | — | U | NO |
| pseudouracil | — | U | NO |
| 4-Thio-pseudo-UTP | — | U | NO |
| 1-carboxymethyl-pseudouridine | — | U | NO |
| 1-methyl-1-deaza-pseudouridine | — | U | NO |
| 1-propynyl-uridine | — | U | NO |
| 1-taurinomethyl-1-methyl-uridine | — | U | NO |
| 1-taurinomethyl-4-thio-uridine | — | U | NO |
| 1-taurinomethyl-pseudouridine | — | U | NO |
| 2-methoxy-4-thio-pseudouridine | — | U | NO |
| 2-thio-1-methyl-1-deaza-pseudouridine | — | U | NO |
| 2-thio-1-methyl-pseudouridine | — | U | NO |
| 2-thio-5-aza-uridine | — | U | NO |
| 2-thio-dihydropseudouridine | — | U | NO |
| 2-thio-dihydrouridine | — | U | NO |
| 2-thio-pseudouridine | — | U | NO |
| 4-methoxy-2-thio-pseudouridine | — | U | NO |
| 4-methoxy-pseudouridine | — | U | NO |

TABLE 5-continued

Modifications

| Name | Symbol | Base | Naturally Occurring |
|---|---|---|---|
| 4-thio-1-methyl-pseudouridine | — | U | NO |
| 4-thio-pseudouridine | — | U | NO |
| 5-aza-uridine | — | U | NO |
| dihydropseudouridine | — | U | NO |
| (±)1-(2-Hydroxypropyl)pseudouridine TP | — | U | NO |
| (2R)-1-(2-Hydroxypropyl)pseudouridine TP | — | U | NO |
| (2S)-1-(2-Hydroxypropyl)pseudouridine TP | — | U | NO |
| (E)-5-(2-Bromo-vinyl)ara-uridine TP | — | U | NO |
| (E)-5-(2-Bromo-vinyl)uridine TP | — | U | NO |
| (Z)-5-(2-Bromo-vinyl)ara-uridine TP | — | U | NO |
| (Z)-5-(2-Bromo-vinyl)uridine TP | — | U | NO |
| 1-(2,2,2-Trifluoroethyl)-pseudo-UTP | — | U | NO |
| 1-(2,2,3,3,3-Pentafluoropropyl)pseudouridine TP | — | U | NO |
| 1-(2,2-Diethoxyethyl)pseudouridine TP | — | U | NO |
| 1-(2,4,6-Trimethylbenzyl)pseudouridine TP | — | U | NO |
| 1-(2,4,6-Trimethyl-benzyl)pseudo-UTP | — | U | NO |
| 1-(2,4,6-Trimethyl-phenyl)pseudo-UTP | — | U | NO |
| 1-(2-Amino-2-carboxyethyl)pseudo-UTP | — | U | NO |
| 1-(2-Amino-ethyl)pseudo-UTP | — | U | NO |
| 1-(2-Hydroxyethyl)pseudouridine TP | — | U | NO |
| 1-(2-Methoxyethyl)pseudouridine TP | — | U | NO |
| 1-(3,4-Bis-trifluoromethoxybenzyl)pseudouridine TP | — | U | NO |
| 1-(3,4-Dimethoxybenzyl)pseudouridine TP | — | U | NO |
| 1-(3-Amino-3-carboxypropyl)pseudo-UTP | — | U | NO |
| 1-(3-Amino-propyl)pseudo-UTP | — | U | NO |
| 1-(3-Cyclopropyl-prop-2-ynyl)pseudouridine TP | — | U | NO |
| 1-(4-Amino-4-carboxybutyl)pseudo-UTP | — | U | NO |
| 1-(4-Amino-benzyl)pseudo-UTP | — | U | NO |
| 1-(4-Amino-butyl)pseudo-UTP | — | U | NO |
| 1-(4-Amino-phenyl)pseudo-UTP | — | U | NO |
| 1-(4-Azidobenzyl)pseudouridine TP | — | U | NO |
| 1-(4-Bromobenzyl)pseudouridine TP | — | U | NO |
| 1-(4-Chlorobenzyl)pseudouridine TP | — | U | NO |
| 1-(4-Fluorobenzyl)pseudouridine TP | — | U | NO |
| 1-(4-Iodobenzyl)pseudouridine TP | — | U | NO |
| 1-(4-Methanesulfonylbenzyl)pseudouridine TP | — | U | NO |
| 1-(4-Methoxybenzyl)pseudouridine TP | — | U | NO |
| 1-(4-Methoxy-benzyl)pseudo-UTP | — | U | NO |
| 1-(4-Methoxy-phenyl)pseudo-UTP | — | U | NO |
| 1-(4-Methylbenzyl)pseudouridine TP | — | U | NO |
| 1-(4-Methyl-benzyl)pseudo-UTP | — | U | NO |
| 1-(4-Nitrobenzyl)pseudouridine TP | — | U | NO |
| 1-(4-Nitro-benzyl)pseudo-UTP | — | U | NO |
| 1(4-Nitro-phenyl)pseudo-UTP | — | U | NO |
| 1-(4-Thiomethoxybenzyl)pseudouridine TP | — | U | NO |
| 1-(4-Trifluoromethoxybenzyl)pseudouridine TP | — | U | NO |
| 1-(4-Trifluoromethylbenzyl)pseudouridine TP | — | U | NO |
| 1-(5-Amino-pentyl)pseudo-UTP | — | U | NO |
| 1-(6-Amino-hexyl)pseudo-UTP | — | U | NO |
| 1,6-Dimethyl-pseudo-UTP | — | U | NO |
| 1-[3-(2-{2-[2-(2-Aminoethoxy)-ethoxy]-ethoxy}-ethoxy)-propionyl]pseudouridine TP | — | U | NO |
| 1-{3-[2-(2-Aminoethoxy)-ethoxy]-propionyl}pseudouridine TP | — | U | NO |
| 1-Acetylpseudouridine TP | — | U | NO |
| 1-Alkyl-6-(1-propynyl)-pseudo-UTP | — | U | NO |
| 1-Alkyl-6-(2-propynyl)-pseudo-UTP | — | U | NO |
| 1-Alkyl-6-allyl-pseudo-UTP | — | U | NO |
| 1-Alkyl-6-ethynyl-pseudo-UTP | — | U | NO |
| 1-Alkyl-6-homoallyl-pseudo-UTP | — | U | NO |
| 1-Alkyl-6-vinyl-pseudo-UTP | — | U | NO |
| 1-Allylpseudouridine TP | — | U | NO |
| 1-Aminomethyl-pseudo-UTP | — | U | NO |
| 1-Benzoylpseudouridine TP | — | U | NO |
| 1-Benzyloxymethylpseudouridine TP | — | U | NO |
| 1-Benzyl-pseudo-UTP | — | U | NO |
| 1-Biotinyl-PEG2-pseudouridine TP | — | U | NO |
| 1-Biotinylpseudouridine TP | — | U | NO |
| 1-Butyl-pseudo-UTP | — | U | NO |
| 1-Cyanomethylpseudouridine TP | — | U | NO |
| 1-Cyclobutylmethyl-pseudo-UTP | — | U | NO |
| 1-Cyclobutyl-pseudo-UTP | — | U | NO |
| 1-Cycloheptylmethyl-pseudo-UTP | — | U | NO |
| 1-Cycloheptyl-pseudo-UTP | — | U | NO |
| 1-Cyclohexylmethyl-pseudo-UTP | — | U | NO |

TABLE 5-continued

Modifications

| Name | Symbol | Base | Naturally Occurring |
|---|---|---|---|
| 1-Cyclohexyl-pseudo-UTP | — | U | NO |
| 1-Cyclooctylmethyl-pseudo-UTP | — | U | NO |
| 1-Cyclooctyl-pseudo-UTP | — | U | NO |
| 1-Cyclopentylmethyl-pseudo-UTP | — | U | NO |
| 1-Cyclopentyl-pseudo-UTP | — | U | NO |
| 1-Cyclopropylmethyl-pseudo-UTP | — | U | NO |
| 1-Cyclopropyl-pseudo-UTP | — | U | NO |
| 1-Ethyl-pseudo-UTP | — | U | NO |
| 1-Hexyl-pseudo-UTP | — | U | NO |
| 1-Homoallylpseudouridine TP | — | U | NO |
| 1-Hydroxymethylpseudouridine TP | — | U | NO |
| 1-iso-propyl-pseudo-UTP | — | U | NO |
| 1-Me-2-thio-pseudo-UTP | — | U | NO |
| 1-Me-4-thio-pseudo-UTP | — | U | NO |
| 1-Me-alpha-thio-pseudo-UTP | — | U | NO |
| 1-Methanesulfonylmethylpseudouridine TP | — | U | NO |
| 1-Methoxymethylpseudouridine TP | — | U | NO |
| 1-Methyl-6-(2,2,2-Trifluoroethyl)pseudo-UTP | — | U | NO |
| 1-Methyl-6-(4-morpholino)-pseudo-UTP | — | U | NO |
| 1-Methyl-6-(4-thiomorpholino)-pseudo-UTP | — | U | NO |
| 1-Methyl-6-(substituted phenyl)pseudo-UTP | — | U | NO |
| 1-Methyl-6-amino-pseudo-UTP | — | U | NO |
| 1-Methyl-6-azido-pseudo-UTP | — | U | NO |
| 1-Methyl-6-bromo-pseudo-UTP | — | U | NO |
| 1-Methyl-6-butyl-pseudo-UTP | — | U | NO |
| 1-Methyl-6-chloro-pseudo-UTP | — | U | NO |
| 1-Methyl-6-cyano-pseudo-UTP | — | U | NO |
| 1-Methyl-6-dimethylamino-pseudo-UTP | — | U | NO |
| 1-Methyl-6-ethoxy-pseudo-UTP | — | U | NO |
| 1-Methyl-6-ethylcarboxylate-pseudo-UTP | — | U | NO |
| 1-Methyl-6-ethyl-pseudo-UTP | — | U | NO |
| 1-Methyl-6-fluoro-pseudo-UTP | — | U | NO |
| 1-Methyl-6-formyl-pseudo-UTP | — | U | NO |
| 1-Methyl-6-hydroxyamino-pseudo-UTP | — | U | NO |
| 1-Methyl-6-hydroxy-pseudo-UTP | — | U | NO |
| 1-Methyl-6-iodo-pseudo-UTP | — | U | NO |
| 1-Methyl-6-iso-propyl-pseudo-UTP | — | U | NO |
| 1-Methyl-6-methoxy-pseudo-UTP | — | U | NO |
| 1-Methyl-6-methylamino-pseudo-UTP | — | U | NO |
| 1-Methyl-6-phenyl-pseudo-UTP | — | U | NO |
| 1-Methyl-6-propyl-pseudo-UTP | — | U | NO |
| 1-Methyl-6-tert-butyl-pseudo-UTP | — | U | NO |
| 1-Methyl-6-trifluoromethoxy-pseudo-UTP | — | U | NO |
| 1-Methyl-6-trifluoromethyl-pseudo-UTP | — | U | NO |
| 1-Morpholinomethylpseudouridine TP | — | U | NO |
| 1-Pentyl-pseudo-UTP | — | U | NO |
| 1-Phenyl-pseudo-UTP | — | U | NO |
| 1-Pivaloylpseudouridine TP | — | U | NO |
| 1-Propargylpseudouridine TP | — | U | NO |
| 1-Propyl-pseudo-UTP | — | U | NO |
| 1-propynyl-pseudouridine | — | U | NO |
| 1-p-tolyl-pseudo-UTP | — | U | NO |
| 1-tert-Butyl-pseudo-UTP | — | U | NO |
| 1-Thiomethoxymethylpseudouridine TP | — | U | NO |
| 1-Thiomorpholinomethylpseudouridine TP | — | U | NO |
| 1-Trifluoroacetylpseudouridine TP | — | U | NO |
| 1-Trifluoromethyl-pseudo-UTP | — | U | NO |
| 1-Vinylpseudouridine TP | — | U | NO |
| 2,2'-anhydro-uridine TP | — | U | NO |
| 2'-bromo-deoxyuridine TP | — | U | NO |
| 2'-F-5-Methyl-2'-deoxy-UTP | — | U | NO |
| 2'-OMe-5-Me-UTP | — | U | NO |
| 2'-OMe-pseudo-UTP | — | U | NO |
| 2'-a-Ethynyluridine TP | — | U | NO |
| 2'-a-Trifluoromethyluridine TP | — | U | NO |
| 2'-b-Ethynyluridine TP | — | U | NO |
| 2'-b-Trifluoromethyluridine TP | — | U | NO |
| 2'-Deoxy-2',2'-difluorouridine TP | — | U | NO |
| 2'-Deoxy-2'-a-mercaptouridine TP | — | U | NO |
| 2'-Deoxy-2'-a-thiomethoxyuridine TP | — | U | NO |
| 2'-Deoxy-2'-b-aminouridine TP | — | U | NO |
| 2'-Deoxy-2'-b-azidouridine TP | — | U | NO |
| 2'-Deoxy-2'-b-bromouridine TP | — | U | NO |
| 2'-Deoxy-2'-b-chlorouridine TP | — | U | NO |
| 2'-Deoxy-2'-b-fluorouridine TP | — | U | NO |

TABLE 5-continued

Modifications

| Name | Symbol | Base | Naturally Occurring |
|---|---|---|---|
| 2'-Deoxy-2'-b-iodouridine TP | — | U | NO |
| 2'-Deoxy-2'-b-mercaptouridine TP | — | U | NO |
| 2'-Deoxy-2'-b-thiomethoxyuridine TP | — | U | NO |
| 2-methoxy-4-thio-uridine | — | U | NO |
| 2-methoxyuridine | — | U | NO |
| 2'-O-Methyl-5-(1-propynyl)uridine TP | — | U | NO |
| 3-Alkyl-pseudo-UTP | — | U | NO |
| 4'-Azidouridine TP | — | U | NO |
| 4'-Carbocyclic uridine TP | — | U | NO |
| 4'-Ethynyluridine TP | — | U | NO |
| 5-(1-Propynyl)ara-uridine TP | — | U | NO |
| 5-(2-Furanyl)uridine TP | — | U | NO |
| 5-Cyanouridine TP | — | U | NO |
| 5-Dimethylaminouridine TP | — | U | NO |
| 5'-Homo-uridine TP | — | U | NO |
| 5-iodo-2'-fluoro-deoxyuridine TP | — | U | NO |
| 5-Phenylethynyluridine TP | — | U | NO |
| 5-Trideuteromethyl-6-deuterouridine TP | — | U | NO |
| 5-Trifluoromethyl-Uridine TP | — | U | NO |
| 5-Vinylarauridine TP | — | U | NO |
| 6-(2,2,2-Trifluoroethyl)-pseudo-UTP | — | U | NO |
| 6-(4-Morpholino)-pseudo-UTP | — | U | NO |
| 6-(4-Thiomorpholino)-pseudo-UTP | — | U | NO |
| 6-(Substituted-Phenyl)-pseudo-UTP | — | U | NO |
| 6-Amino-pseudo-UTP | — | U | NO |
| 6-Azido-pseudo-UTP | — | U | NO |
| 6-Bromo-pseudo-UTP | — | U | NO |
| 6-Butyl-pseudo-UTP | — | U | NO |
| 6-Chloro-pseudo-UTP | — | U | NO |
| 6-Cyano-pseudo-UTP | — | U | NO |
| 6-Dimethylamino-pseudo-UTP | — | U | NO |
| 6-Ethoxy-pseudo-UTP | — | U | NO |
| 6-Ethylcarboxylate-pseudo-UTP | — | U | NO |
| 6-Ethyl-pseudo-UTP | — | U | NO |
| 6-Fluoro-pseudo-UTP | — | U | NO |
| 6-Formyl-pseudo-UTP | — | U | NO |
| 6-Hydroxyamino-pseudo-UTP | — | U | NO |
| 6-Hydroxy-pseudo-UTP | — | U | NO |
| 6-Iodo-pseudo-UTP | — | U | NO |
| 6-iso-Propyl-pseudo-UTP | — | U | NO |
| 6-Methoxy-pseudo-UTP | — | U | NO |
| 6-Methylamino-pseudo-UTP | — | U | NO |
| 6-Methyl-pseudo-UTP | — | U | NO |
| 6-Phenyl-pseudo-UTP | — | U | NO |
| 6-Phenyl-pseudo-UTP | — | U | NO |
| 6-Propyl-pseudo-UTP | — | U | NO |
| 6-tert-Butyl-pseudo-UTP | — | U | NO |
| 6-Trifluoromethoxy-pseudo-UTP | — | U | NO |
| 6-Trifluoromethyl-pseudo-UTP | — | U | NO |
| Alpha-thio-pseudo-UTP | — | U | NO |
| Pseudouridine 1-(4-methylbenzenesulfonic acid) TP | — | U | NO |
| Pseudouridine 1-(4-methylbenzoic acid) TP | — | U | NO |
| Pseudouridine TP 1-[3-(2-ethoxy)]propionic acid | — | U | NO |
| Pseudouridine TP 1-[3-{2-(2-[2-(2-ethoxy)-ethoxy]-ethoxy)-ethoxy}]propionic acid | — | U | NO |
| Pseudouridine TP 1-[3-{2-(2-[2-{2(2-ethoxy)-ethoxy}-ethoxy]-ethoxy)-ethoxy}]propionic acid | — | U | NO |
| Pseudouridine TP 1-[3-{2-(2-[2-(2-ethoxy]-ethoxy)-ethoxy}]propionic acid | — | U | NO |
| Pseudouridine TP 1-[3-{2-(2-(2-ethoxy)-ethoxy}] propionic acid | — | U | NO |
| Pseudouridine TP 1-methylphosphonic acid | — | U | NO |
| Pseudouridine TP 1-methylphosphonic acid diethyl ester | — | U | NO |
| Pseudo-UTP-N1-3-propionic acid | — | U | NO |
| Pseudo-UTP-N1-4-butanoic acid | — | U | NO |
| Pseudo-UTP-N1-5-pentanoic acid | — | U | NO |
| Pseudo-UTP-N1-6-hexanoic acid | — | U | NO |
| Pseudo-UTP-N1-7-heptanoic acid | — | U | NO |
| Pseudo-UTP-N1-methyl-p-benzoic acid | — | U | NO |
| Pseudo-UTP-N1-p-benzoic acid | — | U | NO |
| wybutosine | yW | W | YES |
| hydroxywybutosine | OHyW | W | YES |
| isowyosine | imG2 | W | YES |

TABLE 5-continued

Modifications

| Name | Symbol | Base | Naturally Occurring |
|---|---|---|---|
| peroxywybutosine | o2yW | W | YES |
| undermodified hydroxywybutosine | OHyW* | W | YES |
| 4-demethylwyosine | imG-14 | W | YES |

Other modifications which may be useful in the polynucleotides of the present invention are listed in Table 6.

TABLE 6

Additional Modification types

| Name | Type |
|---|---|
| 2,6-(diamino)purine | Other |
| 1-(aza)-2-(thio)-3-(aza)-phenoxazin-1-yl | Other |
| 1,3-(diaza)-2-(oxo)-phenthiazin-1-yl | Other |
| 1,3-(diaza)-2-(oxo)-phenoxazin-1-yl | Other |
| 1,3,5-(triaza)-2,6-(dioxa)-naphthalene | Other |
| 2 (amino)purine | Other |
| 2,4,5-(trimethyl)phenyl | Other |
| 2' methyl, 2'amino, 2'azido, 2'fluro-cytidine | Other |
| 2' methyl, 2'amino, 2'azido, 2'fluro-adenine | Other |
| 2'methyl, 2'amino, 2'azido, 2'fluro-uridine | Other |
| 2'-amino-2'-deoxyribose | Other |
| 2-amino-6-Chloro-purine | Other |
| 2-aza-inosinyl | Other |
| 2'-azido-2'-deoxyribose | Other |
| 2'fluoro-2'-deoxyribose | Other |
| 2'-fluoro-modified bases | Other |
| 2'-O-methyl-ribose | Other |
| 2-oxo-7-aminopyridopyrimidin-3-yl | Other |
| 2-oxo-pyridopyrimidine-3-yl | Other |
| 2-pyridinone | Other |
| 3 nitropyrrole | Other |
| 3-(methyl)-7-(propynyl)isocarbostyrilyl | Other |
| 3-(methyl)isocarbostyrilyl | Other |
| 4-(fluoro)-6-(methyl)benzimidazole | Other |
| 4-(methyl)benzimidazole | Other |
| 4-(methyl)indolyl | Other |
| 4,6-(dimethyl)indolyl | Other |
| 5 nitroindole | Other |
| 5 substituted pyrimidines | Other |
| 5-(methyl)isocarbostyrilyl | Other |
| 5-nitroindole | Other |
| 6-(aza)pyrimidine | Other |
| 6-(azo)thymine | Other |
| 6-(methyl)-7-(aza)indolyl | Other |
| 6-chloro-purine | Other |
| 6-phenyl-pyrrolo-pyrimidin-2-on-3-yl | Other |
| 7-(aminoalkylhydroxy)-1-(aza)-2-(thio)-3-(aza)-phenthiazin-1-yl | Other |
| 7-(aminoalkylhydroxy)-1-(aza)-2-(thio)-3-(aza)-phenoxazin-1-yl | Other |
| 7-(aminoalkylhydroxy)-1,3-(diaza)-2-(oxo)-phenoxazin-1-yl | Other |
| 7-(aminoalkylhydroxy)-1,3-(diaza)-2-(oxo)-phenthiazin-1-yl | Other |
| 7-(aminoalkylhydroxy)-1,3-(diaza)-2-(oxo)-phenoxazin-1-yl | Other |
| 7-(aza)indolyl | Other |
| 7-(guanidiniumalkylhydroxy)-1-(aza)-2-(thio)-3-(aza)-phenoxazinl-yl | Other |
| 7-(guanidiniumalkylhydroxy)-1-(aza)-2-(thio)-3-(aza)-phenthiazin-1-yl | Other |
| 7-(guanidiniumalkylhydroxy)-1-(aza)-2-(thio)-3-(aza)-phenoxazin-1-yl | Other |
| 7-(guanidiniumalkylhydroxy)-1,3-(diaza)-2-(oxo)-phenoxazin-1-yl | Other |
| 7-(guanidiniumalkylhydroxy-1,3-(diaza)-2-(oxo)-phenoxazin-1-yl | Other |
| 7-(guanidiniumalkylhydroxy)-1,3-(diaza)-2-(oxo)-phenoxazin-1-yl | Other |
| 7-(propynyl)isocarbostyrilyl | Other |
| 7-(propynyl)isocarbostyrilyl, propynyl-7-(aza)indolyl | Other |
| 7-deaza-inosinyl | Other |
| 7-substituted 1-(aza)-2-(thio)-3-(aza)-phenoxazin-1-yl | Other |
| 7-substituted 1,3-(diaza)-2-(oxo)-phenoxazin-1-yl | Other |
| 9-(methyl)-imidizopyridinyl | Other |
| aminoindolyl | Other |
| anthracenyl | Other |
| bis-ortho-(aminoalkylhydroxy)-6-phenyl-pyrrolo-pyrimidin-2-on-3-yl | Other |
| bis-ortho-substituted-6-phenyl-pyrrolo-pyrimidin-2-on-3-yl | Other |
| difluorotolyl | Other |
| hypoxanthine | Other |
| imidizopyridinyl | Other |
| inosinyl | Other |
| isocarbostyrilyl | Other |
| isoguanisine | Other |
| N2-substituted purines | Other |
| N6-methyl-2-amino-purine | Other |
| N6-substituted purines | Other |
| N-alkylated derivative | Other |
| napthalenyl | Other |
| nitrobenzimidazolyl | Other |
| nitroimidazolyl | Other |
| nitroindazolyl | Other |
| nitropyrazolyl | Other |
| nubularine | Other |
| O6-substituted purines | Other |
| O-alkylated derivative | Other |
| ortho-(aminoalkylhydroxy)-6-phenyl-pyrrolo-pyrimidin-2-on-3-yl | Other |
| ortho-substituted-6-phenyl-pyrrolo-pyrimidin-2-on-3-yl | Other |
| Oxoformycin TP | Other |
| para-(aminoalkylhydroxy)-6-phenyl-pyrrolo-pyrimidin-2-on-3-yl | Other |
| para-substituted-6-phenyl-pyrrolo-pyrimidin-2-on-3-yl | Other |
| pentacenyl | Other |
| phenanthracenyl | Other |
| phenyl | Other |
| propynyl-7-(aza)indolyl | Other |
| pyrenyl | Other |
| pyridopyrimidin-3-yl | Other |
| pyridopyrimidin-3-yl, 2-oxo-7-amino-pyridopyrimidin-3-yl | Other |
| pyrrolo-pyrimidin-2-on-3-yl | Other |
| pyrrolopyrimidinyl | Other |
| pyrrolopyrizinyl | Other |
| stilbenzyl | Other |
| substituted 1,2,4-triazoles | Other |
| tetracenyl | Other |
| tubercidine | Other |
| xanthine | Other |
| Xanthosine-5'-TP | Other |
| 2-thio-zebularine | Other |
| 5-aza-2-thio-zebularine | Other |
| 7-deaza-2-amino-purine | Other |
| pyridin-4-one ribonucleoside | Other |
| 2-Amino-riboside-TP | Other |
| Formycin A TP | Other |
| Formycin B TP | Other |
| Pyrrolosine TP | Other |
| 2'-OH-ara-adenosine TP | Other |
| 2'-OH-ara-cytidine TP | Other |
| 2'-OH-ara-uridine TP | Other |
| 2'-OH-ara-guanosine TP | Other |
| 5-(2-carbomethoxyvinyl)uridine TP | Other |
| N6-(19-Amino-pentaoxanonadecyl)adenosine TP | Other |

The polynucleotides can include any useful linker between the nucleosides. Such linkers, including backbone modifications are given in Table 7.

TABLE 7

Linker modifications

| Name | TYPE |
| --- | --- |
| 3'-alkylene phosphonates | Linker |
| 3'-amino phosphoramidate | Linker |
| alkene containing backbones | Linker |
| aminoalkylphosphoramidates | Linker |
| aminoalkylphosphotriesters | Linker |
| boranophosphates | Linker |
| —CH2-0-N(CH3)—CH2— | Linker |
| —CH2—N(CH3)—N(CH3)—CH2— | Linker |
| —CH2—NH—CH2— | Linker |
| chiral phosphonates | Linker |
| chiral phosphorothioates | Linker |
| formacetyl and thioformacetyl backbones | Linker |
| methylene (methylimino) | Linker |
| methylene formacetyl and thioformacetyl backbones | Linker |
| methyleneimino and methylenehydrazino backbones | Linker |
| morpholino linkages | Linker |
| —N(CH3)—CH2—CH2— | Linker |
| oligonucleosides with heteroatom internucleoside linkage | Linker |
| phosphinates | Linker |
| phosphoramidates | Linker |
| phosphorodithioates | Linker |
| phosphorothioate internucleoside linkages | Linker |
| phosphorothioates | Linker |
| phosphotriesters | Linker |
| PNA | Linker |
| siloxane backbones | Linker |
| sulfamate backbones | Linker |
| sulfide sulfoxide and sulfone backbones | Linker |
| sulfonate and sulfonamide backbones | Linker |
| thionoalkylphosphonates | Linker |
| thionoalkylphosphotriesters | Linker |
| thionophosphoramidates | Linker |

The polynucleotides can include any useful modification, such as to the sugar, the nucleobase, or the internucleoside linkage (e.g. to a linking phosphate/to a phosphodiester linkage/to the phosphodiester backbone). One or more atoms of a pyrimidine nucleobase may be replaced or substituted with optionally substituted amino, optionally substituted thiol, optionally substituted alkyl (e.g., methyl or ethyl), or halo (e.g., chloro or fluoro). In certain embodiments, modifications (e.g., one or more modifications) are present in each of the sugar and the internucleoside linkage. Modifications according to the present invention may be modifications of ribonucleic acids (RNAs) to deoxyribonucleic acids (DNAs), threose nucleic acids (TNAs), glycol nucleic acids (GNAs), peptide nucleic acids (PNAs), locked nucleic acids (LNAs) or hybrids thereof). Additional modifications are described herein.

In some embodiments, the polynucleotides of the invention do not substantially induce an innate immune response of a cell into which the mRNA is introduced. Features of an induced innate immune response include 1) increased expression of pro-inflammatory cytokines, 2) activation of intracellular PRRs (RIG-I, MDA5, etc, and/or 3) termination or reduction in protein translation.

In certain embodiments, it may desirable to intracellularly degrade a polynucleotide introduced into the cell. For example, degradation of a polynucleotide may be preferable if precise timing of protein production is desired. Thus, in some embodiments, the invention provides a polynucleotide containing a degradation domain, which is capable of being acted on in a directed manner within a cell.

Any of the regions of the polynucleotides may be chemically modified as taught herein or as taught in International Application Number PCT/2012/058519 filed Oct. 3, 2012 and U.S. Provisional Application No. 61/837,297 filed Jun. 20, 2013 the contents of each of which are incorporated herein by reference in its entirety.

Modified Polynucleotide Molecules

The present invention also includes building blocks, e.g., modified ribonucleosides, and modified ribonucleotides, of polynucleotide molecules. For example, these building blocks can be useful for preparing the polynucleotides of the invention. Such building blocks are taught in International Patent Publication No. WO2013052523 and International Patent Application No. PCT/US2013/75177, the contents of each of which are incorporated herein by reference in its entirety.

Modifications on the Sugar

The modified nucleosides and nucleotides (e.g., building block molecules), which may be incorporated into a polynucleotide (e.g., RNA or mRNA, as described herein), can be modified on the sugar of the ribonucleic acid. For example, the 2' hydroxyl group (OH) can be modified or replaced with a number of different substituents. Exemplary substitutions at the 2'-position include, but are not limited to, H, halo, optionally substituted $C_{1-6}$ alkyl; optionally substituted $C_{1-6}$ alkoxy; optionally substituted $C_{6-10}$ aryloxy; optionally substituted $C_{3-8}$ cycloalkyl; optionally substituted $C_{3-8}$ cycloalkoxy; optionally substituted $C_{6-10}$ aryloxy; optionally substituted $C_{6-10}$ aryl-$C_{1-6}$ alkoxy, optionally substituted $C_{1-12}$ (heterocyclyl)oxy; a sugar (e.g., ribose, pentose, or any described herein); a polyethyleneglycol (PEG), —O(CH$_2$CH$_2$O)$_n$CH$_2$CH$_2$OR, where R is H or optionally substituted alkyl, and n is an integer from 0 to 20 (e.g., from 0 to 4, from 0 to 8, from 0 to 10, from 0 to 16, from 1 to 4, from 1 to 8, from 1 to 10, from 1 to 16, from 1 to 20, from 2 to 4, from 2 to 8, from 2 to 10, from 2 to 16, from 2 to 20, from 4 to 8, from 4 to 10, from 4 to 16, and from 4 to 20); "locked" nucleic acids (LNA) in which the 2'-hydroxyl is connected by a $C_{1-6}$ alkylene or $C_{1-6}$ heteroalkylene bridge to the 4'-carbon of the same ribose sugar, where exemplary bridges included methylene, propylene, ether, or amino bridges; aminoalkyl, as defined herein; aminoalkoxy, as defined herein; amino as defined herein; and amino acid, as defined herein Generally, RNA includes the sugar group ribose, which is a 5-membered ring having an oxygen. Exemplary, non-limiting modified nucleotides include replacement of the oxygen in ribose (e.g., with S, Se, or alkylene, such as methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for anhydrohexitol, altritol, mannitol, cyclohexanyl, cyclohexenyl, and morpholino that also has a phosphoramidate backbone); multicyclic forms (e.g., tricyclo; and "unlocked" forms, such as glycol nucleic acid (GNA) (e.g., R-GNA or S-GNA, where ribose is replaced by glycol units attached to phosphodiester bonds), threose nucleic acid (TNA, where ribose is replace with α-L-threofuranosyl-(3'→2')), and peptide nucleic acid (PNA, where 2-amino-ethyl-glycine linkages replace the ribose and phosphodiester backbone). The sugar group can also contain one or more carbons that possess the opposite stereochemical configuration than that of the corresponding carbon in ribose. Thus, a polynucleotide molecule can include nucleotides containing, e.g., arabinose, as the sugar. Such sugar modifications are taught International Patent Publication No. WO2013052523 and International Patent Application No. PCT/US2013/75177, the contents of each of which are incorporated herein by reference in its entirety.

Modifications on the Nucleobase

The present disclosure provides for modified nucleosides and nucleotides. As described herein "nucleoside" is defined as a compound containing a sugar molecule (e.g., a pentose or ribose) or a derivative thereof in combination with an organic base (e.g., a purine or pyrimidine) or a derivative thereof (also referred to herein as "nucleobase"). As described herein, "nucleotide" is defined as a nucleoside including a phosphate group. The modified nucleotides may by synthesized by any useful method, as described herein (e.g., chemically, enzymatically, or recombinantly to include one or more modified or non-natural nucleosides). The polynucleotides may comprise a region or regions of linked nucleosides. Such regions may have variable backbone linkages. The linkages may be standard phosphoester linkages, in which case the polynucleotides would comprise regions of nucleotides.

The modified nucleotide base pairing encompasses not only the standard adenosine-thymine, adenosine-uracil, or guanosine-cytosine base pairs, but also base pairs formed between nucleotides and/or modified nucleotides comprising non-standard or modified bases, wherein the arrangement of hydrogen bond donors and hydrogen bond acceptors permits hydrogen bonding between a non-standard base and a standard base or between two complementary non-standard base structures. One example of such non-standard base pairing is the base pairing between the modified nucleotide inosine and adenine, cytosine or uracil.

The modified nucleosides and nucleotides can include a modified nucleobase. Examples of nucleobases found in RNA include, but are not limited to, adenine, guanine, cytosine, and uracil. Examples of nucleobase found in DNA include, but are not limited to, adenine, guanine, cytosine, and thymine. Such modified nucleobases (including the distinctions between naturally occurring and non-naturally occurring) are taught in International Patent Publication No. WO2013052523 and International Patent Application No. PCT/US2013/75177, the contents of each of which are incorporated herein by reference in its entirety.

Combinations of Modified Sugars, Nucleobases, and Internucleoside Linkages

The polynucleotides of the invention can include a combination of modifications to the sugar, the nucleobase, and/or the internucleoside linkage. These combinations can include any one or more modifications described herein.

Examples of modified nucleotides and modified nucleotide combinations are provided below in Table 8. These combinations of modified nucleotides can be used to form the polynucleotides of the invention. Unless otherwise noted, the modified nucleotides may be completely substituted for the natural nucleotides of the polynucleotides of the invention. As a non-limiting example, the natural nucleotide uridine may be substituted with a modified nucleoside described herein. In another non-limiting example, the natural nucleotide uridine may be partially substituted (e.g., about 0.1%, 1%, 5%, 10%, 15%, 20%, 25%, 30%, 35%, 40%, 45%, 50%, 55%, 60%, 65%, 70%, 75%, 80%, 85%, 90%, 95% or 99.9%) with at least one of the modified nucleoside disclosed herein. Any combination of base/sugar or linker may be incorporated into the polynucleotides of the invention and such modifications are taught in International Patent Publication No. WO2013052523 and International Patent Application No. PCT/US2013/75177, the contents of each of which are incorporated herein by reference in its entirety.

TABLE 8

Combinations

| Modified Nucleotide | Modified Nucleotide Combination |
|---|---|
| α-thio-cytidine | α-thio-cytidine/5-iodo-uridine |
| | α-thio-cytidine/N1-methyl-pseudouridine |
| | α-thio-cytidine/α-thio-uridine |
| | α-thio-cytidine/5-methyl-uridine |
| | α-thio-cytidine/pseudo-uridine |
| | about 50% of the cytosines are α-thio-cytidine |
| pseudoisocytidine | pseudoisocytidine/5-iodo-uridine |
| | pseudoisocytidine/N1-methyl-pseudouridine |
| | pseudoisocytidine/α-thio-uridine |
| | pseudoisocytidine/5-methyl-uridine |
| | pseudoisocytidine/pseudouridine |
| | about 25% of cytosines are pseudoisocytidine |
| | pseudoisocytidine/about 50% of uridines are N1-methyl-pseudouridine and about 50% of uridines are pseudouridine |
| | pseudoisocytidine/about 25% of uridines are N1-methyl-pseudouridine and about 25% of uridines are pseudouridine |
| pyrrolo-cytidine | pyrrolo-cytidine/5-iodo-uridine |
| | pyrrolo-cytidine/N1-methyl-pseudouridine |
| | pyrrolo-cytidine/α-thio-uridine |
| | pyrrolo-cytidine/5-methyl-uridine |
| | pyrrolo-cytidine/pseudouridine |
| | about 50% of the cytosines are pyrrolo-cytidine |
| 5-methyl-cytidine | 5-methyl-cytidine/5-iodo-uridine |
| | 5-methyl-cytidine/N1-methyl-pseudouridine |
| | 5-methyl-cytidine/α-thio-uridine |
| | 5-methyl-cytidine/5-methyl-uridine |
| | 5-methyl-cytidine/pseudouridine |
| | about 25% of cytosines are 5-methyl-cytidine |
| | about 50% of cytosines are 5-methyl-cytidine |
| | 5-methyl-cytidine/5-methoxy-uridine |
| | 5-methyl-cytidine/5-bromo-uridine |
| | 5-methyl-cytidine/2-thio-uridine |
| | 5-methyl-cytidine/about 50% of uridines are 2-thio-uridine |
| | about 50% of uridines are 5-methyl-cytidine/about 50% of uridines are 2-thio-uridine |
| N4-acetyl-cytidine | N4-acetyl-cytidine/5-iodo-uridine |
| | N4-acetyl-cytidine/N1-methyl-pseudouridine |
| | N4-acetyl-cytidine/α-thio-uridine |
| | N4-acetyl-cytidine/5-methyl-uridine |
| | N4-acetyl-cytidine/pseudouridine |
| | about 50% of cytosines are N4-acetyl-cytidine |
| | about 25% of cytosines are N4-acetyl-cytidine |
| | N4-acetyl-cytidine/5-methoxy-uridine |
| | N4-acetyl-cytidine/5-bromo-uridine |
| | N4-acetyl-cytidine/2-thio-uridine |
| | about 50% of cytosines are N4-acetyl-cytidine/about 50% of uridines are 2-thio-uridine |

IV. Pharmaceutical Compositions
Formulation, Administration, Delivery and Dosing The present invention provides polynucleotides compositions and complexes in combination with one or more pharmaceutically acceptable excipients. Pharmaceutical compositions may optionally comprise one or more additional active substances, e.g. therapeutically and/or prophylactically active substances. Pharmaceutical compositions of the present invention may be sterile and/or pyrogen-free. General considerations in the formulation and/or manufacture of pharmaceutical agents may be found, for example, in *Remington: The Science and Practice of Pharmacy* 21$^{st}$ ed., Lippincott Williams & Wilkins, 2005 (incorporated herein by reference in its entirety).

In some embodiments, compositions are administered to humans, human patients or subjects. For the purposes of the present disclosure, the phrase "active ingredient" generally refers to polynucleotides to be delivered as described herein.

Although the descriptions of pharmaceutical compositions provided herein are principally directed to pharmaceutical compositions which are suitable for administration to humans, it will be understood by the skilled artisan that such compositions are generally suitable for administration to any other animal, e.g., to non-human animals, e.g. non-human mammals. Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, including commercially relevant mammals such as cattle, pigs, horses, sheep, cats, dogs, mice, and/or rats; and/or birds, including commercially relevant birds such as poultry, chickens, ducks, geese, and/or turkeys.

Formulations of the pharmaceutical compositions described herein may be prepared by any method known or hereafter developed in the art of pharmacology. In general, such preparatory methods include the step of bringing the active ingredient into association with an excipient and/or one or more other accessory ingredients, and then, if necessary and/or desirable, dividing, shaping and/or packaging the product into a desired single- or multi-dose unit.

Relative amounts of the active ingredient, the pharmaceutically acceptable excipient, and/or any additional ingredients in a pharmaceutical composition in accordance with the invention will vary, depending upon the identity, size, and/or condition of the subject treated and further depending upon the route by which the composition is to be administered. By way of example, the composition may comprise between 0.1% and 100%, e.g., between 0.5 and 50%, between 1-30%, between 5-80%, at least 80% (w/w) active ingredient.

Formulations

The polynucleotides of the invention can be formulated using one or more excipients to: (1) increase stability; (2) increase cell transfection; (3) permit the sustained or delayed release (e.g., from a depot formulation of the polynucleotide); (4) alter the biodistribution (e.g., target the polynucleotide to specific tissues or cell types); (5) increase the translation of encoded protein in vivo; and/or (6) alter the release profile of encoded protein in vivo. In addition to traditional excipients such as any and all solvents, dispersion media, diluents, or other liquid vehicles, dispersion or suspension aids, surface active agents, isotonic agents, thickening or emulsifying agents, preservatives, excipients of the present invention can include, without limitation, lipidoids, liposomes, lipid nanoparticles, polymers, lipoplexes, core-shell nanoparticles, peptides, proteins, cells transfected with polynucleotides (e.g., for transplantation into a subject), hyaluronidase, nanoparticle mimics and combinations thereof. Accordingly, the formulations of the invention can include one or more excipients, each in an amount that together increases the stability of the polynucleotide, increases cell transfection by the polynucleotide, increases the expression of polynucleotides encoded protein, and/or alters the release profile of polynucleotide encoded proteins. Further, the polynucleotides of the present invention may be formulated using self-assembled nucleic acid nanoparticles.

Formulations of the pharmaceutical compositions described herein may be prepared by any method known or hereafter developed in the art of pharmacology. In general, such preparatory methods include the step of associating the active ingredient with an excipient and/or one or more other accessory ingredients.

A pharmaceutical composition in accordance with the present disclosure may be prepared, packaged, and/or sold in bulk, as a single unit dose, and/or as a plurality of single unit doses. As used herein, a "unit dose" refers to a discrete amount of the pharmaceutical composition comprising a predetermined amount of the active ingredient. The amount of the active ingredient is generally equal to the dosage of the active ingredient which would be administered to a subject and/or a convenient fraction of such a dosage such as, for example, one-half or one-third of such a dosage.

Relative amounts of the active ingredient, the pharmaceutically acceptable excipient, and/or any additional ingredients in a pharmaceutical composition in accordance with the present disclosure may vary, depending upon the identity, size, and/or condition of the subject being treated and further depending upon the route by which the composition is to be administered. For example, the composition may comprise between 0.1% and 99% (w/w) of the active ingredient. By way of example, the composition may comprise between 0.1% and 100%, e.g., between 0.5 and 50%, between 1-30%, between 5-80%, at least 80% (w/w) active ingredient.

In some embodiments, the formulations described herein may contain at least one polynucleotide. As a non-limiting example, the formulations may contain 1, 2, 3, 4 or 5 polynucleotides.

In one embodiment, the formulations described herein may comprise more than one type of polynucleotide. In one embodiment, the formulation may comprise a polynucleotide in linear and circular form. In another embodiment, the formulation may comprise a circular polynucleotide and an IVT polynucleotide. In yet another embodiment, the formulation may comprise an IVT polynucleotide, a chimeric polynucleotide and a circular polynucleotide.

In one embodiment the formulation may contain polynucleotide encoding a LDLR protein or a LDLR protein comprising at least one mutation (e.g., a LDLR cell surface expression-enhancing mutation, a mutation increasing the residence time of LDLR at the cell surface or a mutation resulting in increased levels of LDLR at the cell surface).

Pharmaceutical formulations may additionally comprise a pharmaceutically acceptable excipient, which, as used herein, includes, but is not limited to, any and all solvents, dispersion media, diluents, or other liquid vehicles, dispersion or suspension aids, surface active agents, isotonic agents, thickening or emulsifying agents, preservatives, and the like, as suited to the particular dosage form desired. Various excipients for formulating pharmaceutical compositions and techniques for preparing the composition are known in the art (see *Remington: The Science and Practice of Pharmacy*, 21$^{st}$ Edition, A. R. Gennaro, Lippincott, Williams & Wilkins, Baltimore, Md., 2006; incorporated herein by reference in its entirety). The use of a conventional excipient medium may be contemplated within the scope of the present disclosure, except insofar as any conventional excipient medium may be incompatible with a substance or its derivatives, such as by producing any undesirable biological effect or otherwise interacting in a deleterious manner with any other component(s) of the pharmaceutical composition.

In some embodiments, the particle size of the lipid nanoparticle may be increased and/or decreased. The change in particle size may be able to help counter biological reaction such as, but not limited to, inflammation or may increase the biological effect of the modified mRNA delivered to mammals.

Pharmaceutically acceptable excipients used in the manufacture of pharmaceutical compositions include, but are not limited to, inert diluents, surface active agents and/or emulsifiers, preservatives, buffering agents, lubricating agents, and/or oils. Such excipients may optionally be included in the pharmaceutical formulations of the invention.

In one embodiment, the polynucleotides may be administered in or with, formulated in or delivered with nanostructures that can sequester molecules such as cholesterol. Non-limiting examples of these nanostructures and methods of making these nanostructures are described in US Patent Publication No. US20130195759, the contents of which are herein incorporated by reference in its entirety. Exemplary structures of these nanostructures are shown in FIG. 1 of US Patent Publication No. US20130195759, the contents of which are herein incorporated by reference in its entirety, and may include a core and a shell surrounding the core.

Lipidoids

The synthesis of lipidoids has been extensively described and formulations containing these compounds are particularly suited for delivery of polynucleotides (see Mahon et al., Bioconjug Chem. 2010 21:1448-1454; Schroeder et al., J Intern Med. 2010 267:9-21; Akinc et al., Nat Biotechnol. 2008 26:561-569; Love et al., Proc Natl Acad Sci USA. 2010 107:1864-1869; Siegwart et al., Proc Natl Acad Sci USA. 2011 108:12996-3001; all of which are incorporated herein in their entireties).

While these lipidoids have been used to effectively deliver double stranded small interfering RNA molecules in rodents and non-human primates (see Akinc et al., Nat Biotechnol. 2008 26:561-569; Frank-Kamenetsky et al., Proc Natl Acad Sci USA. 2008 105:11915-11920; Akinc et al., Mol Ther. 2009 17:872-879; Love et al., Proc Natl Acad Sci USA. 2010 107:1864-1869; Leuschner et al., Nat Biotechnol. 2011 29:1005-1010; all of which is incorporated herein in their entirety), the present disclosure describes their formulation and use in delivering polynucleotides.

Complexes, micelles, liposomes or particles can be prepared containing these lipidoids and therefore, can result in an effective delivery of the polynucleotide, as judged by the production of an encoded protein, following the injection of a lipidoid formulation via localized and/or systemic routes of administration. Lipidoid complexes of polynucleotides can be administered by various means including, but not limited to, intravenous, intramuscular, or subcutaneous routes.

In vivo delivery of nucleic acids may be affected by many parameters, including, but not limited to, the formulation composition, nature of particle PEGylation, degree of loading, polynucleotide to lipid ratio, and biophysical parameters such as, but not limited to, particle size (Akinc et al., Mol Ther. 2009 17:872-879; herein incorporated by reference in its entirety). As an example, small changes in the anchor chain length of poly(ethylene glycol) (PEG) lipids may result in significant effects on in vivo efficacy. Formulations with the different lipidoids, including, but not limited to penta[3-(1-laurylaminopropionyl)]-triethylenetetramine hydrochloride (TETA-5LAP; aka 98N12-5, see Murugaiah et al., Analytical Biochemistry, 401:61 (2010); herein incorporated by reference in its entirety), C12-200 (including derivatives and variants), and MD1, can be tested for in vivo activity.

The lipidoid referred to herein as "98N12-5" is disclosed by Akinc et al., Mol Ther. 2009 17:872-879 and is incorporated by reference in its entirety.

The lipidoid referred to herein as "C12-200" is disclosed by Love et al., Proc Natl Acad Sci USA. 2010 107:1864-1869 and Liu and Huang, Molecular Therapy. 2010 669-670; both of which are herein incorporated by reference in their entirety. The lipidoid formulations can include particles comprising either 3 or 4 or more components in addition to polynucleotides.

Lipidoids and polynucleotide formulations comprising lipidoids are described in International Patent Application No. PCT/US2014/097077, the contents of which are herein incorporated by reference in its entirety, such as in paragraphs [000415]-[000422].

Liposomes, Lipoplexes, and Lipid Nanoparticles

The polynucleotides of the invention can be formulated using one or more liposomes, lipoplexes, or lipid nanoparticles. In one embodiment, pharmaceutical compositions of polynucleotides include liposomes. Liposomes are artificially-prepared vesicles which may primarily be composed of a lipid bilayer and may be used as a delivery vehicle for the administration of nutrients and pharmaceutical formulations. Liposomes can be of different sizes such as, but not limited to, a multilamellar vesicle (MLV) which may be hundreds of nanometers in diameter and may contain a series of concentric bilayers separated by narrow aqueous compartments, a small unicellular vesicle (SUV) which may be smaller than 50 nm in diameter, and a large unilamellar vesicle (LUV) which may be between 50 and 500 nm in diameter. Liposome design may include, but is not limited to, opsonins or ligands in order to improve the attachment of liposomes to unhealthy tissue or to activate events such as, but not limited to, endocytosis. Liposomes may contain a low or a high pH in order to improve the delivery of the pharmaceutical formulations.

The formation of liposomes may depend on the physicochemical characteristics such as, but not limited to, the pharmaceutical formulation entrapped and the liposomal ingredients, the nature of the medium in which the lipid vesicles are dispersed, the effective concentration of the entrapped substance and its potential toxicity, any additional processes involved during the application and/or delivery of the vesicles, the optimization size, polydispersity and the shelf-life of the vesicles for the intended application, and the batch-to-batch reproducibility and possibility of large-scale production of safe and efficient liposomal products.

As a non-limiting example, liposomes such as synthetic membrane vesicles may be prepared by the methods, apparatus and devices described in US Patent Publication No. US20130177638, US20130177637, US20130177636, US20130177635, US20130177634, US20130177633, US20130183375, US20130183373 and US20130183372, the contents of each of which are herein incorporated by reference in its entirety.

In one embodiment, pharmaceutical compositions described herein may include, without limitation, liposomes such as those formed from 1,2-dioleyloxy-N,N-dimethylaminopropane (DODMA) liposomes, DiLa2 liposomes from Marina Biotech (Bothell, Wash.), 1,2-dilinoleyloxy-3-dimethylaminopropane (DLin-DMA), 2,2-dilinoleyl-4-(2-dimethylaminoethyl)-[1,3]-dioxolane (DLin-KC2-DMA), and MC3 (US20100324120; herein incorporated by reference in its entirety) and liposomes which may deliver small molecule drugs such as, but not limited to, DOXIL® from Janssen Biotech, Inc. (Horsham, Pa.).

In one embodiment, pharmaceutical compositions described herein may include, without limitation, liposomes such as those formed from the synthesis of stabilized plasmid-lipid particles (SPLP) or stabilized nucleic acid lipid particle (SNALP) that have been previously described and shown to be suitable for oligonucleotide delivery in vitro and in vivo (see Wheeler et al. Gene Therapy. 1999 6:271-281; Zhang et al. Gene Therapy. 1999 6:1438-1447; Jeffs et al. Pharm Res. 2005 22:362-372; Morrissey et al., Nat Biotechnol. 2005 2:1002-1007; Zimmermann et al., Nature. 2006 441:111-114; Heyes et al. J Contr Rel. 2005 107:276-287; Semple et al. Nature Biotech. 2010 28:172-176; Judge et al. J Clin Invest. 2009 119:661-673; deFougerolles Hum Gene Ther. 2008 19:125-132; U.S. Patent Publication No US20130122104; all of which are incorporated herein in their entireties). The original manufacture method by Wheeler et al. was a detergent dialysis method, which was later improved by Jeffs et al. and is referred to as the spontaneous vesicle formation method. The liposome formulations are composed of 3 to 4 lipid components in addition to the polynucleotide. As an example a liposome can contain, but is not limited to, 55% cholesterol, 20% disteroylphosphatidyl choline (DSPC), 10% PEG-S-DSG, and 15% 1,2-dioleyloxy-N,N-dimethylaminopropane (DODMA), as described by Jeffs et al. As another example, certain liposome formulations may contain, but are not limited to, 48% cholesterol, 20% DSPC, 2% PEG-c-DMA, and 30% cationic lipid, where the cationic lipid can be 1,2-distearloxy-N,N-dimethylaminopropane (DSDMA), DODMA, DLin-DMA, or 1,2-dilinolenyloxy-3-dimethylaminopropane (DLenDMA), as described by Heyes et al.

In some embodiments, liposome formulations may comprise from about about 25.0% cholesterol to about 40.0% cholesterol, from about 30.0% cholesterol to about 45.0% cholesterol, from about 35.0% cholesterol to about 50.0% cholesterol and/or from about 48.5% cholesterol to about 60% cholesterol. In a preferred embodiment, formulations may comprise a percentage of cholesterol selected from the group consisting of 28.5%, 31.5%, 33.5%, 36.5%, 37.0%, 38.5%, 39.0% and 43.5%. In some embodiments, formulations may comprise from about 5.0% to about 10.0% DSPC and/or from about 7.0% to about 15.0% DSPC.

In one embodiment, pharmaceutical compositions may include liposomes which may be formed to deliver polynucleotides which may encode at least one immunogen or any other polypeptide of interest. The polynucleotide may be encapsulated by the liposome and/or it may be contained in an aqueous core which may then be encapsulated by the liposome (see International Pub. Nos. WO2012031046, WO2012031043, WO2012030901 and WO2012006378 and US Patent Publication No. US20130189351, US20130195969 and US20130202684; the contents of each of which are herein incorporated by reference in their entirety).

In another embodiment, liposomes may be formulated for targeted delivery. As a non-limiting example, the liposome may be formulated for targeted delivery to the liver. The liposome used for targeted delivery may include, but is not limited to, the liposomes described in and methods of making liposomes described in US Patent Publication No. US20130195967, the contents of which are herein incorporated by reference in its entirety.

In another embodiment, the polynucleotide may be formulated in a cationic oil-in-water emulsion where the emulsion particle comprises an oil core and a cationic lipid which can interact with the polynucleotide anchoring the molecule to the emulsion particle (see International Pub. No. WO2012006380; herein incorporated by reference in its entirety).

In one embodiment, the polynucleotides may be formulated in a water-in-oil emulsion comprising a continuous hydrophobic phase in which the hydrophilic phase is dispersed. As a non-limiting example, the emulsion may be made by the methods described in International Publication No. WO201087791, herein incorporated by reference in its entirety.

In another embodiment, the lipid formulation may include at least cationic lipid, a lipid which may enhance transfection and a least one lipid which contains a hydrophilic head group linked to a lipid moiety (International Pub. No. WO2011076807 and U.S. Pub. No. 20110200582; the contents of each of which is herein incorporated by reference in their entirety). In another embodiment, the polynucleotides may be formulated in a lipid vesicle which may have crosslinks between functionalized lipid bilayers (see U.S. Pub. No. 20120177724, the contents of which is herein incorporated by reference in its entirety).

In one embodiment, the polynucleotides may be formulated in a liposome as described in International Patent Publication No. WO2013086526, herein incorporated by reference in its entirety. The polynucleotides may be encapsulated in a liposome using reverse pH gradients and/or optimized internal buffer compositions as described in International Patent Publication No. WO2013086526, herein incorporated by reference in its entirety.

In one embodiment, the pharmaceutical compositions may be formulated in liposomes such as, but not limited to, DiLa2 liposomes (Marina Biotech, Bothell, Wash.), SMARTICLES® (Marina Biotech, Bothell, Wash.), neutral DOPC (1,2-dioleoyl-sn-glycero-3-phosphocholine) based liposomes (e.g., siRNA delivery for ovarian cancer (Landen et al. Cancer Biology & Therapy 2006 5(12)1708-1713); herein incorporated by reference in its entirety) and hyaluronan-coated liposomes (Quiet Therapeutics, Israel).

In one embodiment, the cationic lipid may be a low molecular weight cationic lipid such as those described in US Patent Application No. 20130090372, the contents of which are herein incorporated by reference in its entirety.

In one embodiment, the polynucleotides may be formulated in a lipid vesicle which may have crosslinks between functionalized lipid bilayers.

In one embodiment, the polynucleotides may be formulated in a liposome comprising a cationic lipid. The liposome may have a molar ratio of nitrogen atoms in the cationic lipid to the phosphates in the RNA (N:P ratio) of between 1:1 and 20:1 as described in International Publication No. WO2013006825, herein incorporated by reference in its entirety. In another embodiment, the liposome may have a N:P ratio of greater than 20:1 or less than 1:1.

In one embodiment, the polynucleotides may be formulated in a lipid-polycation complex. The formation of the lipid-polycation complex may be accomplished by methods known in the art and/or as described in U.S. Pub. No. 20120178702, herein incorporated by reference in its entirety. As a non-limiting example, the polycation may include a cationic peptide or a polypeptide such as, but not limited to, polylysine, polyornithine and/or polyarginine and the cationic peptides described in International Pub. No. WO2012013326 or US Patent Pub. No. US20130142818; each of which is herein incorporated by reference in its entirety. In another embodiment, the polynucleotides may be formulated in a lipid-polycation complex which may further include a neutral lipid such as, but not limited to, cholesterol or dioleoyl phosphatidylethanolamine (DOPE).

In one embodiment, the polynucleotide may be formulated in an aminoalcohol lipidoid. Aminoalcohol lipidoids which may be used in the present invention may be prepared by the methods described in U.S. Pat. No. 8,450,298, herein incorporated by reference in its entirety.

The liposome formulation may be influenced by, but not limited to, the selection of the cationic lipid component, the degree of cationic lipid saturation, the nature of the PEGylation, ratio of all components and biophysical parameters such as size. In one example by Semple et al. (Semple et al. Nature Biotech. 2010 28:172-176; herein incorporated by reference in its entirety), the liposome formulation was composed of 57.1% cationic lipid, 7.1% dipalmitoylphosphatidylcholine, 34.3% cholesterol, and 1.4% PEG-c-DMA. As another example, changing the composition of the cationic lipid could more effectively deliver siRNA to various antigen presenting cells (Basha et al. Mol Ther. 2011 19:2186-2200; herein incorporated by reference in its entirety). In some embodiments, liposome formulations may comprise from about 35 to about 45% cationic lipid, from about 40% to about 50% cationic lipid, from about 50% to about 60% cationic lipid and/or from about 55% to about 65% cationic lipid. In some embodiments, the ratio of lipid to mRNA in liposomes may be from about about 5:1 to about 20:1, from about 10:1 to about 25:1, from about 15:1 to about 30:1 and/or at least 30:1.

In some embodiments, the ratio of PEG in the lipid nanoparticle (LNP) formulations may be increased or decreased and/or the carbon chain length of the PEG lipid may be modified from C14 to C18 to alter the pharmacokinetics and/or biodistribution of the LNP formulations. As a non-limiting example, LNP formulations may contain from about 0.5% to about 3.0%, from about 1.0% to about 3.5%, from about 1.5% to about 4.0%, from about 2.0% to about 4.5%, from about 2.5% to about 5.0% and/or from about 3.0% to about 6.0% of the lipid molar ratio of PEG-c-DOMG as compared to the cationic lipid, DSPC and cholesterol. In another embodiment the PEG-c-DOMG may be replaced with a PEG lipid such as, but not limited to, PEG-DSG (1,2-Distearoyl-sn-glycerol, methoxypolyethylene glycol), PEG-DMG (1,2-Dimyristoyl-sn-glycerol) and/or PEG-DPG (1,2-Dipalmitoyl-sn-glycerol, methoxypolyethylene glycol). The cationic lipid may be selected from any lipid known in the art such as, but not limited to, DLin-MC3-DMA, DLin-DMA, C12-200 and DLin-KC2-DMA.

In one embodiment, the polynucleotides may be formulated in a lipid nanoparticle such as those described in International Publication No. WO2012170930, herein incorporated by reference in its entirety.

In one embodiment, the formulation comprising the polynucleotide is a nanoparticle which may comprise at least one lipid. The lipid may be selected from, but is not limited to, DLin-DMA, DLin-K-DMA, 98N12-5, C12-200, DLin-MC3-DMA, DLin-KC2-DMA, DODMA, PLGA, PEG, PEG-DMG, PEGylated lipids and amino alcohol lipids. In another aspect, the lipid may be a cationic lipid such as, but not limited to, DLin-DMA, DLin-D-DMA, DLin-MC3-DMA, DLin-KC2-DMA, DODMA and amino alcohol lipids. The amino alcohol cationic lipid may be the lipids described in and/or made by the methods described in US Patent Publication No. US20130150625, herein incorporated by reference in its entirety. As a non-limiting example, the cationic lipid may be 2-amino-3-[(9Z,12Z)-octadeca-9,12-dien-1-yloxy]-2-{[(9Z,2Z)-octadeca-9,12-dien-1-yloxy]methyl}propan-1-ol (Compound 1 in US20130150625); 2-amino-3-[(9Z)-octadec-9-en-1-yloxy]-2-{[(9Z)-octadec-9-en-1-yloxy]methyl propan-1-ol (Compound 2 in US20130150625); 2-amino-3-[(9Z,12Z)-octadeca-9,12-dien-1-yloxy]-2-[(octyloxy)methyl]propan-1-ol (Compound 3 in US20130150625); and 2-(dimethylamino)-3-[(9Z,12Z)-octadeca-9,12-dien-1-yloxy]-2-{[(9Z,12Z)-octadeca-9,12-dien-1-yloxy]methyl}propan-1-ol (Compound 4 in US20130150625); or any pharmaceutically acceptable salt or stereoisomer thereof.

In one embodiment, the cationic lipid may be selected from, but not limited to, a cationic lipid described in International Publication Nos. WO2012040184, WO2011153120, WO2011149733, WO2011090965, WO2011043913, WO2011022460, WO2012061259, WO2012054365, WO2012044638, WO2010080724, WO201021865, WO2008103276, WO2013086373 and WO2013086354, U.S. Pat. Nos. 7,893,302, 7,404,969, 8,283,333, and 8,466,122 and US Patent Publication No. US20100036115, US20120202871, US20130064894, US20130129785, US20130150625, US20130178541 and US20130225836; the contents of each of which are herein incorporated by reference in their entirety. In another embodiment, the cationic lipid may be selected from, but not limited to, formula A described in International Publication Nos. WO2012040184, WO2011153120, WO2011149733, WO2011090965, WO2011043913, WO2011022460, WO2012061259, WO2012054365, WO2012044638 and WO2013116126 or US Patent Publication No. US20130178541 and US20130225836; the contents of each of which is herein incorporated by reference in their entirety. In yet another embodiment, the cationic lipid may be selected from, but not limited to, formula CLI-CLXXIX of International Publication No. WO2008103276, formula CLI-CLXXIX of U.S. Pat. No. 7,893,302, formula CLI-CLXXXII of U.S. Pat. No. 7,404,969 and formula I-VI of US Patent Publication No. US20100036115, formula I of US Patent Publication No US20130123338; each of which is herein incorporated by reference in their entirety. As a non-limiting example, the cationic lipid may be selected from (20Z,23Z)—N,N-dimethylnonacosa-20,23-dien-10-amine, (17Z,20Z)—N,N-dimemylhexacosa-17,20-dien-9-amine, (1Z,19Z)—N5N-dimethylpentacosa-1 6, 19-dien-8-amine, (13Z,16Z)—N,N-dimethyldocosa-13,16-dien-5-amine, (12Z,15Z)—N,N-dimethylhenicosa-12,15-dien-4-amine, (14Z,17Z)—N,N-dimethyltricosa-14,17-dien-6-amine, (15Z,18Z)—N,N-dimethyltetracosa-15,18-dien-7-amine, (18Z,21Z)—N,N-dimethylheptacosa-18,21-dien-10-amine, (15Z,18Z)—N,N-dimethyltetracosa-15,18-dien-5-amine, (14Z,17Z)—N,N-dimethyltricosa-14,17-dien-4-amine, (19Z,22Z)—N,N-dimeihyloctacosa-19,22-dien-9-amine, (18Z,21 Z)—N,N-dimethylheptacosa-18,21-dien-8-amine, (17Z,20Z)—N,N-dimethylhexacosa-17,20-dien-7-amine, (16Z,19Z)—N,N-dimethylpentacosa-16,19-dien-6-amine, (22Z,25Z)—N,N-dimethylhentriaconta-22,25-dien-10-amine, (21 Z,24Z)—N,N-dimethyltriaconta-21,24-dien-9-amine, (18Z)—N,N-dimetylheptacos-18-en-10-amine, (17Z)—N,N-dimethylhexacos-17-en-9-amine, (19Z,22Z)—N,N-dimethyloctacosa-19,22-dien-7-amine, N,N-dimethylheptacosan-10-amine, (20Z,23Z)—N-ethyl-N-methylnonacosa-20,23-dien-10-amine, 1-[(11Z,14Z)-1-nonylicosa-11,14-dien-1-yl] pyrrolidine, (20Z)—N,N-dimethylheptacos-20-en-10-amine, (15Z)—N,N-dimethyl eptacos-15-en-10-amine, (14Z)—N,N-dimethylnonacos-14-en-10-amine, (17Z)—N,N-dimethylnonacos-17-en-10-amine, (24Z)—N,N-dimethyltritriacont-24-en-10-amine, (20Z)—N,N-dimethylnonacos-20-en-10-amine, (22Z)—N,N-dimethylhentriacont-22-en-10-amine, (16Z)—N,N-dimethylpentacos-16-en-8-amine, (12Z,15Z)—N,N-dimethyl-2-nonylhenicosa-12,15-dien-1-amine, (13Z,16Z)—N,N-dimethyl-3-nonyldocosa-13,16-dien-1-amine, N,N-dimethyl-1-[(1S,2R)-2-octylcyclopropyl] eptadecan-8-amine, 1-[(1S,2R)-2-hexylcyclopropyl]-N,N-dimethylnonadecan-10-amine, N,N-dimethyl-1-[(1S,2R)-2- octylcyclopropyl]nonadecan-10-amine, N,N-dimethyl-21-[(1S,2R)-2-octylcyclopropyl]henicosan-10-amine,N,N-dimethyl-1-[(1S,2S)-2-{[(1R,2R)-2-pentylcyclopropyl]methyl}cyclopropyl]nonadecan-10-amine,N,N-dimethyl-1-[(1S,2R)-2-octylcyclopropyl]hexadecan-8-amine, N,N-dimethyl-R1R,2S)-2-undecylcyclopropyl]tetradecan-5-amine, N,N-dimethyl-3-{7-[(1S,2R)-2-octylcyclopropyl]heptyl dodecan-1-amine, 1-[(1R,2S)-2-heptylcyclopropyl]-N,N-dimethyloctadecan-9-amine, 1-[(1S,2R)-2-decylcyclopropyl]-N,N-dimethylpentadecan-6-amine, N,N-dimethyl-1-[(1S,2R)-2-octylcyclopropyl]pentadecan-8-amine, R—N,N-dimethyl-1-[(9Z,12Z)-octadeca-9,12-dien-1-yloxy]-3-(octyloxy)propan-2-amine, S—N,N-dimethyl-1-[(9Z,12Z)-octadeca-9,12-dien-1-yloxy]-3-(octyloxy)propan-2-amine, 1-{2-[(9Z,12Z)-octadeca-9,12-dien-1-yloxy]-1-[(octyloxy)methyl]ethyl}pyrrolidine, (2S)—N,N-dimethyl-1-[(9Z,12Z)-octadeca-9,12-dien-1-yloxy]-3-[(5Z)-oct-5-en-1-yloxy]propan-2-amine, 1-{2-[(9Z,12Z)-octadeca-9,12-dien-1-yloxy]-1-[(octyloxy)methyl]ethyl}azetidine, (2S)-1-(hexyloxy)-N,N-dimethyl-3-[(9Z,12Z)-octadeca-9,12-dien-1-yloxy]propan-2-amine, (2S)-1-(heptyloxy)-N,N-dimethyl-3-[(9Z,12Z)-octadeca-9,12-dien-1-yloxy]propan-2-amine, N,N-dimethyl-1-(nonyloxy)-3-[(9Z,12Z)-octadeca-9,12-dien-1-yloxy]propan-2-amine, N,N-dimethyl-1-[(9Z)-octadec-9-en-1-yloxy]-3-(octyloxy)propan-2-amine; (2S)—N,N-dimethyl-1-[(6Z,9Z,12Z)-octadeca-6,9,12-trien-1-yloxy]-3-(octyloxy)propan-2-amine, (2S)-1-[(11Z,14Z)-icosa-11,14-dien-1-yloxy]-N,N-dimethyl-3-(pentyloxy)propan-2-amine, (2S)-1-(hexyloxy)-3-[(11Z,14Z)-icosa-11,14-dien-1-yloxy]-N,N-dimethylpropan-2-amine, 1-[(11Z,14Z)-icosa-11,14-dien-1-yloxy]-N,N-dimethyl-3-(octyloxy)propan-2-amine, 1-[(13Z,16Z)-docosa-13,16-dien-1-yloxy]-N,N-dimethyl-3-(octyloxy)propan-2-amine, (2S)-1-[(13Z,16Z)-docosa-13,16-dien-1-yloxy]-3-(hexyloxy)-N,N-dimethylpropan-2-amine, (2S)-1-[(13Z)-docos-13-en-1-yloxy]-3-(hexyloxy)-N,N-dimethylpropan-2-amine, 1-[(13Z)-docos-13-en-1-yloxy]-N,N-dimethyl-3-(octyloxy)propan-2-amine, 1-[(9Z)-hexadec-9-en-1-yloxy]-N,N-dimethyl-3-(octyloxy)propan-2-amine, (2R)—N,N-dimethyl-H(1-metoyloctyl)oxy]-3-[(9Z,12Z)-octadeca-9,12-dien-1-yloxy]propan-2-amine, (2R)-1-[(3,7-dimethyloctyl)oxy]-N,N-dimethyl-3-[(9Z,12Z)-octadeca-9,12-dien-1-yloxy]propan-2-amine, N,N-dimethyl-1-(octyloxy)-3-({8-[(1S,2S)-2-{[(1R,2R)-2-pentylcyclopropyl]methyl cyclopropyl]octyl}oxy)propan-2-amine, N,N-dimethyl-1-{[8-(2-oclylcyclopropyl)octyl]oxy}-3-(octyloxy)propan-2-amine and (11E,20Z,23Z)—N,N-dimethylnonacosa-11,20,2-trien-10-amine or a pharmaceutically acceptable salt or stereoisomer thereof.

In one embodiment, the lipid may be a cleavable lipid such as those described in International Publication No. WO2012170889, herein incorporated by reference in its entirety.

In another embodiment, the lipid may be a cationic lipid such as, but not limited to, Formula (I) of U.S. Patent Application No. US20130064894, the contents of which are herein incorporated by reference in its entirety.

In one embodiment, the cationic lipid may be synthesized by methods known in the art and/or as described in International Publication Nos. WO2012040184, WO2011153120, WO2011149733, WO2011090965, WO2011043913, WO2011022460, WO2012061259, WO2012054365, WO2012044638, WO2010080724, WO201021865, WO2013086373 and WO2013086354; the contents of each of which are herein incorporated by reference in their entirety.

In another embodiment, the cationic lipid may be a trialkyl cationic lipid. Non-limiting examples of trialkyl cationic lipids and methods of making and using the trialkyl cationic lipids are described in International Patent Publication No. WO2013126803, the contents of which are herein incorporated by reference in its entirety.

In one embodiment, the LNP formulations of the polynucleotides may contain PEG-c-DOMG at 3% lipid molar ratio. In another embodiment, the LNP formulations polynucleotides may contain PEG-c-DOMG at 1.5% lipid molar ratio.

In one embodiment, the pharmaceutical compositions of the polynucleotides may include at least one of the PEGylated lipids described in International Publication No. WO2012099755, herein incorporated by reference.

In one embodiment, the LNP formulation may contain PEG-DMG 2000 (1,2-dimyristoyl-sn-glycero-3-phophoethanolamine-N-[methoxy(polyethylene glycol)-2000). In one embodiment, the LNP formulation may contain PEG-DMG 2000, a cationic lipid known in the art and at least one other component. In another embodiment, the LNP formulation may contain PEG-DMG 2000, a cationic lipid known in the art, DSPC and cholesterol. As a non-limiting example, the LNP formulation may contain PEG-DMG 2000, DLin-DMA, DSPC and cholesterol. As another non-limiting example the LNP formulation may contain PEG-DMG 2000, DLin-DMA, DSPC and cholesterol in a molar ratio of 2:40:10:48 (see e.g., Geall et al., Nonviral delivery of self-amplifying RNA vaccines, PNAS 2012; PMID: 22908294; herein incorporated by reference in its entirety).

In one embodiment, the LNP formulation may be formulated by the methods described in International Publication Nos. WO2011127255 or WO2008103276, the contents of each of which is herein incorporated by reference in their entirety. As a non-limiting example, the polynucleotides described herein may be encapsulated in LNP formulations as described in WO2011127255 and/or WO2008103276; each of which is herein incorporated by reference in their entirety.

In one embodiment, the polynucleotides described herein may be formulated in a nanoparticle to be delivered by a parenteral route as described in U.S. Pub. No. US20120207845; the contents of which are herein incorporated by reference in its entirety.

In one embodiment, the polynucleotides may be formulated in a lipid nanoparticle made by the methods described in US Patent Publication No US20130156845 or International Publication No WO2013093648 or WO2012024526, each of which is herein incorporated by reference in its entirety.

The lipid nanoparticles described herein may be made in a sterile environment by the system and/or methods described in US Patent Publication No. US20130164400, herein incorporated by reference in its entirety.

In one embodiment, the LNP formulation may be formulated in a nanoparticle such as a nucleic acid-lipid particle described in U.S. Pat. No. 8,492,359, the contents of which are herein incorporated by reference in its entirety. As a non-limiting example, the lipid particle may comprise one or more active agents or therapeutic agents; one or more cationic lipids comprising from about 50 mol % to about 85 mol % of the total lipid present in the particle; one or more non-cationic lipids comprising from about 13 mol % to about 49.5 mol % of the total lipid present in the particle; and one or more conjugated lipids that inhibit aggregation of particles comprising from about 0.5 mol % to about 2 mol % of the total lipid present in the particle. The nucleic acid in the nanoparticle may be the polynucleotides described herein and/or are known in the art.

In one embodiment, the LNP formulation may be formulated by the methods described in International Publication Nos. WO2011127255 or WO2008103276, the contents of each of which are herein incorporated by reference in their entirety. As a non-limiting example, modified RNA described herein may be encapsulated in LNP formulations as described in WO2011127255 and/or WO2008103276; the contents of each of which are herein incorporated by reference in their entirety.

In one embodiment, LNP formulations described herein may comprise a polycationic composition. As a non-limiting example, the polycationic composition may be selected from formula 1-60 of US Patent Publication No. US20050222064; the content of which is herein incorporated by reference in its entirety. In another embodiment, the LNP formulations comprising a polycationic composition may be used for the delivery of the modified RNA described herein in vivo and/or in vitro.

In one embodiment, the LNP formulations described herein may additionally comprise a permeability enhancer molecule. Non-limiting permeability enhancer molecules are described in US Patent Publication No. US20050222064; the content of which is herein incorporated by reference in its entirety.

In one embodiment, the pharmaceutical compositions may be formulated in liposomes such as, but not limited to, DiLa2 liposomes (Marina Biotech, Bothell, Wash.), SMARTICLES® (Marina Biotech, Bothell, Wash.), neutral DOPC (1,2-dioleoyl-sn-glycero-3-phosphocholine) based liposomes (e.g., siRNA delivery for ovarian cancer (Landen et al. Cancer Biology & Therapy 2006 5(12)1708-1713); herein incorporated by reference in its entirety) and hyaluronan-coated liposomes (Quiet Therapeutics, Israel).

In one embodiment, the polynucleotides may be formulated in a lyophilized gel-phase liposomal composition as described in US Publication No. US2012060293, herein incorporated by reference in its entirety.

The nanoparticle formulations may be a carbohydrate nanoparticle comprising a carbohydrate carrier and a polynucleotide. As a non-limiting example, the carbohydrate carrier may include, but is not limited to, an anhydride-modified phytoglycogen or glycogen-type material, phtoglycogen octenyl succinate, phytoglycogen beta-dextrin, anhydride-modified phytoglycogen beta-dextrin. (See e.g., International Publication No. WO2012109121; the contents of which are herein incorporated by reference in its entirety).

Nanoparticle formulations of the present invention may be coated with a surfactant or polymer in order to improve the delivery of the particle. In one embodiment, the nanoparticle may be coated with a hydrophilic coating such as, but not limited to, PEG coatings and/or coatings that have a neutral surface charge. The hydrophilic coatings may help to deliver nanoparticles with larger payloads such as, but not limited to, polynucleotides within the central nervous system. As a non-limiting example nanoparticles comprising a hydrophilic coating and methods of making such nanoparticles are described in US Patent Publication No. US20130183244, the contents of which are herein incorporated by reference in its entirety.

In one embodiment, the lipid nanoparticles of the present invention may be hydrophilic polymer particles. Non-limiting examples of hydrophilic polymer particles and methods of making hydrophilic polymer particles are described in US Patent Publication No. US20130210991, the contents of which are herein incorporated by reference in its entirety.

In another embodiment, the lipid nanoparticles of the present invention may be hydrophobic polymer particles.

Lipid nanoparticle formulations may be improved by replacing the cationic lipid with a biodegradable cationic lipid which is known as a rapidly eliminated lipid nanoparticle (reLNP). Ionizable cationic lipids, such as, but not limited to, DLinDMA, DLin-KC2-DMA, and DLin-MC3-DMA, have been shown to accumulate in plasma and tissues over time and may be a potential source of toxicity. The rapid metabolism of the rapidly eliminated lipids can improve the tolerability and therapeutic index of the lipid nanoparticles by an order of magnitude from a 1 mg/kg dose to a 10 mg/kg dose in rat. Inclusion of an enzymatically degraded ester linkage can improve the degradation and metabolism profile of the cationic component, while still maintaining the activity of the reLNP formulation. The ester linkage can be internally located within the lipid chain or it may be terminally located at the terminal end of the lipid chain. The internal ester linkage may replace any carbon in the lipid chain.

In one embodiment, the internal ester linkage may be located on either side of the saturated carbon.

In one embodiment, an immune response may be elicited by delivering a lipid nanoparticle which may include a nanospecies, a polymer and an immunogen. (U.S. Publication No. 20120189700 and International Publication No. WO2012099805; each of which is herein incorporated by reference in their entirety). The polymer may encapsulate the nanospecies or partially encapsulate the nanospecies. The immunogen may be a recombinant protein, a modified RNA and/or a polynucleotide described herein. In one embodiment, the lipid nanoparticle may be formulated for use in a vaccine such as, but not limited to, against a pathogen.

Lipid nanoparticles may be engineered to alter the surface properties of particles so the lipid nanoparticles may penetrate the mucosal barrier. Lipid nanoparticles to penetrate the mucosal barrier and areas where mucus is located is described in International Patent Application No. PCT/US2014/027077, the contents of which is herein incorporated by reference in its entirety, for example in paragraphs [000491]-[000501].

In one embodiment, the polynucleotide is formulated as a lipoplex, such as, without limitation, the ATUPLEX™ system, the DACC system, the DBTC system and other siRNA-lipoplex technology from Silence Therapeutics (London, United Kingdom), STEMFECT™ from STEMGENT® (Cambridge, Mass.), and polyethylenimine (PEI) or protamine-based targeted and non-targeted delivery of nucleic acids acids (Aleku et al. Cancer Res. 2008 68:9788-9798; Strumberg et al. Int J Clin Pharmacol Ther 2012 50:76-78; Santel et al., Gene Ther 2006 13:1222-1234; Santel et al., Gene Ther 2006 13:1360-1370; Gutbier et al., Pulm Pharmacol. Ther. 2010 23:334-344; Kaufmann et al. Microvasc Res 2010 80:286-293 Weide et al. J Immunother. 2009 32:498-507; Weide et al. J Immunother. 2008 31:180-188; Pascolo Expert Opin. Biol. Ther. 4:1285-1294; Fotin-Mleczek et al., 2011 J. Immunother. 34:1-15; Song et al., Nature Biotechnol. 2005, 23:709-717; Peer et al., Proc Natl Acad Sci USA. 2007 6; 104:4095-4100; deFougerolles Hum Gene Ther. 2008 19:125-132; all of which are incorporated herein by reference in its entirety).

In one embodiment such formulations may also be constructed or compositions altered such that they passively or actively are directed to different cell types in vivo, including but not limited to hepatocytes, immune cells, tumor cells, endothelial cells, antigen presenting cells, and leukocytes (Akinc et al. Mol Ther. 2010 18:1357-1364; Song et al., Nat Biotechnol. 2005 23:709-717; Judge et al., J Clin Invest. 2009 119:661-673; Kaufmann et al., Microvasc Res 2010 80:286-293; Santel et al., Gene Ther 2006 13:1222-1234; Santel et al., Gene Ther 2006 13:1360-1370; Gutbier et al., Pulm Pharmacol. Ther. 2010 23:334-344; Basha et al., Mol. Ther. 2011 19:2186-2200; Fenske and Cullis, Expert Opin Drug Deliv. 2008 5:25-44; Peer et al., Science. 2008 319: 627-630; Peer and Lieberman, Gene Ther. 2011 18:1127-1133; all of which are incorporated herein by reference in its entirety). One example of passive targeting of formulations to liver cells includes the DLin-DMA, DLin-KC2-DMA and DLin-MC3-DMA-based lipid nanoparticle formulations which have been shown to bind to apolipoprotein E and promote binding and uptake of these formulations into hepatocytes in vivo (Akinc et al. Mol Ther. 2010 18:1357-1364; herein incorporated by reference in its entirety). Formulations can also be selectively targeted through expression of different ligands on their surface as exemplified by, but not limited by, folate, transferrin, N-acetylgalactosamine (GalNAc), and antibody targeted approaches (Kolhatkar et al., Curr Drug Discov Technol. 2011 8:197-206; Musacchio and Torchilin, Front Biosci. 2011 16:1388-1412; Yu et al., Mol Membr Biol. 2010 27:286-298; Patil et al., Crit Rev Ther Drug Carrier Syst. 2008 25:1-61; Benoit et al., Biomacromolecules. 2011 12:2708-2714; Zhao et al., Expert Opin Drug Deliv. 2008 5:309-319; Akinc et al., Mol Ther. 2010 18:1357-1364; Srinivasan et al., Methods Mol Biol. 2012 820:105-116; Ben-Arie et al., Methods Mol Biol. 2012 757:497-507; Peer 2010 J Control Release. 20:63-68; Peer et al., Proc Natl Acad Sci USA. 2007 104:4095-4100; Kim et al., Methods Mol Biol. 2011 721:339-353; Subramanya et al., Mol Ther. 2010 18:2028-2037; Song et al., Nat Biotechnol. 2005 23:709-717; Peer et al., Science. 2008 319:627-630; Peer and Lieberman, Gene Ther. 2011 18:1127-1133; all of which are incorporated herein by reference in its entirety).

In one embodiment, the polynucleotide is formulated as a solid lipid nanoparticle. A solid lipid nanoparticle (SLN) may be spherical with an average diameter between 10 to 1000 nm. SLN possess a solid lipid core matrix that can solubilize lipophilic molecules and may be stabilized with surfactants and/or emulsifiers. In a further embodiment, the lipid nanoparticle may be a self-assembly lipid-polymer nanoparticle (see Zhang et al., ACS Nano, 2008, 2 (8), pp 1696-1702; the contents of which are herein incorporated by reference in its entirety). As a non-limiting example, the SLN may be the SLN described in International Patent Publication No. WO2013105101, the contents of which are herein incorporated by reference in its entirety. As another non-limiting example, the SLN may be made by the methods or processes described in International Patent Publication No. WO2013105101, the contents of which are herein incorporated by reference in its entirety.

Liposomes, lipoplexes, or lipid nanoparticles may be used to improve the efficacy of polynucleotides directed protein production as these formulations may be able to increase cell transfection by the polynucleotide; and/or increase the translation of encoded protein. One such example involves the use of lipid encapsulation to enable the effective systemic delivery of polyplex plasmid DNA (Heyes et al., Mol Ther. 2007 15:713-720; herein incorporated by reference in its entirety). The liposomes, lipoplexes, or lipid nanoparticles may also be used to increase the stability of the polynucleotide.

In one embodiment, the polynucleotides of the present invention can be formulated for controlled release and/or targeted delivery. As used herein, "controlled release" refers to a pharmaceutical composition or compound release profile that conforms to a particular pattern of release to effect a therapeutic outcome. In one embodiment, the polynucleotides may be encapsulated into a delivery agent described herein and/or known in the art for controlled release and/or targeted delivery. As used herein, the term "encapsulate" means to enclose, surround or encase. As it relates to the formulation of the compounds of the invention, encapsulation may be substantial, complete or partial. The term "substantially encapsulated" means that at least greater than 50, 60, 70, 80, 85, 90, 95, 96, 97, 98, 99, 99.9, 99.9 or greater than 99.999% of the pharmaceutical composition or compound of the invention may be enclosed, surrounded or encased within the delivery agent. "Partially encapsulation" means that less than 10, 10, 20, 30, 40 50 or less of the pharmaceutical composition or compound of the invention may be enclosed, surrounded or encased within the delivery agent. Advantageously, encapsulation may be determined by measuring the escape or the activity of the pharmaceutical composition or compound of the invention using fluorescence and/or electron micrograph. For example, at least 1, 5, 10, 20, 30, 40, 50, 60, 70, 80, 85, 90, 95, 96, 97, 98, 99, 99.9, 99.99 or greater than 99.99% of the pharmaceutical composition or compound of the invention are encapsulated in the delivery agent.

In one embodiment, the controlled release formulation may include, but is not limited to, tri-block co-polymers. As a non-limiting example, the formulation may include two different types of tri-block co-polymers (International Pub. No. WO2012131104 and WO2012131106; each of which is herein incorporated by reference in its entirety).

In another embodiment, the polynucleotides may be encapsulated into a lipid nanoparticle or a rapidly eliminated lipid nanoparticle and the lipid nanoparticles or a rapidly eliminated lipid nanoparticle may then be encapsulated into a polymer, hydrogel and/or surgical sealant described herein and/or known in the art. As a non-limiting example, the polymer, hydrogel or surgical sealant may be PLGA, ethylene vinyl acetate (EVAc), poloxamer, GELSITE® (Nanotherapeutics, Inc. Alachua, Fla.), HYLENEX® (Halozyme Therapeutics, San Diego Calif.), surgical sealants such as fibrinogen polymers (Ethicon Inc. Cornelia, Ga.), TIS-SELL® (Baxter International, Inc Deerfield, Ill.), PEG-based sealants, and COSEAL® (Baxter International, Inc Deerfield, Ill.).

In another embodiment, the lipid nanoparticle may be encapsulated into any polymer known in the art which may form a gel when injected into a subject. As another non-limiting example, the lipid nanoparticle may be encapsulated into a polymer matrix which may be biodegradable.

In one embodiment, the polynucleotide formulation for controlled release and/or targeted delivery may also include at least one controlled release coating. Controlled release coatings include, but are not limited to, OPADRY®, polyvinylpyrrolidone/vinyl acetate copolymer, polyvinylpyrrolidone, hydroxypropyl methylcellulose, hydroxypropyl cellulose, hydroxyethyl cellulose, EUDRAGIT RL®, EUDRAGIT RS® and cellulose derivatives such as ethylcellulose aqueous dispersions (AQUACOAT® and SURELEASE®). Controlled release and/or targeted delivery formulations are described in International Patent Application No. PCT/US2014/027077, the contents of which are herein incorporated by reference in its entirety, and non-limiting examples of the formulations are in paragraphs [000515]-[000519].

In one embodiment, the polynucleotides of the present invention may be encapsulated in a therapeutic nanoparticle including ACCURINS™. Therapeutic nanoparticles may be formulated by methods described herein and known in the art such as, but not limited to, in International Patent Application No. PCT/US2014/027077, the contents of which are herein incorporated by reference in its entirety, such as in paragraphs [000519]-[000551]. As one example, the therapeutic nanoparticle may be a sustained release nanoparticle such as those described in International Patent Application No. PCT/US2014/027077, the contents of which are herein incorporated by reference in its entirety, such as in paragraphs [000531]-[000533].

In one embodiment, the nanoparticles of the present invention may comprise a polymeric matrix. As a non-limiting example, the nanoparticle may comprise two or more polymers such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polylysine, poly(ethylene imine), poly(serine ester), poly(L-lactide-co-L-lysine), poly(4-hydroxy-L-proline ester) or combinations thereof.

In one embodiment, the therapeutic nanoparticle comprises a diblock copolymer. In one embodiment, the diblock copolymer may include PEG in combination with a polymer such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polylysine, poly(ethylene imine), poly(serine ester), poly(L-lactide-co-L-lysine), poly(4-hydroxy-L-proline ester) or combinations thereof. In another embodiment, the diblock copolymer may comprise the diblock copolymers described in European Patent Publication No. the contents of which are herein incorporated by reference in its entirety. In yet another embodiment, the diblock copolymer may be a high-X diblock copolymer such as those described in International Patent Publication No. WO2013120052, the contents of which are herein incorporated by reference in its entirety.

In yet another non-limiting example, the lipid nanoparticle comprises the block copolymer PEG-PLGA-PEG (see e.g., the thermosensitive hydrogel (PEG-PLGA-PEG) was used as a TGF-beta1 gene delivery vehicle in Lee et al. Thermosensitive Hydrogel as a Tgf-β1 Gene Delivery Vehicle Enhances Diabetic Wound Healing. Pharmaceutical Research, 2003 20(12): 1995-2000; as a controlled gene delivery system in Li et al. Controlled Gene Delivery System Based on Thermosensitive Biodegradable Hydrogel. Pharmaceutical Research 2003 20(6):884-888; and Chang et al., Non-ionic amphiphilic biodegradable PEG-PLGA-PEG copolymer enhances gene delivery efficiency in rat skeletal muscle. J Controlled Release. 2007 118:245-253; each of which is herein incorporated by reference in its entirety). The polynucleotides of the present invention may be formulated in lipid nanoparticles comprising the PEG-PLGA-PEG block copolymer.

In one embodiment, the polynucleotides of the present invention may be encapsulated in a synthetic nanocarrier. Synthetic nanocarriers may be formulated by methods described herein and known in the art such as, but not limited to, in International Patent Application No. PCT/US2014/027077, the contents of which are herein incorporated by reference in its entirety, such as in paragraphs [000552]-[000563].

In one embodiment, the polynucleotides may be encapsulated in, linked to and/or associated with zwitterionic lipids. Non-limiting examples of zwitterionic lipids and methods of using zwitterionic lipids are described in US Patent Publication No. US20130216607, the contents of which are herein incorporated by reference in its entirety. In one aspect, the zwitterionic lipids may be used in the liposomes and lipid nanoparticles described herein.

In one embodiment, the polynucleotides may be formulated in colloid nanocarriers as described in US Patent Publication No. US20130197100, the contents of which are herein incorporated by reference in its entirety.

In one embodiment, the nanoparticle may be optimized for oral administration. The nanoparticle may comprise at least one cationic biopolymer such as, but not limited to, chitosan or a derivative thereof. As a non-limiting example, the nanoparticle may be formulated by the methods described in U.S. Pub. No. 20120282343; herein incorporated by reference in its entirety.

In some embodiments, LNPs comprise the lipid KL52 (an amino-lipid disclosed in U.S. Application Publication No. 2012/0295832 expressly incorporated herein by reference in its entirety). Activity and/or safety (as measured by examining one or more of ALT/AST, white blood cell count and cytokine induction) of LNP administration may be improved by incorporation of such lipids. LNPs comprising KL52 may be administered intravenously and/or in one or more doses. In some embodiments, administration of LNPs comprising KL52 results in equal or improved mRNA and/or protein expression as compared to LNPs comprising MC3.

In some embodiments, polynucleotides may be delivered using smaller LNPs. Such particles may comprise a diameter from below 0.1 um up to 100 nm such as, but not limited to, less than 0.1 um, less than 1.0 um, less than 5 um, less than 10 um, less than 15 um, less than 20 um, less than 25 um, less than 30 um, less than 35 um, less than 40 um, less than 50 um, less than 55 um, less than 60 um, less than 65 um, less than 70 um, less than 75 um, less than 80 um, less than 85 um, less than 90 um, less than 95 um, less than 100 um, less than 125 um, less than 150 um, less than 175 um, less than 200 um, less than 225 um, less than 250 um, less than 275 um, less than 300 um, less than 325 um, less than 350 um, less than 375 um, less than 400 um, less than 425 um, less than 450 um, less than 475 um, less than 500 um, less than 525 um, less than 550 um, less than 575 um, less than 600 um, less than 625 um, less than 650 um, less than 675 um, less than 700 um, less than 725 um, less than 750 um, less than 775 um, less than 800 um, less than 825 um, less than 850 um, less than 875 um, less than 900 um, less than 925 um, less than 950 um, less than 975 um, In another embodiment, polynucleotides may be delivered using smaller LNPs which may comprise a diameter from about 1 nm to about 100 nm, from about 1 nm to about 10 nm, about 1 nm to about 20 nm, from about 1 nm to about 30 nm, from about 1 nm to about 40 nm, from about 1 nm to about 50 nm, from about 1 nm to about 60 nm, from about 1 nm to about 70 nm, from about 1 nm to about 80 nm, from about 1 nm to about 90 nm, from about 5 nm to about from 100 nm, from about 5 nm to about 10 nm, about 5 nm to about 20 nm, from about 5 nm to about 30 nm, from about 5 nm to about 40 nm, from about 5 nm to about 50 nm, from about 5 nm to about 60 nm, from about 5 nm to about 70 nm, from about 5 nm to about 80 nm, from about 5 nm to about 90 nm, about 10 to about 50 nM, from about 20 to about 50 nm, from about 30 to about 50 nm, from about 40 to about 50 nm, from about 20 to about 60 nm, from about 30 to about 60 nm, from about 40 to about 60 nm, from about 20 to about 70 nm, from about 30 to about 70 nm, from about 40 to about 70 nm, from about 50 to about 70 nm, from about 60 to about 70 nm, from about 20 to about 80 nm, from about 30 to about 80 nm, from about 40 to about 80 nm, from about 50 to about 80 nm, from about 60 to about 80 nm, from about 20 to about 90 nm, from about 30 to about 90 nm, from about 40 to about 90 nm, from about 50 to about 90 nm, from about 60 to about 90 nm and/or from about 70 to about 90 nm.

In some embodiments, such LNPs are synthesized using methods comprising microfluidic mixers. Exemplary microfluidic mixers may include, but are not limited to a slit interdigitial micromixer including, but not limited to those manufactured by Microinnova (Allerheiligen bei Wildon, Austria) and/or a staggered herringbone micromixer (SHM) (Zhigaltsev, I. V. et al., Bottom-up design and synthesis of limit size lipid nanoparticle systems with aqueous and triglyceride cores using millisecond microfluidic mixing have been published (Langmuir. 2012. 28:3633-40; Belliveau, N. M. et al., Microfluidic synthesis of highly potent limit-size lipid nanoparticles for in vivo delivery of siRNA. Molecular Therapy-Nucleic Acids. 2012. 1:e37; Chen, D. et al., Rapid discovery of potent siRNA-containing lipid nanoparticles enabled by controlled microfluidic formulation. J Am Chem Soc. 2012. 134(16):6948-51; each of which is herein incorporated by reference in its entirety). In some embodiments, methods of LNP generation comprising SHM, further comprise the mixing of at least two input streams wherein mixing occurs by microstructure-induced chaotic advection (MICA). According to this method, fluid streams flow through channels present in a herringbone pattern causing rotational flow and folding the fluids around each other. This method may also comprise a surface for fluid mixing wherein the surface changes orientations during fluid cycling. Methods of generating LNPs using SHM include those disclosed in U.S. Application Publication Nos. 2004/0262223 and 2012/0276209, each of which is expressly incorporated herein by reference in their entirety.

In one embodiment, the polynucleotides of the present invention may be formulated in lipid nanoparticles created using a micromixer such as, but not limited to, a Slit Interdigital Microstructured Mixer (SIMM-V2) or a Standard Slit Interdigital Micro Mixer (SSIMM) or Caterpillar (CPMM) or Impinging-jet (IJMM) from the Institut für Mikrotechnik Mainz GmbH, Mainz Germany).

In one embodiment, the polynucleotides of the present invention may be formulated in lipid nanoparticles created using microfluidic technology (see Whitesides, George M. The Origins and the Future of Microfluidics. Nature, 2006 442: 368-373; and Abraham et al. Chaotic Mixer for Microchannels. Science, 2002 295: 647-651; each of which is herein incorporated by reference in its entirety). As a non-limiting example, controlled microfluidic formulation includes a passive method for mixing streams of steady pressure-driven flows in micro channels at a low Reynolds number (See e.g., Abraham et al. Chaotic Mixer for Microchannels. Science, 2002 295: 647-651; which is herein incorporated by reference in its entirety).

In one embodiment, the polynucleotides of the present invention may be formulated in lipid nanoparticles created using a micromixer chip such as, but not limited to, those from Harvard Apparatus (Holliston, Mass.) or Dolomite Microfluidics (Royston, UK). A micromixer chip can be used for rapid mixing of two or more fluid streams with a split and recombine mechanism.

In one embodiment, the polynucleotides of the invention may be formulated for delivery using the drug encapsulating microspheres described in International Patent Publication No. WO2013063468 or U.S. Pat. No. 8,440,614, each of which is herein incorporated by reference in its entirety. The microspheres may comprise a compound of the formula (I), (II), (III), (IV), (V) or (VI) as described in International patent application No. WO2013063468, the contents of which are herein incorporated by reference in its entirety. In another aspect, the amino acid, peptide, polypeptide, lipids (APPL) are useful in delivering the polynucleotides of the invention to cells (see International Patent Publication No. WO2013063468, herein incorporated by reference in its entirety).

In one embodiment, the polynucleotides of the invention may be formulated in lipid nanoparticles having a diameter from about 10 to about 100 nm such as, but not limited to, about 10 to about 20 nm, about 10 to about 30 nm, about 10 to about 40 nm, about 10 to about 50 nm, about 10 to about 60 nm, about 10 to about 70 nm, about 10 to about 80 nm, about 10 to about 90 nm, about 20 to about 30 nm, about 20 to about 40 nm, about 20 to about 50 nm, about 20 to about 60 nm, about 20 to about 70 nm, about 20 to about 80 nm, about 20 to about 90 nm, about 20 to about 100 nm, about 30 to about 40 nm, about 30 to about 50 nm, about 30 to about 60 nm, about 30 to about 70 nm, about 30 to about 80 nm, about 30 to about 90 nm, about 30 to about 100 nm, about 40 to about 50 nm, about 40 to about 60 nm, about 40 to about 70 nm, about 40 to about 80 nm, about 40 to about 90 nm, about 40 to about 100 nm, about 50 to about 60 nm, about 50 to about 70 nm about 50 to about 80 nm, about 50 to about 90 nm, about 50 to about 100 nm, about 60 to about 70 nm, about 60 to about 80 nm, about 60 to about 90 nm, about 60 to about 100 nm, about 70 to about 80 nm, about 70 to about 90 nm, about 70 to about 100 nm, about 80 to about 90 nm, about 80 to about 100 nm and/or about 90 to about 100 nm.

In one embodiment, the lipid nanoparticles may have a diameter from about 10 to 500 nm.

In one embodiment, the lipid nanoparticle may have a diameter greater than 100 nm, greater than 150 nm, greater than 200 nm, greater than 250 nm, greater than 300 nm, greater than 350 nm, greater than 400 nm, greater than 450 nm, greater than 500 nm, greater than 550 nm, greater than 600 nm, greater than 650 nm, greater than 700 nm, greater than 750 nm, greater than 800 nm, greater than 850 nm, greater than 900 nm, greater than 950 nm or greater than 1000 nm.

In one aspect, the lipid nanoparticle may be a limit size lipid nanoparticle described in International Patent Publication No. WO2013059922, the contents of which are herein incorporated by reference in its entirety. The limit size lipid nanoparticle may comprise a lipid bilayer surrounding an aqueous core or a hydrophobic core; where the lipid bilayer may comprise a phospholipid such as, but not limited to, diacylphosphatidylcholine, a diacylphosphatidylethanolamine, a ceramide, a sphingomyelin, a dihydrosphingomyelin, a cephalin, a cerebroside, a C8-C20 fatty acid diacylphophatidylcholine, and 1-palmitoyl-2-oleoyl phosphatidylcholine (POPC). In another aspect the limit size lipid nanoparticle may comprise a polyethylene glycol-lipid such as, but not limited to, DLPE-PEG, DMPE-PEG, DPPC-PEG and DSPE-PEG.

In one embodiment, the polynucleotides may be delivered, localized and/or concentrated in a specific location using the delivery methods described in International Patent Publication No. WO2013063530, the contents of which are herein incorporated by reference in its entirety. As a non-limiting example, a subject may be administered an empty polymeric particle prior to, simultaneously with or after delivering the polynucleotides to the subject. The empty polymeric particle undergoes a change in volume once in contact with the subject and becomes lodged, embedded, immobilized or entrapped at a specific location in the subject.

In one embodiment, the polynucleotides may be formulated in an active substance release system (See e.g., US Patent Publication No. US20130102545, herein incorporated by reference in its entirety). The active substance release system may comprise 1) at least one nanoparticle bonded to an oligonucleotide inhibitor strand which is hybridized with a catalytically active nucleic acid and 2) a compound bonded to at least one substrate molecule bonded to a therapeutically active substance (e.g., polynucleotides described herein), where the therapeutically active substance is released by the cleavage of the substrate molecule by the catalytically active nucleic acid.

In one embodiment, the polynucleotides may be formulated in a nanoparticle comprising an inner core comprising a non-cellular material and an outer surface comprising a cellular membrane. The cellular membrane may be derived from a cell or a membrane derived from a virus. As a non-limiting example, the nanoparticle may be made by the methods described in International Patent Publication No. WO2013052167, herein incorporated by reference in its entirety. As another non-limiting example, the nanoparticle described in International Patent Publication No. WO2013052167, herein incorporated by reference in its entirety, may be used to deliver the polynucleotides described herein.

In one embodiment, the polynucleotides may be formulated in porous nanoparticle-supported lipid bilayers (protocells). Protocells are described in International Patent Publication No. WO2013056132, the contents of which are herein incorporated by reference in its entirety.

In one embodiment, the polynucleotides described herein may be formulated in polymeric nanoparticles as described in or made by the methods described in U.S. Pat. Nos. 8,420,123 and 8,518,963 and European Patent No. EP2073848B1, the contents of each of which are herein incorporated by reference in their entirety. As a non-limiting example, the polymeric nanoparticle may have a high glass transition temperature such as the nanoparticles described in or nanoparticles made by the methods described in U.S. Pat. No. 8,518,963, the contents of which are herein incorporated by reference in its entirety. As another non-limiting example, the polymer nanoparticle for oral, parenteral and topical formulations may be made by the methods described in European Patent No. EP2073848B1, the contents of which are herein incorporated by reference in its entirety.

In another embodiment, the polynucleotides described herein may be formulated in nanoparticles used in imaging. The nanoparticles may be liposome nanoparticles such as those described in US Patent Publication No US20130129636, herein incorporated by reference in its entirety. As a non-limiting example, the liposome may comprise gadolinium(III)2-{4,7-bis-carboxymethyl-10-[(N, N-distearylamidomethyl-N'-amido-methyl]-1,4,7,10-tetra-azacyclododec-1-yl}-acetic acid and a neutral, fully saturated phospholipid component (see e.g., US Patent Publication No US20130129636, the contents of which is herein incorporated by reference in its entirety).

In one embodiment, the nanoparticles which may be used in the present invention are formed by the methods described in U.S. Patent Application No. US20130130348, the contents of which is herein incorporated by reference in its entirety.

The nanoparticles of the present invention may further include nutrients such as, but not limited to, those which deficiencies can lead to health hazards from anemia to neural tube defects (see e.g, the nanoparticles described in International Patent Publication No WO2013072929, the contents of which is herein incorporated by reference in its entirety). As a non-limiting example, the nutrient may be iron in the form of ferrous, ferric salts or elemental iron, iodine, folic acid, vitamins or micronutrients.

In one embodiment, the polynucleotides of the present invention may be formulated in a swellable nanoparticle. The swellable nanoparticle may be, but is not limited to, those described in U.S. Pat. No. 8,440,231, the contents of which is herein incorporated by reference in its entirety. As a non-limiting embodiment, the swellable nanoparticle may be used for delivery of the polynucleotides of the present invention to the pulmonary system (see e.g., U.S. Pat. No. 8,440,231, the contents of which is herein incorporated by reference in its entirety).

The polynucleotides of the present invention may be formulated in polyanhydride nanoparticles such as, but not limited to, those described in U.S. Pat. No. 8,449,916, the contents of which is herein incorporated by reference in its entirety.

The nanoparticles and microparticles of the present invention may be geometrically engineered to modulate macrophage and/or the immune response. In one aspect, the geometrically engineered particles may have varied shapes, sizes and/or surface charges in order to incorporated the polynucleotides of the present invention for targeted delivery such as, but not limited to, pulmonary delivery (see e.g., International Publication No WO2013082111, the contents of which are herein incorporated by reference in its entirety). Other physical features the geometrically engineering particles may have include, but are not limited to, fenestrations, angled arms, asymmetry and surface roughness, charge which can alter the interactions with cells and tissues. As a non-limiting example, nanoparticles of the present invention may be made by the methods described in International Publication No WO2013082111, the contents of which is herein incorporated by reference in its entirety.

In one embodiment, the nanoparticles of the present invention may be water soluble nanoparticles such as, but not limited to, those described in International Publication No. WO2013090601, the contents of which is herein incorporated by reference in its entirety. The nanoparticles may be inorganic nanoparticles which have a compact and zwitterionic ligand in order to exhibit good water solubility. The nanoparticles may also have small hydrodynamic diameters (HD), stability with respect to time, pH, and salinity and a low level of non-specific protein binding.

In one embodiment the nanoparticles of the present invention may be developed by the methods described in US Patent Publication No. US20130172406, the contents of which are herein incorporated by reference in its entirety.

In one embodiment, the nanoparticles of the present invention are stealth nanoparticles or target-specific stealth nanoparticles such as, but not limited to, those described in US Patent Publication No. US20130172406; the contents of which is herein incorporated by reference in its entirety. The nanoparticles of the present invention may be made by the methods described in US Patent Publication No.

US20130172406, the contents of which are herein incorporated by reference in its entirety.

In another embodiment, the stealth or target-specific stealth nanoparticles may comprise a polymeric matrix. The polymeric matrix may comprise two or more polymers such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polyesters, polyanhydrides, polyethers, polyurethanes, polymethacrylates, polyacrylates, polycyanoacrylates or combinations thereof.

In one embodiment, the nanoparticle may be a nanoparticle-nucleic acid hybrid structure having a high density nucleic acid layer. As a non-limiting example, the nanoparticle-nucleic acid hybrid structure may made by the methods described in US Patent Publication No. US20130171646, the contents of which are herein incorporated by reference in its entirety. The nanoparticle may comprise a nucleic acid such as, but not limited to, polynucleotides described herein and/or known in the art.

At least one of the nanoparticles of the present invention may be embedded in in the core a nanostructure or coated with a low density porous 3-D structure or coating which is capable of carrying or associating with at least one payload within or on the surface of the nanostructure. Non-limiting examples of the nanostructures comprising at least one nanoparticle are described in International Patent Publication No. WO2013123523, the contents of which are herein incorporated by reference in its entirety.

Polymers, Biodegradable Nanoparticles, and Core-Shell Nanoparticles

The polynucleotides of the invention can be formulated using natural and/or synthetic polymers. Non-limiting examples of polymers which may be used for delivery include, but are not limited to, DYNAMIC POLYCONJUGATE® (Arrowhead Research Corp., Pasadena, Calif.) formulations from MIRUS® Bio (Madison, Wis.) and Roche Madison (Madison, Wis.), PHASERX™ polymer formulations such as, without limitation, SMARTT POLYMER TECHNOLOGY™ (PHASERX®, Seattle, Wash.), DMRI/DOPE, poloxamer, VAXFECTIN® adjuvant from Vical (San Diego, Calif.), chitosan, cyclodextrin from Calando Pharmaceuticals (Pasadena, Calif.), dendrimers and poly (lactic-co-glycolic acid) (PLGA) polymers. RONDEL™ (RNAi/Oligonucleotide Nanoparticle Delivery) polymers (Arrowhead Research Corporation, Pasadena, Calif.) and pH responsive co-block polymers such as, but not limited to, PHASERX® (Seattle, Wash.).

A non-limiting example of chitosan formulation includes a core of positively charged chitosan and an outer portion of negatively charged substrate (U.S. Pub. No. 20120258176; herein incorporated by reference in its entirety). Chitosan includes, but is not limited to N-trimethyl chitosan, mono-N-carboxymethyl chitosan (MCC), N-palmitoyl chitosan (NPCS), EDTA-chitosan, low molecular weight chitosan, chitosan derivatives, or combinations thereof.

In one embodiment, the polymers used in the present invention have undergone processing to reduce and/or inhibit the attachment of unwanted substances such as, but not limited to, bacteria, to the surface of the polymer. The polymer may be processed by methods known and/or described in the art and/or described in International Pub. No. WO2012150467, herein incorporated by reference in its entirety.

A non-limiting example of PLGA formulations include, but are not limited to, PLGA injectable depots (e.g., ELIGARD® which is formed by dissolving PLGA in 66% N-methyl-2-pyrrolidone (NMP) and the remainder being aqueous solvent and leuprolide. Once injected, the PLGA and leuprolide peptide precipitates into the subcutaneous space).

Many of these polymer approaches have demonstrated efficacy in delivering oligonucleotides in vivo into the cell cytoplasm (reviewed in deFougerolles Hum Gene Ther. 2008 19:125-132; herein incorporated by reference in its entirety). Two polymer approaches that have yielded robust in vivo delivery of nucleic acids, in this case with small interfering RNA (siRNA), are dynamic polyconjugates and cyclodextrin-based nanoparticles (see e.g., US Patent Publication No. US20130156721, herein incorporated by reference in its entirety). The first of these delivery approaches uses dynamic polyconjugates and has been shown in vivo in mice to effectively deliver siRNA and silence endogenous target mRNA in hepatocytes (Rozema et al., Proc Natl Acad Sci USA. 2007 104:12982-12887; herein incorporated by reference in its entirety). This particular approach is a multicomponent polymer system whose key features include a membrane-active polymer to which nucleic acid, in this case siRNA, is covalently coupled via a disulfide bond and where both PEG (for charge masking) and N-acetylgalactosamine (for hepatocyte targeting) groups are linked via pH-sensitive bonds (Rozema et al., Proc Natl Acad Sci USA. 2007 104:12982-12887; herein incorporated by reference in its entirety). On binding to the hepatocyte and entry into the endosome, the polymer complex disassembles in the low-pH environment, with the polymer exposing its positive charge, leading to endosomal escape and cytoplasmic release of the siRNA from the polymer. Through replacement of the N-acetylgalactosamine group with a mannose group, it was shown one could alter targeting from asialoglycoprotein receptor-expressing hepatocytes to sinusoidal endothelium and Kupffer cells. Another polymer approach involves using transferrin-targeted cyclodextrin-containing polycation nanoparticles. These nanoparticles have demonstrated targeted silencing of the EWS-FLI1 gene product in transferrin receptor-expressing Ewing's sarcoma tumor cells (Hu-Lieskovan et al., Cancer Res.2005 65: 8984-8982; herein incorporated by reference in its entirety) and siRNA formulated in these nanoparticles was well tolerated in non-human primates (Heidel et al., Proc Natl Acad Sci USA 2007 104:5715-21; herein incorporated by reference in its entirety). Both of these delivery strategies incorporate rational approaches using both targeted delivery and endosomal escape mechanisms.

The polymer formulation can permit the sustained or delayed release of polynucleotides (e.g., following intramuscular or subcutaneous injection). The altered release profile for the polynucleotide can result in, for example, translation of an encoded protein over an extended period of time. The polymer formulation may also be used to increase the stability of the polynucleotide. Biodegradable polymers have been previously used to protect nucleic acids other than polynucleotide from degradation and been shown to result in sustained release of payloads in vivo (Rozema et al., Proc Natl Acad Sci USA. 2007 104:12982-12887; Sullivan et al., Expert Opin Drug Deliv. 2010 7:1433-1446; Convertine et al., Biomacromolecules. 2010 Oct. 1; Chu et al., Acc Chem Res. 2012 Jan. 13; Manganiello et al., Biomaterials. 2012 33:2301-2309; Benoit et al., Biomacromolecules. 2011 12:2708-2714; Singha et al., Nucleic Acid Ther. 2011 2:133-147; deFougerolles Hum Gene Ther. 2008 19:125-132;

Schaffert and Wagner, Gene Ther. 2008 16:1131-1138; Chaturvedi et al., Expert Opin Drug Deliv. 2011 8:1455-1468; Davis, Mol Pharm. 2009 6:659-668; Davis, Nature 2010 464:1067-1070; each of which is herein incorporated by reference in its entirety).

In one embodiment, the pharmaceutical compositions may be sustained release formulations. In a further embodiment, the sustained release formulations may be for subcutaneous delivery. Sustained release formulations may include, but are not limited to, PLGA microspheres, ethylene vinyl acetate (EVAc), poloxamer, GELSITE® (Nanotherapeutics, Inc. Alachua, Fla.), HYLENEX® (Halozyme Therapeutics, San Diego Calif.), surgical sealants such as fibrinogen polymers (Ethicon Inc. Cornelia, Ga.), TISSELL® (Baxter International, Inc Deerfield, Ill.), PEG-based sealants, and COSEAL® (Baxter International, Inc Deerfield, Ill.).

As a non-limiting example modified mRNA may be formulated in PLGA microspheres by preparing the PLGA microspheres with tunable release rates (e.g., days and weeks) and encapsulating the modified mRNA in the PLGA microspheres while maintaining the integrity of the modified mRNA during the encapsulation process. EVAc are non-biodegradeable, biocompatible polymers which are used extensively in pre-clinical sustained release implant applications (e.g., extended release products Ocusert a pilocarpine ophthalmic insert for glaucoma or progestasert a sustained release progesterone intrauterine deivce; transdermal delivery systems Testoderm, Duragesic and Selegiline; catheters). Poloxamer F-407 NF is a hydrophilic, non-ionic surfactant triblock copolymer of polyoxyethylene-polyoxypropylene-polyoxyethylene having a low viscosity at temperatures less than 5° C. and forms a solid gel at temperatures greater than 15° C. PEG-based surgical sealants comprise two synthetic PEG components mixed in a delivery device which can be prepared in one minute, seals in 3 minutes and is reabsorbed within 30 days. GELSITE® and natural polymers are capable of in-situ gelation at the site of administration. They have been shown to interact with protein and peptide therapeutic candidates through ionic ineraction to provide a stabilizing effect.

Polymer formulations can also be selectively targeted through expression of different ligands as exemplified by, but not limited by, folate, transferrin, and N-acetylgalactosamine (GalNAc) (Benoit et al., Biomacromolecules. 2011 12:2708-2714; Rozema et al., Proc Natl Acad Sci USA. 2007 104:12982-12887; Davis, Mol Pharm. 2009 6:659-668; Davis, Nature 2010 464:1067-1070; each of which is herein incorporated by reference in its entirety).

The polynucleotides of the invention may be formulated with or in a polymeric compound. The polymer may include at least one polymer such as, but not limited to, polyethenes, polyethylene glycol (PEG), poly(l-lysine)(PLL), PEG grafted to PLL, cationic lipopolymer, biodegradable cationic lipopolymer, polyethyleneimine (PEI), cross-linked branched poly(alkylene imines), a polyamine derivative, a modified poloxamer, a biodegradable polymer, elastic biodegradable polymer, biodegradable block copolymer, biodegradable random copolymer, biodegradable polyester copolymer, biodegradable polyester block copolymer, biodegradable polyester block random copolymer, multiblock copolymers, linear biodegradable copolymer, poly[α-(4-aminobutyl)-L-glycolic acid) (PAGA), biodegradable cross-linked cationic multi-block copolymers, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polylysine, poly(ethylene imine), poly(serine ester), poly(L-lactide-co-L-lysine), poly(4-hydroxy-L-proline ester), acrylic polymers, amine-containing polymers, dextran polymers, dextran polymer derivatives or or combinations thereof.

As a non-limiting example, the polynucleotides of the invention may be formulated with the polymeric compound of PEG grafted with PLL as described in U.S. Pat. No. 6,177,274; herein incorporated by reference in its entirety. The formulation may be used for transfecting cells in vitro or for in vivo delivery of polynucleotide. In another example, the polynucleotide may be suspended in a solution or medium with a cationic polymer, in a dry pharmaceutical composition or in a solution that is capable of being dried as described in U.S. Pub. Nos. 20090042829 and 20090042825; each of which are herein incorporated by reference in their entireties.

As another non-limiting example the polynucleotides of the invention may be formulated with a PLGA-PEG block copolymer (see US Pub. No. US20120004293 and U.S. Pat. No. 8,236,330, herein incorporated by reference in their entireties) or PLGA-PEG-PLGA block copolymers (See U.S. Pat. No. 6,004,573, herein incorporated by reference in its entirety). As a non-limiting example, the polynucleotides of the invention may be formulated with a diblock copolymer of PEG and PLA or PEG and PLGA (see U.S. Pat. No. 8,246,968, herein incorporated by reference in its entirety).

A polyamine derivative may be used to deliver nucleic acids or to treat and/or prevent a disease or to be included in an implantable or injectable device (U.S. Pub. No. 20100260817 (now U.S. Pat. No. 8,460,696) the contents of each of which is herein incorporated by reference in its entirety). As a non-limiting example, a pharmaceutical composition may include the polynucleotide and the polyamine derivative described in U.S. Pub. No. 20100260817 (now U.S. Pat. No. 8,460,696; the contents of which are incorporated herein by reference in its entirety. As a non-limiting example the polynucleotides of the present invention may be delivered using a polyaminde polymer such as, but not limited to, a polymer comprising a 1,3-dipolar addition polymer prepared by combining a carbohydrate diazide monomer with a dilkyne unite comprising oligoamines (U.S. Pat. No. 8,236,280; herein incorporated by reference in its entirety).

The polynucleotides of the invention may be formulated with at least one acrylic polymer. Acrylic polymers include but are not limited to, acrylic acid, methacrylic acid, acrylic acid and methacrylic acid copolymers, methyl methacrylate copolymers, ethoxyethyl methacrylates, cyanoethyl methacrylate, amino alkyl methacrylate copolymer, poly(acrylic acid), poly(methacrylic acid), polycyanoacrylates and combinations thereof.

In one embodiment, the polynucleotides of the present invention may be formulated with at least one polymer and/or derivatives thereof described in International Publication Nos. WO2011115862, WO2012082574 and WO2012068187 and U.S. Pub. No. 20120283427, each of which are herein incorporated by reference in their entireties. In another embodiment, the polynucleotides of the present invention may be formulated with a polymer of formula Z as described in WO2011115862, herein incorporated by reference in its entirety. In yet another embodiment, the polynucleotides may be formulated with a polymer of formula Z, Z' or Z" as described in International Pub. Nos. WO2012082574 or WO2012068187 and U.S. Pub. No.

2012028342, each of which are herein incorporated by reference in their entireties. The polymers formulated with the modified RNA of the present invention may be synthesized by the methods described in International Pub. Nos. WO2012082574 or WO2012068187, each of which are herein incorporated by reference in their entireties.

The polynucleotides of the invention may be formulated with at least one acrylic polymer. Acrylic polymers include but are not limited to, acrylic acid, methacrylic acid, acrylic acid and methacrylic acid copolymers, methyl methacrylate copolymers, ethoxyethyl methacrylates, cyanoethyl methacrylate, amino alkyl methacrylate copolymer, poly(acrylic acid), poly(methacrylic acid), polycyanoacrylates and combinations thereof.

Formulations of polynucleotides of the invention may include at least one amine-containing polymer such as, but not limited to polylysine, polyethylene imine, poly(amidoamine) dendrimers, poly(amine-co-esters) or combinations thereof. As a non-limiting example, the poly(amine-co-esters) may be the polymers described in and/or made by the methods described in International Publication No WO2013082529, the contents of which are herein incorporated by reference in its entirety.

For example, the polynucleotides of the invention may be formulated in a pharmaceutical compound including a poly(alkylene imine), a biodegradable cationic lipopolymer, a biodegradable block copolymer, a biodegradable polymer, or a biodegradable random copolymer, a biodegradable polyester block copolymer, a biodegradable polyester polymer, a biodegradable polyester random copolymer, a linear biodegradable copolymer, PAGA, a biodegradable cross-linked cationic multi-block copolymer or combinations thereof. The biodegradable cationic lipopolymer may be made by methods known in the art and/or described in U.S. Pat. No. 6,696,038, U.S. App. Nos. 20030073619 and 20040142474 each of which is herein incorporated by reference in their entireties. The poly(alkylene imine) may be made using methods known in the art and/or as described in U.S. Pub. No. 20100004315, herein incorporated by reference in its entirety. The biodegradabale polymer, biodegradable block copolymer, the biodegradable random copolymer, biodegradable polyester block copolymer, biodegradable polyester polymer, or biodegradable polyester random copolymer may be made using methods known in the art and/or as described in U.S. Pat. Nos. 6,517,869 and 6,267,987, the contents of which are each incorporated herein by reference in their entirety. The linear biodegradable copolymer may be made using methods known in the art and/or as described in U.S. Pat. No. 6,652,886. The PAGA polymer may be made using methods known in the art and/or as described in U.S. Pat. No. 6,217,912 herein incorporated by reference in its entirety. The PAGA polymer may be copolymerized to form a copolymer or block copolymer with polymers such as but not limited to, poly-L-lysine, polyargine, polyornithine, histones, avidin, protamines, polylactides and poly(lactide-co-glycolides). The biodegradable cross-linked cationic multi-block copolymers may be made my methods known in the art and/or as described in U.S. Pat. Nos. 8,057,821, 8,444,992 or U.S. Pub. No. 2012009145 each of which are herein incorporated by reference in their entireties. For example, the multi-block copolymers may be synthesized using linear polyethyleneimine (LPEI) blocks which have distinct patterns as compared to branched polyethyleneimines. Further, the composition or pharmaceutical composition may be made by the methods known in the art, described herein, or as described in U.S. Pub. No. 20100004315 or U.S. Pat. Nos. 6,267,987 and 6,217,912 each of which are herein incorporated by reference in their entireties.

The polynucleotides of the invention may be formulated with at least one degradable polyester which may contain polycationic side chains. Degradeable polyesters include, but are not limited to, poly(serine ester), poly(L-lactide-co-L-lysine), poly(4-hydroxy-L-proline ester), and combinations thereof. In another embodiment, the degradable polyesters may include a PEG conjugation to form a PEGylated polymer.

The polynucleotides of the invention may be formulated with at least one crosslinkable polyester. Crosslinkable polyesters include those known in the art and described in US Pub. No. 20120269761, the contents of which is herein incorporated by reference in its entirety.

The polynucleotides of the invention may be formulated in or with at least one cyclodextrin polymer. Cyclodextrin polymers and methods of making cyclodextrin polymers include those known in the art and described in US Pub. No. 20130184453, the contents of which are herein incorporated by reference in its entirety.

In one embodiment, the polynucleotides of the invention may be formulated in or with at least one crosslinked cation-binding polymers. Crosslinked cation-binding polymers and methods of making crosslinked cation-binding polymers include those known in the art and described in International Patent Publication No. WO2013106072, WO2013106073 and WO2013106086, the contents of each of which are herein incorporated by reference in its entirety.

In one embodiment, the polynucleotides of the invention may be formulated in or with at least one branched polymer. Branched polymers and methods of making branched polymers include those known in the art and described in International Patent Publication No. WO2013113071, the contents of each of which are herein incorporated by reference in its entirety.

In one embodiment, the polynucleotides of the invention may be formulated in or with at least PEGylated albumin polymer. PEGylated albumin polymer and methods of making PEGylated albumin polymer include those known in the art and described in US Patent Publication No. US20130231287, the contents of each of which are herein incorporated by reference in its entirety.

In one embodiment, the polymers described herein may be conjugated to a lipid-terminating PEG. As a non-limiting example, PLGA may be conjugated to a lipid-terminating PEG forming PLGA-DSPE-PEG. As another non-limiting example, PEG conjugates for use with the present invention are described in International Publication No. WO2008103276, herein incorporated by reference in its entirety. The polymers may be conjugated using a ligand conjugate such as, but not limited to, the conjugates described in U.S. Pat. No. 8,273,363, herein incorporated by reference in its entirety.

In one embodiment, the polynucleotides disclosed herein may be mixed with the PEGs or the sodium phosphate/sodium carbonate solution prior to administration. In another embodiment, a polynucleotides encoding a protein of interest may be mixed with the PEGs and also mixed with the sodium phosphate/sodium carbonate solution. In yet another embodiment, polynucleotides encoding a protein of interest may be mixed with the PEGs and a polynucleotides encoding a second protein of interest may be mixed with the sodium phosphate/sodium carbonate solution.

In one embodiment, the polynucleotides described herein may be conjugated with another compound. Non-limiting examples of conjugates are described in U.S. Pat. Nos.

7,964,578 and 7,833,992, each of which are herein incorporated by reference in their entireties. In another embodiment, modified RNA of the present invention may be conjugated with conjugates of formula 1-122 as described in U.S. Pat. Nos. 7,964,578 and 7,833,992, each of which are herein incorporated by reference in their entireties. The polynucleotides described herein may be conjugated with a metal such as, but not limited to, gold. (See e.g., Giljohann et al. Journ. Amer. Chem. Soc. 2009 131(6): 2072-2073; herein incorporated by reference in its entirety). In another embodiment, the polynucleotides described herein may be conjugated and/or encapsulated in gold-nanoparticles. (International Pub. No. WO201216269 and U.S. Pub. No. 20120302940 and US20130177523; the contents of each of which is herein incorporated by reference in its entirety).

As described in U.S. Pub. No. 20100004313, herein incorporated by reference in its entirety, a gene delivery composition may include a nucleotide sequence and a poloxamer. For example, the polynucleotides of the present invention may be used in a gene delivery composition with the poloxamer described in U.S. Pub. No. 20100004313.

In one embodiment, the polymer formulation of the present invention may be stabilized by contacting the polymer formulation, which may include a cationic carrier, with a cationic lipopolymer which may be covalently linked to cholesterol and polyethylene glycol groups. The polymer formulation may be contacted with a cationic lipopolymer using the methods described in U.S. Pub. No. 20090042829 herein incorporated by reference in its entirety. The cationic carrier may include, but is not limited to, polyethylenimine, poly(trimethylenimine), poly(tetramethylenimine), polypropylenimine, aminoglycoside-polyamine, dideoxy-diamino-b-cyclodextrin, spermine, spermidine, poly(2-dimethylamino)ethyl methacrylate, poly(lysine), poly(histidine), poly(arginine), cationized gelatin, dendrimers, chitosan, 1,2-Dioleoyl-3-Trimethylammonium-Propane(DOTAP), N-[1-(2,3-dioleoyloxy)propyl]-N,N,N-trimethylammonium chloride (DOTMA), 1-[2-(oleoyloxy)ethyl]-2-oleyl-3-(2-hydroxyethyl)imidazolinium chloride (DOTIM), 2,3-dioleyloxy-N-[2(sperminecarboxamido)ethyl]-N,N-dimethyl-1-propanaminium trifluoroacetate (DOSPA), 3B-[N—(N',N'-Dimethylaminoethane)-carbamoyl]Cholesterol Hydrochloride (DC-Cholesterol HCl) diheptadecylamidoglycyl spermidine (DOGS), N,N-distearyl-N,N-dimethylammonium bromide (DDAB), N-(1,2-dimyristyloxyprop-3-yl)-N,N-dimethyl-N-hydroxyethyl ammonium bromide (DMRIE), N,N-dioleyl-N,N-dimethylammonium chloride DODAC) and combinations thereof. As a non-limiting example, the polynucleotides may be formulated with a cationic lipopolymer such as those described in U.S. Patent Application No. 20130065942, herein incorporated by reference in its entirety.

The polynucleotides of the invention may be formulated in a polyplex of one or more polymers (See e.g., U.S. Pat. No. 8,501,478, U.S. Pub. No. 20120237565 and 20120270927 and 20130149783 and International Patent Pub. No. WO2013090861; the contents of each of which is herein incorporated by reference in its entirety). As a non-limiting example, the polyplex may be formed using the noval alpha-aminoamidine polymers described in International Publication No. WO2013090861, the contents of which are herein incorporated by reference in its entirety. As another non-limiting example, the polyplex may be formed using the click polymers described in U.S. Pat. No. 8,501,478, the contents of which is herein incorporated by reference in its entirety.

In one embodiment, the polyplex comprises two or more cationic polymers. The catioinic polymer may comprise a poly(ethylene imine) (PEI) such as linear PEI. In another embodiment, the polyplex comprises p(TETA/CBA) its PEGylated analog p(TETA/CBA)-g-PEG2k and mixtures thereof (see e.g., US Patent Publication No. US20130149783, the contents of which are herein incorporated by reference in its entirety.

The polynucleotides of the invention can also be formulated as a nanoparticle using a combination of polymers, lipids, and/or other biodegradable agents, such as, but not limited to, calcium phosphate. Components may be combined in a core-shell, hybrid, and/or layer-by-layer architecture, to allow for fine-tuning of the nanoparticle so to delivery of the polynucleotide, polynucleotides may be enhanced (Wang et al., Nat Mater. 2006 5:791-796; Fuller et al., Biomaterials. 2008 29:1526-1532; DeKoker et al., Adv Drug Deliv Rev. 2011 63:748-761; Endres et al., Biomaterials. 2011 32:7721-7731; Su et al., Mol Pharm. 2011 Jun. 6; 8(3):774-87; herein incorporated by reference in its entirety). As a non-limiting example, the nanoparticle may comprise a plurality of polymers such as, but not limited to hydrophilic-hydrophobic polymers (e.g., PEG-PLGA), hydrophobic polymers (e.g., PEG) and/or hydrophilic polymers (International Pub. No. WO20120225129; the contents of which is herein incorporated by reference in its entirety).

As another non-limiting example the nanoparticle comprising hydrophilic polymers for the polynucleotides may be those described in or made by the methods described in International Patent Publication No. WO2013119936, the contents of which are herein incorporated by reference in its entirety.

In one embodiment, the biodegradable polymers which may be used in the present invention are poly(ether-anhydride) block copolymers. As a non-limiting example, the biodegradable polymers used herein may be a block copolymer as described in International Patent Publication No WO2006063249, herein incorporated by reference in its entirety, or made by the methods described in International Patent Publication No WO2006063249, herein incorporated by reference in its entirety.

In another embodiment, the biodegradable polymers which may be used in the present invention are alkyl and cycloalkyl terminated biodegradable lipids. As a non-limiting example, the alkyl and cycloalkyl terminated biodegradable lipids may be those described in International Publication No. WO2013086322 and/or made by the methods described in International Publication No. WO2013086322; the contents of which are herein incorporated by reference in its entirety.

In yet another embodiment, the biodegradable polymers which may be used in the present invention are cationic lipids having one or more biodegradable group located in a lipid moiety. As a non-limiting example, the biodegradable lipids may be those described in US Patent Publication No. US20130195920, the contents of which are herein incorporated by reference in its entirety.

Biodegradable calcium phosphate nanoparticles in combination with lipids and/or polymers have been shown to deliver polynucleotides in vivo. In one embodiment, a lipid coated calcium phosphate nanoparticle, which may also contain a targeting ligand such as anisamide, may be used to deliver the polynucleotide, polynucleotides of the present invention. For example, to effectively deliver siRNA in a mouse metastatic lung model a lipid coated calcium phosphate nanoparticle was used (Li et al., J Contr Rel. 2010 142: 416-421; Li et al., J Contr Rel. 2012 158:108-114; Yang et al., Mol Ther. 2012 20:609-615; herein incorporated by reference in its entirety). This delivery system combines both a targeted nanoparticle and a component to enhance the endosomal escape, calcium phosphate, in order to improve delivery of the siRNA.

In one embodiment, calcium phosphate with a PEG-polyanion block copolymer may be used to delivery polynucleotides (Kazikawa et al., J Contr Rel. 2004 97:345-356; Kazikawa et al., J Contr Rel. 2006 111:368-370; the contents of each of which are herein incorporated by reference in its entirety).

In one embodiment, a PEG-charge-conversional polymer (Pitella et al., Biomaterials. 2011 32:3106-3114; the contents of which are herein incorporated by reference in its entirety) may be used to form a nanoparticle to deliver the polynucleotides of the present invention. The PEG-charge-conversional polymer may improve upon the PEG-polyanion block copolymers by being cleaved into a polycation at acidic pH, thus enhancing endosomal escape.

In one embodiment, a polymer used in the present invention may be a pentablock polymer such as, but not limited to, the pentablock polymers described in International Patent Publication No. WO2013055331, herein incorporated by reference in its entirety. As a non-limiting example, the pentablock polymer comprises PGA-PCL-PEG-PCL-PGA, wherein PEG is polyethylene glycol, PCL is poly(E-caprolactone), PGA is poly(glycolic acid), and PLA is poly(lactic acid). As another non-limiting example, the pentablock polymer comprises PEG-PCL-PLA-PCL-PEG, wherein PEG is polyethylene glycol, PCL is poly(E-caprolactone), PGA is poly(glycolic acid), and PLA is poly(lactic acid).

In one embodiment, a polymer which may be used in the present invention comprises at least one diepoxide and at least one aminoglycoside (See e.g., International Patent Publication No. WO2013055971, the contents of which are herein incorporated by reference in its entirety). The diepoxide may be selected from, but is not limited to, 1,4 butanediol diglycidyl ether (1,4 B), 1,4-cyclohexanedimethanol diglycidyl ether (1,4 C), 4-vinylcyclohexene diepoxide (4VCD), ethyleneglycol diglycidyl ether (EDGE), glycerol diglycidyl ether (GDE), neopentylglycol diglycidyl ether (NPDGE), poly(ethyleneglycol) diglycidyl ether (PEGDE), poly(propyleneglycol) diglycidyl ether (PPGDE) and resorcinol diglycidyl ether (RDE). The aminoglycoside may be selected from, but is not limited to, streptomycin, neomycin, framycetin, paromomycin, ribostamycin, kanamycin, amikacin, arbekacin, bekanamycin, dibekacin, tobramycin, spectinomycin, hygromycin, gentamicin, netilmicin, sisomicin, isepamicin, verdamicin, astromicin, and apramycin. As a non-limiting example, the polymers may be made by the methods described in International Patent Publication No. WO2013055971, the contents of which are herein incorporated by reference in its entirety. As another non-limiting example, compositions comprising any of the polymers comprising at least one least one diepoxide and at least one aminoglycoside may be made by the methods described in International Patent Publication No. WO2013055971, the contents of which are herein incorporated by reference in its entirety.

In one embodiment, a polymer which may be used in the present invention may be a cross-linked polymer. As a non-limiting example, the cross-linked polymers may be used to form a particle as described in U.S. Pat. No. 8,414,927, the contents of which are herein incorporated by reference in its entirety. As another non-limiting example, the cross-linked polymer may be obtained by the methods described in US Patent Publication No. US20130172600, the contents of which are herein incorporated by reference in its entirety.

In another embodiment, a polymer which may be used in the present invention may be a cross-linked polymer such as those described in U.S. Pat. No. 8,461,132, the contents of which are herein incorporated by reference in its entirety. As a non-limiting example, the cross-linked polymer may be used in a therapeutic composition for the treatment of a body tissue. The therapeutic composition may be administered to damaged tissue using various methods known in the art and/or described herein such as injection or catheterization.

In one embodiment, a polymer which may be used in the present invention may be a di-alphatic substituted pegylated lipid such as, but not limited to, those described in International Patent Publication No. WO2013049328, the contents of which are herein incorporated by reference in its entirety.

In one embodiment, a block copolymer is PEG-PLGA-PEG (see e.g., the thermosensitive hydrogel (PEG-PLGA-PEG) was used as a TGF-beta1 gene delivery vehicle in Lee et al. Thermosensitive Hydrogel as a Tgf-β1 Gene Delivery Vehicle Enhances Diabetic Wound Healing. Pharmaceutical Research, 2003 20(12): 1995-2000; as a controlled gene delivery system in Li et al. Controlled Gene Delivery System Based on Thermosensitive Biodegradable Hydrogel. Pharmaceutical Research 2003 20(6):884-888; and Chang et al., Non-ionic amphiphilic biodegradable PEG-PLGA-PEG copolymer enhances gene delivery efficiency in rat skeletal muscle. J Controlled Release. 2007 118:245-253; each of which is herein incorporated by reference in its entirety) may be used in the present invention. The present invention may be formulated with PEG-PLGA-PEG for administration such as, but not limited to, intramuscular and subcutaneous administration.

In another embodiment, the PEG-PLGA-PEG block copolymer is used in the present invention to develop a biodegradable sustained release system. In one aspect, the polynucleotides of the present invention are mixed with the block copolymer prior to administration. In another aspect, the polynucleotides acids of the present invention are co-administered with the block copolymer.

In one embodiment, the polymer used in the present invention may be a multi-functional polymer derivative such as, but not limited to, a multi-functional N-maleimidyl polymer derivatives as described in U.S. Pat. No. 8,454,946, the contents of which are herein incorporated by reference in its entirety.

The use of core-shell nanoparticles has additionally focused on a high-throughput approach to synthesize cationic cross-linked nanogel cores and various shells (Siegwart et al., Proc Natl Acad Sci USA. 2011 108:12996-13001; the contents of which are herein incorporated by reference in its entirety). The complexation, delivery, and internalization of the polymeric nanoparticles can be precisely controlled by altering the chemical composition in both the core and shell components of the nanoparticle. For example, the core-shell nanoparticles may efficiently deliver siRNA to mouse hepatocytes after they covalently attach cholesterol to the nanoparticle.

In one embodiment, a hollow lipid core comprising a middle PLGA layer and an outer neutral lipid layer containg PEG may be used to delivery of the polynucleotide, polynucleotides of the present invention. As a non-limiting example, in mice bearing a luciferease-expressing tumor, it was determined that the lipid-polymer-lipid hybrid nanoparticle significantly suppressed luciferase expression, as compared to a conventional lipoplex (Shi et al, Angew Chem Int Ed. 2011 50:7027-7031; herein incorporated by reference in its entirety).

In one embodiment, the lipid nanoparticles may comprise a core of the polynucleotides disclosed herein and a polymer shell. The polymer shell may be any of the polymers described herein and are known in the art. In an additional embodiment, the polymer shell may be used to protect the polynucleotides in the core.

Core-shell nanoparticles for use with the polynucleotides of the present invention are described and may be formed by the methods described in U.S. Pat. No. 8,313,777 or International Patent Publication No. WO2013124867, the contents of each of which are herein incorporated by reference in their entirety.

In one embodiment, the core-shell nanoparticles may comprise a core of the polynucleotides disclosed herein and a polymer shell. The polymer shell may be any of the polymers described herein and are known in the art. In an additional embodiment, the polymer shell may be used to protect the polynucleotides in the core.

In one embodiment, the polymer used with the formulations described herein may be a modified polymer (such as, but not limited to, a modified polyacetal) as described in International Publication No. WO2011120053, the contents of which are herein incorporated by reference in its entirety.

In one embodiment, the formulation may be a polymeric carrier cargo complex comprising a polymeric carrier and at least one nucleic acid molecule. Non-limiting examples of polymeric carrier cargo complexes are described in International Patent Publications Nos. WO2013113326, WO2013113501, WO2013113325, WO2013113502 and WO2013113736 and European Patent Publication No. EP2623121, the contents of each of which are herein incorporated by reference in their entireties. In one aspect the polymeric carrier cargo complexes may comprise a negatively charged nucleic acid molecule such as, but not limited to, those described in International Patent Publication Nos. WO2013113325 and WO2013113502, the contents of each of which are herein incorporated by reference in its entirety.

In one embodiment, a pharmaceutical composition may comprise polynucleotides of the invention and a polymeric carrier cargo complex. The polynucleotides may encode a protein of interest such as, but not limited to, an antigen from a pathogen associated with infectious disease, an antigen associated with allergy or allergic disease, an antigen associated with autoimmune disease or an antigen associated with cancer or tumour disease (See e.g., the antigens described in International Patent Publications Nos. WO2013113326, WO2013113501, WO2013113325, WO2013113502 and WO2013113736 and European Patent Publication No. EP2623121, the contents of each of which are herein incorporated by reference in their entireties).

As a non-limiting example, the core-shell nanoparticle may be used to treat an eye disease or disorder (See e.g. US Publication No. 20120321719, the contents of which are herein incorporated by reference in its entirety).

In one embodiment, the polymer used with the formulations described herein may be a modified polymer (such as, but not limited to, a modified polyacetal) as described in International Publication No. WO2011120053, the contents of which are herein incorporated by reference in its entirety.

Peptides and Proteins

The polynucleotides of the invention can be formulated with peptides and/or proteins in order to increase transfection of cells by the polynucleotide. In one embodiment, peptides such as, but not limited to, cell penetrating peptides and proteins and peptides that enable intracellular delivery may be used to deliver pharmaceutical formulations. A non-limiting example of a cell penetrating peptide which may be used with the pharmaceutical formulations of the present invention includes a cell-penetrating peptide sequence attached to polycations that facilitates delivery to the intracellular space, e.g., HIV-derived TAT peptide, penetratins, transportans, or hCT derived cell-penetrating peptides (see, e.g., Caron et al., Mol. Ther. 3(3):310-8 (2001); Langel, Cell-Penetrating Peptides: Processes and Applications (CRC Press, Boca Raton Fla., 2002); El-Andaloussi et al., Curr. Pharm. Des. 11(28):3597-611 (2003); and Deshayes et al., Cell. Mol. Life Sci. 62(16):1839-49 (2005), all of which are incorporated herein by reference in their entirety). The compositions can also be formulated to include a cell penetrating agent, e.g., liposomes, which enhance delivery of the compositions to the intracellular space. Polynucleotides of the invention may be complexed to peptides and/or proteins such as, but not limited to, peptides and/or proteins from Aileron Therapeutics (Cambridge, Mass.) and Permeon Biologics (Cambridge, Mass.) in order to enable intracellular delivery (Cronican et al., ACS Chem. Biol. 2010 5:747-752; McNaughton et al., Proc. Natl. Acad. Sci. USA 2009 106:6111-6116; Sawyer, Chem Biol Drug Des. 2009 73:3-6; Verdine and Hilinski, Methods Enzymol. 2012; 503:3-33; all of which are herein incorporated by reference in its entirety).

In one embodiment, the cell-penetrating polypeptide may comprise a first domain and a second domain. The first domain may comprise a supercharged polypeptide. The second domain may comprise a protein-binding partner. As used herein, "protein-binding partner" includes, but are not limited to, antibodies and functional fragments thereof, scaffold proteins, or peptides. The cell-penetrating polypeptide may further comprise an intracellular binding partner for the protein-binding partner. The cell-penetrating polypeptide may be capable of being secreted from a cell where the polynucleotide may be introduced.

Formulations of the including peptides or proteins may be used to increase cell transfection by the polynucleotide, alter the biodistribution of the polynucleotide (e.g., by targeting specific tissues or cell types), and/or increase the translation of encoded protein. (See e.g., International Pub. No. WO2012110636 and WO2013123298; the contents of which are herein incorporated by reference in its entirety).

In one embodiment, the cell penetrating peptide may be, but is not limited to, those described in US Patent Publication No US20130129726, US20130137644 and US20130164219, each of which is herein incorporated by reference in its entirety.

Cells

The polynucleotides of the invention can be transfected ex vivo into cells, which are subsequently transplanted into a subject. As non-limiting examples, the pharmaceutical compositions may include red blood cells to deliver modified RNA to liver and myeloid cells, virosomes to deliver modified RNA in virus-like particles (VLPs), and electroporated cells such as, but not limited to, from MAXCYTE® (Gaithersburg, Md.) and from ERYTECH® (Lyon, France) to deliver modified RNA. Examples of use of red blood cells, viral particles and electroporated cells to deliver payloads other than polynucleotides have been documented (Godfrin et al., Expert Opin Biol Ther. 2012 12:127-133; Fang et al., Expert Opin Biol Ther. 2012 12:385-389; Hu et al., Proc Natl Acad Sci USA. 2011 108:10980-10985; Lund et al., Pharm Res. 2010 27:400-420; Huckriede et al., J Liposome Res. 2007; 17:39-47; Cusi, Hum Vaccin. 2006 2:1-7; de Jonge et al., Gene Ther. 2006 13:400-411; all of which are herein incorporated by reference in its entirety).

The polynucleotides may be delivered in synthetic VLPs synthesized by the methods described in International Pub No. WO2011085231 and WO2013116656 and US Pub No. 20110171248, the contents of each of which are herein incorporated by reference in their entireties.

Cell-based formulations of the polynucleotides of the invention may be used to ensure cell transfection (e.g., in the cellular carrier), alter the biodistribution of the polynucleotide (e.g., by targeting the cell carrier to specific tissues or cell types), and/or increase the translation of encoded protein.

Introduction into Cells

A variety of methods are known in the art and suitable for introduction of nucleic acid into a cell, including viral and non-viral mediated techniques. Examples of typical non-viral mediated techniques include, but are not limited to, electroporation, calcium phosphate mediated transfer, nucleofection, sonoporation, heat shock, magnetofection, liposome mediated transfer, microinjection, microprojectile mediated transfer (nanoparticles), cationic polymer mediated transfer (DEAE-dextran, polyethylenimine, polyethylene glycol (PEG) and the like) or cell fusion.

The technique of sonoporation, or cellular sonication, is the use of sound (e.g., ultrasonic frequencies) for modifying the permeability of the cell plasma membrane. Sonoporation methods are known to those in the art and are used to deliver nucleic acids in vivo (Yoon and Park, Expert Opin Drug Deliv. 2010 7:321-330; Postema and Gilja, Curr Pharm Biotechnol. 2007 8:355-361; Newman and Bettinger, Gene Ther. 2007 14:465-475; all herein incorporated by reference in their entirety). Sonoporation methods are known in the art and are also taught for example as it relates to bacteria in US Patent Publication 20100196983 and as it relates to other cell types in, for example, US Patent Publication 20100009424, each of which are incorporated herein by reference in their entirety.

Electroporation techniques are also well known in the art and are used to deliver nucleic acids in vivo and clinically (Andre et al., Curr Gene Ther. 2010 10:267-280; Chiarella et al., Curr Gene Ther. 2010 10:281-286; Hojman, Curr Gene Ther. 2010 10:128-138; all herein incorporated by reference in their entirety). Electroporation devices are sold by many companies worldwide including, but not limited to BTX® Instruments (Holliston, Mass.) (e.g., the AgilePulse In Vivo System) and Inovio (Blue Bell, Pa.) (e.g., Inovio SP-5P intramuscular delivery device or the CELLECTRA® 3000 intradermal delivery device). In one embodiment, polynucleotides may be delivered by electroporation.

Micro-Organ

The polynucleotides may be contained in a micro-organ which can then express an encoded polypeptide of interest in a long-lasting therapeutic formulation. Micro-organs and formulations thereof are described in International Patent Application No. PCT/US2014/027077, the contents of which are herein incorporated by reference in its entirety, such as in paragraphs [000701]-[000705].

Hyaluronidase

The intramuscular or subcutaneous localized injection of polynucleotides of the invention can include hyaluronidase, which catalyzes the hydrolysis of hyaluronan. By catalyzing the hydrolysis of hyaluronan, a constituent of the interstitial barrier, hyaluronidase lowers the viscosity of hyaluronan, thereby increasing tissue permeability (Frost, Expert Opin. Drug Deliv. (2007) 4:427-440; herein incorporated by reference in its entirety). It is useful to speed their dispersion and systemic distribution of encoded proteins produced by transfected cells. Alternatively, the hyaluronidase can be used to increase the number of cells exposed to a polynucleotide of the invention administered intramuscularly or subcutaneously.

Nanoparticle Mimics

The polynucleotides of the invention may be encapsulated within and/or absorbed to a nanoparticle mimic. A nanoparticle mimic can mimic the delivery function organisms or particles such as, but not limited to, pathogens, viruses, bacteria, fungus, parasites, prions and cells. As a non-limiting example the polynucleotides of the invention may be encapsulated in a non-viron particle which can mimic the delivery function of a virus (see International Pub. No. WO2012006376 and US Patent Publication No. US20130171241 and US20130195968, the contents of each of which are herein incorporated by reference in its entirety).

Nanotubes

The polynucleotides of the invention can be attached or otherwise bound to at least one nanotube such as, but not limited to, rosette nanotubes, rosette nanotubes having twin bases with a linker, carbon nanotubes and/or single-walled carbon nanotubes, The polynucleotides may be bound to the nanotubes through forces such as, but not limited to, steric, ionic, covalent and/or other forces. Nanotubes and nanotube formulations comprising polynucleotides are described in International Patent Application No. PCT/US2014/027077, the contents of which are herein incorporated by reference in its entirety, such as in paragraphs [000708]-[000714].

Conjugates

The polynucleotides of the invention include conjugates, such as a polynucleotide covalently linked to a carrier or targeting group, or including two encoding regions that together produce a fusion protein (e.g., bearing a targeting group and therapeutic protein or peptide).

The conjugates of the invention include a naturally occurring substance, such as a protein (e.g., human serum albumin (HSA), low-density lipoprotein (LDL), high-density lipoprotein (HDL), or globulin); an carbohydrate (e.g., a dextran, pullulan, chitin, chitosan, inulin, cyclodextrin or hyaluronic acid); or a lipid. The ligand may also be a recombinant or synthetic molecule, such as a synthetic polymer, e.g., a synthetic polyamino acid, an oligonucleotide (e.g. an aptamer). Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly (2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Representative U.S. patents that teach the preparation of polynucleotide conjugates, particularly to RNA, include, but are not limited to, U.S. Pat. Nos. 4,828,979; 4,948,882; 5,218,105; 5,525,465; 5,541,313; 5,545,730; 5,552,538; 5,578,717, 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506;

5,262,536; 5,272,250; 5,292,873; 5,317,098; 5,371,241; 5,391,723; 5,416,203; 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941; 6,294,664; 6,320,017; 6,576,752; 6,783,931; 6,900,297; 7,037,646; each of which is herein incorporated by reference in their entireties.

In one embodiment, the conjugate of the present invention may function as a carrier for the polynucleotides of the present invention. The conjugate may comprise a cationic polymer such as, but not limited to, polyamine, polylysine, polyalkylenimine, and polyethylenimine which may be grafted to with poly(ethylene glycol). As a non-limiting example, the conjugate may be similar to the polymeric conjugate and the method of synthesizing the polymeric conjugate described in U.S. Pat. No. 6,586,524 herein incorporated by reference in its entirety.

A non-limiting example of a method for conjugation to a substrate is described in US Patent Publication No. US20130211249, the contents of which are herein incorporated by reference in its entirety. The method may be used to make a conjugated polymeric particle comprising a polynucleotide.

The conjugates can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-gulucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, an RGD peptide, an RGD peptide mimetic or an aptamer.

Targeting groups can be proteins, e.g., glycoproteins, or peptides, e.g., molecules having a specific affinity for a co-ligand, or antibodies e.g., an antibody, that binds to a specified cell type such as a cancer cell, endothelial cell, or bone cell. Targeting groups may also include hormones and hormone receptors. They can also include non-peptidic species, such as lipids, lectins, carbohydrates, vitamins, cofactors, multivalent lactose, multivalent galactose, N-acetyl-galactosamine, N-acetyl-gulucosamine multivalent mannose, multivalent fucose, or aptamers. The ligand can be, for example, a lipopolysaccharide, or an activator of p38 MAP kinase.

The targeting group can be any ligand that is capable of targeting a specific receptor. Examples include, without limitation, folate, GalNAc, galactose, mannose, mannose-6P, apatamers, integrin receptor ligands, chemokine receptor ligands, transferrin, biotin, serotonin receptor ligands, PSMA, endothelin, GCPII, somatostatin, LDL, and HDL ligands. In particular embodiments, the targeting group is an aptamer. The aptamer can be unmodified or have any combination of modifications disclosed herein.

As a non-limiting example, the targeting group may be a glutathione receptor (GR)-binding conjugate for targeted delivery across the blood-central nervous system barrier (See e.g., US Patent Publication No. US2013021661012, the contents of which are herein incorporated by reference in its entirety.

In one embodiment, the conjugate of the present invention may be a synergistic biomolecule-polymer conjugate. The synergistic biomolecule-polymer conjugate may be long-acting continuous-release system to provide a greater therapeutic efficacy. The synergistic biomolecule-polymer conjugate may be those described in US Patent Publication No. US20130195799, the contents of which are herein incorporated by reference in its entirety.

In another embodiment, the conjugate which may be used in the present invention may be an aptamer conjugate. Non-limiting examples of apatamer conjugates are described in International Patent Publication No. WO2012040524, the contents of which are herein incorporated by reference in its entirety. The aptamer conjugates may be used to provide targerted delivery of formulations comprising polynucleotides.

In one embodiment, the conjugate which may be used in the present invention may be an amine containing polymer conjugate. Non-limiting examples of amine containing polymer conjugate are described in U.S. Pat. No. 8,507,653, the contents of which are herein incorporated by reference in its entirety.

In one embodiment, pharmaceutical compositions of the present invention may include chemical modifications such as, but not limited to, modifications similar to locked nucleic acids.

Representative U.S. Patents that teach the preparation of locked nucleic acid (LNA) such as those from Santaris, include, but are not limited to, the following: U.S. Pat. Nos. 6,268,490; 6,670,461; 6,794,499; 6,998,484; 7,053,207; 7,084,125; and 7,399,845, each of which is herein incorporated by reference in its entirety.

Representative U.S. patents that teach the preparation of PNA compounds include, but are not limited to, U.S. Pat. Nos. 5,539,082; 5,714,331; and 5,719,262, each of which is herein incorporated by reference. Further teaching of PNA compounds can be found, for example, in Nielsen et al., Science, 1991, 254, 1497-1500.

Some embodiments featured in the invention include polynucleotides with phosphorothioate backbones and oligonucleosides with other modified backbones, and in particular —$CH_2$—NH—$CH_2$—, —$CH_2$—N($CH_3$)—O—$CH_2$— [known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$— [wherein the native phosphodiester backbone is represented as —O—P(O)$_2$—O—$CH_2$—] of the above-referenced U.S. Pat. No. 5,489,677, and the amide backbones of the above-referenced U.S. Pat. No. 5,602,240. In some embodiments, the polynucletotides featured herein have morpholino backbone structures of the above-referenced U.S. Pat. No. 5,034,506.

Modifications at the 2' position may also aid in delivery. Preferably, modifications at the 2' position are not located in a polypeptide-coding sequence, i.e., not in a translatable region. Modifications at the 2' position may be located in a 5'UTR, a 3'UTR and/or a tailing region. Modifications at the 2' position can include one of the following at the 2' position: H (i.e., 2'-deoxy); F; O-, S-, or N-alkyl; O-, S-, or N-alkenyl; O-, S- or N-alkynyl; or O-alkyl-O-alkyl, wherein the alkyl, alkenyl and alkynyl may be substituted or unsubstituted $C_1$ to $C_{10}$ alkyl or $C_2$ to $C_{10}$ alkenyl and alkynyl. Exemplary suitable modifications include O[($CH_2$)$_n$O]$_m$$CH_3$, O($CH_2$)$_n$ O$CH_3$, O($CH_2$)$_n$$NH_2$, O($CH_2$)$_n$$CH_3$, O($CH_2$)$_n$O$NH_2$, and O($CH_2$)$_n$ON[($CH_2$)$_n$$CH_3$)]$_2$, where n and m are from 1 to about 10. In other embodiments, the polynucleotides include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, N3, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties, or a group for improving the pharmacodynamic properties, and other substituents having similar properties. In some embodiments, the modification includes a 2'-methoxyethoxy (2'-O-CH$_2$CH$_2$OCH$_3$, also known as 2'-O-(2-methoxyethyl) or 2'-MOE) (Martin et al., *Helv. Chim. Acta*, 1995, 78:486-504) i.e., an alkoxy-alkoxy group. Another exemplary modification is 2'-dimethylaminooxyethoxy, i.e., a O(CH$_2$)$_2$ON(CH$_3$)$_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—CH$_2$—O—CH$_2$—N(CH$_2$)$_2$, also described in examples herein below. Other modifications include 2'-methoxy (2'-OCH$_3$), 2'-aminopropoxy (2'-OCH$_2$CH$_2$CH$_2$NH$_2$) and 2'-fluoro (2'-F). Similar modifications may also be made at other positions, particularly the 3' position of the sugar on the 3' terminal nucleotide or in 2'-5' linked dsRNAs and the 5' position of 5' terminal nucleotide. Polynucleotides of the invention may also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920; the contents of each of which is herein incorporated by reference in their entirety.

In still other embodiments, the polynucleotide is covalently conjugated to a cell penetrating polypeptide. The cell-penetrating peptide may also include a signal sequence. The conjugates of the invention can be designed to have increased stability; increased cell transfection; and/or altered the biodistribution (e.g., targeted to specific tissues or cell types).

In one embodiment, the polynucleotides may be conjugated to an agent to enhance delivery. As a non-limiting example, the agent may be a monomer or polymer such as a targeting monomer or a polymer having targeting blocks as described in International Publication No. WO2011062965, herein incorporated by reference in its entirety. In another non-limiting example, the agent may be a transport agent covalently coupled to the polynucleotides of the present invention (See e.g., U.S. Pat. Nos. 6,835.393 and 7,374,778, each of which is herein incorporated by reference in its entirety). In yet another non-limiting example, the agent may be a membrane barrier transport enhancing agent such as those described in U.S. Pat. Nos. 7,737,108 and 8,003,129, each of which is herein incorporated by reference in its entirety.

In another embodiment, polynucleotides may be conjugated to SMARTT POLYMER TECHNOLOGY® (PHASERX®, Inc. Seattle, Wash.).

In another aspect, the conjugate may be a peptide that selectively directs the nanoparticle to neurons in a tissue or organism. As a non-limiting example, the peptide used may be, but is not limited to, the peptides described in US Patent Publication No US20130129627, herein incorporated by reference in its entirety.

In yet another aspect, the conjugate may be a peptide that can assist in crossing the blood-brain barrier.

Self-Assembled Nanoparticles

The polynucleotides described herein may be formulated in self-assembled nanoparticles. Nucleic acid self-assembled nanoparticles are described in International Patent Application No. PCT/US2014/027077, the contents of which are herein incorporated by reference in its entirety, such as in paragraphs [000740]-[000743]. Polymer-based self-assembled nanoparticles are described in International Patent Application No. PCT/US2014/027077, the contents of which are herein incorporated by reference in its entirety, such as in paragraphs [000744]-[000749].

Self-Assembled Macromolecules

The polynucleotides may be formulated in amphiphilic macromolecules (AMs) for delivery. AMs comprise biocompatible amphiphilic polymers which have an alkylated sugar backbone covalently linked to poly(ethylene glycol). In aqueous solution, the AMs self-assemble to form micelles. Non-limiting examples of methods of forming AMs and AMs are described in US Patent Publication No. US20130217753, the contents of which are herein incorporated by reference in its entirety.

Inorganic Nanoparticles

The polynucleotides of the present invention may be formulated in inorganic nanoparticles (U.S. Pat. No. 8,257,745, herein incorporated by reference in its entirety). The inorganic nanoparticles may include, but are not limited to, clay substances that are water swellable. As a non-limiting example, the inorganic nanoparticle may include synthetic smectite clays which are made from simple silicates (See e.g., U.S. Pat. Nos. 5,585,108 and 8,257,745 each of which are herein incorporated by reference in their entirety).

In one embodiment, the inorganic nanoparticles may comprise a core of the polynucleotides disclosed herein and a polymer shell. The polymer shell may be any of the polymers described herein and are known in the art. In an additional embodiment, the polymer shell may be used to protect the polynucleotides in the core.

Semi-conductive and Metallic Nanoparticles

The polynucleotides of the present invention may be formulated in water-dispersible nanoparticle comprising a semiconductive or metallic material (U.S. Pub. No. 20120228565; herein incorporated by reference in its entirety) or formed in a magnetic nanoparticle (U.S. Pub. No. 20120265001 and 20120283503; each of which is herein incorporated by reference in its entirety). The water-dispersible nanoparticles may be hydrophobic nanoparticles or hydrophilic nanoparticles.

In one embodiment, the semi-conductive and/or metallic nanoparticles may comprise a core of the polynucleotides disclosed herein and a polymer shell. The polymer shell may be any of the polymers described herein and are known in the art. In an additional embodiment, the polymer shell may be used to protect the polynucleotides in the core.

Surgical Sealants: Gels and Hydrogels

In one embodiment, the polynucleotides disclosed herein may be encapsulated into any hydrogel known in the art which may form a gel when injected into a subject. Surgical sealants such as gels and hydrogels are described in International Patent Application No. PCT/US2014/027077, the contents of which are herein incorporated by reference in its entirety, such as in paragraphs [000762]-[000809]. Suspension formulations In some embodiments, suspension formulations are provided comprising polynucleotides, water immiscible oil depots, surfactants and/or co-surfactants and/or co-solvents. Combinations of oils and surfactants may enable suspension formulation with polynucleotides. Delivery of polynucleotides in a water immiscible depot may be used to improve bioavailability through sustained release of mRNA from the depot to the surrounding physiologic environment and prevent polynucleotides degradation by nucleases.

In some embodiments, suspension formulations of mRNA may be prepared using combinations of polynucleotides, oil-based solutions and surfactants. Such formulations may be prepared as a two-part system comprising an aqueous phase comprising polynucleotides and an oil-based phase comprising oil and surfactants. Exemplary oils for suspension formulations may include, but are not limited to sesame oil and Miglyol (comprising esters of saturated coconut and palmkernel oil-derived caprylic and capric fatty acids and glycerin or propylene glycol), corn oil, soybean oil, peanut oil, beeswax and/or palm seed oil. Exemplary surfactants may include, but are not limited to Cremophor, polysorbate 20, polysorbate 80, polyethylene glycol, transcutol, Capmul®, labrasol, isopropyl myristate, and/or Span 80. In some embodiments, suspensions may comprise co-solvents including, but not limited to ethanol, glycerol and/or propylene glycol.

Suspensions may be formed by first preparing polynucleotides formulation comprising an aqueous solution of polynucleotide and an oil-based phase comprising one or more surfactants. Suspension formation occurs as a result of mixing the two phases (aqueous and oil-based). In some embodiments, such a suspension may be delivered to an aqueous phase to form an oil-in-water emulsion. In some embodiments, delivery of a suspension to an aqueous phase results in the formation of an oil-in-water emulsion in which the oil-based phase comprising polynucleotides forms droplets that may range in size from nanometer-sized droplets to micrometer-sized droplets. In some embodiments, specific combinations of oils, surfactants, cosurfactants and/or co-solvents may be utilized to suspend polynucleotides in the oil phase and/or to form oil-in-water emulsions upon delivery into an aqueous environment.

In some embodiments, suspensions may provide modulation of the release of polynucleotides into the surrounding environment. In such embodiments, polynucleotides release may be modulated by diffusion from a water immiscible depot followed by resolubilization into a surrounding environment (e.g. an aqueous environment).

In some embodiments, polynucleotides within a water immiscible depot (e.g. suspended within an oil phase) may result in altered polynucleotides stability (e.g. altered degradation by nucleases).

In some embodiments, polynucleotides may be formulated such that upon injection, an emulsion forms spontaneously (e.g. when delivered to an aqueous phase). Such particle formation may provide a high surface area to volume ratio for release of polynucleotides from an oil phase to an aqueous phase.

In one embodiment, the polynucleotides may be formulated in a nanoemulsion such as, but not limited to, the nanoemulsions described in U.S. Pat. No. 8,496,945, the contents of which are herein incorporated by reference in its entirety. The nanoemulsions may comprise nanoparticles described herein. As a non-limiting example, the nanoparticles may comprise a liquid hydrophobic core which may be surrounded or coated with a lipid or surfactant layer. The lipid or surfactant layer may comprise at least one membrane-integrating peptide and may also comprise a targeting ligand (see e.g., U.S. Pat. No. 8,496,945, the contents of which are herein incorporated by reference in its entirety).

Cations and Anions

Formulations of polynucleotides disclosed herein may include cations or anions. In one embodiment, the formulations include metal cations such as, but not limited to, $Zn^{2+}$, $Ca^{2+}$, $Cu^{2+}$, $Mg^+$ and combinations thereof. As a non-limiting example, formulations may include polymers and a polynucleotides complexed with a metal cation (See e.g., U.S. Pat. Nos. 6,265,389 and 6,555,525, each of which is herein incorporated by reference in its entirety).

In some embodiments, cationic nanoparticles comprising combinations of divalent and monovalent cations may be formulated with polynucleotides. Such nanoparticles may form spontaneously in solution over a give period (e.g. hours, days, etc). Such nanoparticles do not form in the presence of divalent cations alone or in the presence of monovalent cations alone. The delivery of polynucleotides in cationic nanoparticles or in one or more depot comprising cationic nanoparticles may improve polynucleotide bioavailability by acting as a long-acting depot and/or reducing the rate of degradation by nucleases.

Molded Nanoparticles and Microparticles

The polynucleotides disclosed herein may be formulated in nanoparticles and/or microparticles. These nanoparticles and/or microparticles may be molded into any size shape and chemistry. As an example, the nanoparticles and/or microparticles may be made using the PRINT® technology by LIQUIDA TECHNOLOGIES® (Morrisville, N.C.) (See e.g., International Pub. No. WO2007024323; the contents of which are herein incorporated by reference in its entirety).

In one embodiment, the molded nanoparticles may comprise a core of the polynucleotides disclosed herein and a polymer shell. The polymer shell may be any of the polymers described herein and are known in the art. In an additional embodiment, the polymer shell may be used to protect the polynucleotides in the core.

In one embodiment, the polynucleotides of the present invention may be formulated in microparticles. The microparticles may contain a core of the polynucleotides and a cortex of a biocompatible and/or biodegradable polymer. As a non-limiting example, the microparticles which may be used with the present invention may be those described in U.S. Pat. No. 8,460,709, U.S. Patent Publication No. US20130129830 and International Patent Publication No WO2013075068, each of which is herein incorporated by reference in its entirety. As another non-limiting example, the microparticles may be designed to extend the release of the polynucleotides of the present invention over a desired period of time (see e.g, extended release of a therapeutic protein in U.S. Patent Publication No. US20130129830, herein incorporated by reference in its entirety).

The microparticle for use with the present invention may have a diameter of at least 1 micron to at least 100 microns (e.g., at least 1 micron, at least 5 micron, at least 10 micron, at least 15 micron, at least 20 micron, at least 25 micron, at least 30 micron, at least 35 micron, at least 40 micron, at least 45 micron, at least 50 micron, at least 55 micron, at least 60 micron, at least 65 micron, at least 70 micron, at least 75 micron, at least 80 micron, at least 85 micron, at least 90 micron, at least 95 micron, at least 97 micron, at least 99 micron, and at least 100 micron).

NanoJackets and NanoLiposomes

The polynucleotides disclosed herein may be formulated in NanoJackets and NanoLiposomes by Keystone Nano (State College, Pa.). NanoJackets are made of compounds that are naturally found in the body including calcium, phosphate and may also include a small amount of silicates. Nanojackets may range in size from 5 to 50 nm and may be used to deliver hydrophilic and hydrophobic compounds such as, but not limited to, polynucleotides.

NanoLiposomes are made of lipids such as, but not limited to, lipids which naturally occur in the body. NanoLiposomes may range in size from 60-80 nm and may be used to deliver hydrophilic and hydrophobic compounds such as, but not limited to, polynucleotides. In one aspect, the polynucleotides disclosed herein are formulated in a NanoLiposome such as, but not limited to, Ceramide Nano-Liposomes.

Pseudovirions

In one embodiment, the polynucleotides disclosed herein may be formulated in Pseudovirions (e.g., pseudo-virions). As a non-limiting example, the pseudovirions may be those developed and/or are described by Aura Biosciences (Cambridge, Mass.). In one aspect, the pseudovirion may be developed to deliver drugs to keratinocytes and basal membranes (See e.g., US Patent Publication Nos. US20130012450, US20130012566, US21030012426 and US20120207840 and International Publication No. WO2013009717, each of which is herein incorporated by reference in its entirety).

In one embodiment, the pseudovirion used for delivering the polynucleotides of the present invention may be derived from viruses such as, but not limited to, herpes and papillomaviruses (See e.g., US Patent Publication Nos. US Patent Publication Nos. US20130012450, US20130012566, US21030012426 and US20120207840 and International Publication No. WO2013009717, each of which is herein incorporated by reference in its entirety; and Ma et al. HPV pseudovirions as DNA delivery vehicles. Ther Deliv. 2011: 2(4): 427-430; Kines et al. The initial steps leading to papillomavirus infection occur on the basement membrane prior to cell surface binding. PNAS 2009:106(48), 20458-20463; Roberts et al. Genital transmission of HPV in a mouse model is potentiated by nonoxynol-9 and inhibited by carrageenan. Nature Medicine. 2007:13(7) 857-861; Gordon et al., Targeting the Vaginal Mucosa with Human Papillomavirus Psedudovirion Vaccines delivering SIV DNA. J Immunol. 2012 188(2) 714-723; Cuburu et al., Intravaginal immunization with HPV vectors induces tissue-resident CD8+ T cell responses. The Journal of Clinical Investigation. 2012: 122(12) 4606-4620; Hung et al., Ovarian Cancer Gene Therapy Using HPV-16 Psedudovirion Carrying the HSV-tk Gene. PLoS ONE. 2012: 7(7) e40983; Johnson et al., Role of Heparan Sulfate in Attachment to and Infection of the Murine Femal Genital Tract by Human Papillomavirus. J Virology. 2009: 83(5) 2067-2074; each of which is herein incorporated by reference in its entirety).

The pseudovirion may be a virus-like particle (VLP) prepared by the methods described in US Patent Publication No. US20120015899 and US20130177587 and International Patent Publication No. WO2010047839 WO2013116656, WO2013106525 and WO2013122262, the contents of each of which is herein incorporated by reference in its entirety. In one aspect, the VLP may be, but is not limited to, bacteriophages MS, Qβ, R17, fr, GA, Sp, MI, I, MXI, NL95, AP205, f2, PP7, and the plant viruses Turnip crinkle virus (TCV), Tomato bushy stunt virus (TBSV), Southern bean mosaic virus (SBMV) and members of the genus Bromovirus including Broad bean mottle virus, Brome mosaic virus, Cassia yellow blotch virus, Cowpea chlorotic mottle virus (CCMV), Melandrium yellow fleck virus, and Spring beauty latent virus. In another aspect, the VLP may be derived from the influenza virus as described in US Patent Publication No. US20130177587 or U.S. Pat. No. 8,506,967, the contents of each of which are herein incorporated by reference in its entirety. In yet another aspect, the VLP may comprise a B7-1 and/or B7-2 molecule anchored to a lipid membrane or the exterior of the particle such as described in International Patent Publication No. WO2013116656, the contents of which are herein incorporated by reference in its entirety. In one aspect, the VLP may be derived from norovirus, rotavirus recombinant VP6 protein or double layered VP2/VP6 such as the VLP described in International Patent Publication No. WO2012049366, the contents of which are herein incorporated by reference in its entirety.

The pseudovirion may be a human papilloma virus-like particle such as, but not limited to, those described in International Publication No. WO2010120266 and US Patent Publication No. US20120171290, each of which is herein incorporated by reference in its entirety and Ma et al. HPV pseudovirions as DNA delivery vehicles. Ther Deliv. 2011: 2(4): 427-430; Kines et al. The initial steps leading to papillomavirus infection occur on the basement membrane prior to cell surface binding. PNAS 2009:106(48), 20458-20463; Roberts et al. Genital transmission of HPV in a mouse model is potentiated by nonoxynol-9 and inhibited by carrageenan. Nature Medicine. 2007:13(7) 857-861; Gordon et al., Targeting the Vaginal Mucosa with Human Papillomavirus Psedudovirion Vaccines delivering SIV DNA. J Immunol. 2012 188(2) 714-723; Cuburu et al., Intravaginal immunization with HPV vectors induces tissue-resident CD8+ T cell responses. The Journal of Clinical Investigation. 2012: 122(12) 4606-4620; Hung et al., Ovarian Cancer Gene Therapy Using HPV-16 Psedudovirion Carrying the HSV-tk Gene. PLoS ONE. 2012: 7(7) e40983; Johnson et al., Role of Heparan Sulfate in Attachment to and Infection of the Murine Femal Genital Tract by Human Papillomavirus. J Virology. 2009: 83(5) 2067-2074; each of which is herein incorporated by reference in its entirety.

In one aspect, the pseudovirions may be virion derived nanoparticles such as, but not limited to, those described in US Patent Publication No. US20130116408 and US20130115247, each of which is herein incorporated by reference in their entirety. As a non-limiting example, the virion derived nanoparticles may be used to deliver polynucleotides which may be used in the treatment for cancer and/or enhance the immune system's recognition of the tumor. As a non-limiting example, the virion-derived nanoparticle which may selectively deliver an agent to at least one tumor may be the papilloma-derived particles described in International Patent Publication No. WO2013119877, the contents of which are herein incorporated by reference in its entirety. The virion derived nanoparticles may be made by the methods described in US Patent Publication No. US20130116408 and US20130115247 or International Patent Publication No. WO2013119877, each of which is herein incorporated by reference in their entirety.

In one embodiment, the virus-like particle (VLP) may be a self-assembled particle. Non-limiting examples of self-assembled VLPs and methods of making the self-assembled VLPs are described in International Patent Publication No. WO2013122262, the contents of which are herein incorporated by reference in its entirety.

Minicells

In one aspect, the polynucleotides may be formulated in bacterial minicells. As a non-limiting example, bacterial minicells may be those described in International Publication No. WO2013088250 or US Patent Publication No. US20130177499, the contents of each of which are herein incorporated by reference in its entirety. The bacterial minicells comprising therapeutic agents such as polynucleotides described herein may be used to deliver the therapeutic agents to brain tumors.

Semi-Solid Compositions

In one embodiment, the polynucleotides may be formulated with a hydrophobic matrix to form a semi-solid composition. As a non-limiting example, the semi-solid composition or paste-like composition may be made by the methods described in International Patent Publication No WO201307604, herein incorporated by reference in its entirety. The semi-solid composition may be a sustained release formulation as described in International Patent Publication No WO201307604, herein incorporated by reference in its entirety.

In another embodiment, the semi-solid composition may further have a micro-porous membrane or a biodegradable polymer formed around the composition (see e.g., International Patent Publication No WO201307604, herein incorporated by reference in its entirety).

The semi-solid composition using the polynucleotides of the present invention may have the characteristics of the semi-solid mixture as described in International Patent Publication No WO201307604, herein incorporated by reference in its entirety (e.g., a modulus of elasticity of at least $10^{-4}$ N·mm$^{-2}$, and/or a viscosity of at least 100 mPa·s).

Exosomes

In one embodiment, the polynucleotides may be formulated in exosomes. The exosomes may be loaded with at least one polynucleotide and delivered to cells, tissues and/or organisms. As a non-limiting example, the polynucleotides may be loaded in the exosomes described in International Publication No. WO2013084000, herein incorporated by reference in its entirety.

Silk-Based Delivery

In one embodiment, the polynucleotides may be formulated in a sustained release silk-based delivery system. The silk-based delivery system may be formed by contacting a silk fibroin solution with a therapeutic agent such as, but not limited to, the polynucleotides described herein and/or known in the art. As a non-limiting example, the sustained release silk-based delivery system which may be used in the present invention and methods of making such system are described in US Patent Publication No. US20130177611, the contents of which are herein incorporated by reference in its entirety.

Microparticles

In one embodiment, formulations comprising polynucleotides may comprise microparticles. The microparticles may comprise a polymer described herein and/or known in the art such as, but not limited to, poly($\alpha$-hydroxy acid), a polyhydroxy butyric acid, a polycaprolactone, a polyorthoester and a polyanhydride. The microparticle may have adsorbent surfaces to adsorb biologically active molecules such as polynucleotides. As a non-limiting example microparticles for use with the present invention and methods of making microparticles are described in US Patent Publication No. US2013195923 and US20130195898 and U.S. Pat. Nos. 8,309,139 and 8,206,749, the contents of each of which are herein incorporated by reference in its entirety.

In another embodiment, the formulation may be a microemulsion comprising microparticles and polynucleotides. As a non-limiting example, microemulsions comprising microparticles are described in US Patent Publication No. US2013195923 and US20130195898 and U.S. Pat. Nos. 8,309,139 and 8,206,749, the contents of each of which are herein incorporated by reference in its entirety.

Amino Acid Lipids

In one embodiment, the polynucleotides may be formulated in amino acid lipids. Amino acid lipids are lipophilic compounds comprising an amino acid residue and one or more lipophilic tails. Non-limiting examples of amino acid lipids and methods of making amino acid lipids are described in U.S. Pat. No. 8,501,824, the contents of which are herein incorporated by reference in its entirety.

In one embodiment, the amino acid lipids have a hydrophilic portion and a lipophilic portion. The hydrophilic portion may be an amino acid residue and a lipophilic portion may comprise at least one lipophilic tail.

In one embodiment, the amino acid lipid formulations may be used to deliver the polynucleotides to a subject.

In another embodiment, the amino acid lipid formulations may deliver a polynucleotide in releasable form which comprises an amino acid lipid that binds and releases the polynucleotides. As a non-limiting example, the release of the polynucleotides may be provided by an acid-labile linker such as, but not limited to, those described in U.S. Pat. Nos. 7,098,032, 6,897,196, 6,426,086, 7,138,382, 5,563,250, and 5,505,931, the contents of each of which are herein incorporated by reference in its entirety.

Microvesicles

In one embodiment, polynucleotides may be formulated in microvesicles. Non-limiting examples of microvesicles include those described in US Patent Publication No. US20130209544, the contents of which are herein incorporated by reference in its entirety.

In one embodiment, the microvesicle is an ARRDC1-mediated microvesicles (ARMMs). Non-limiting examples of ARMMs and methods of making ARMMs are described in International Patent Publication No. WO2013119602, the contents of which are herein incorporated by reference in its entirety.

Interpolyelectrolyte Complexes

In one embodiment, the polynucleotides may be formulated in an interpolyelectrolyte complex. Interpolyelectrolyte complexes are formed when charge-dynamic polymers are complexed with one or more anionic molecules. Non-limiting examples of charge-dynamic polymers and interpolyelectrolyte complexes and methods of making interpolyelectrolyte complexes are described in U.S. Pat. No. 8,524,368, the contents of which is herein incorporated by reference in its entirety.

Crystalline Polymeric Systems

In one embodiment, the polynucleotides may be formulated in crystalline polymeric systems. Crystalline polymeric systems are polymers with crystalline moieties and/or terminal units comprising crystalline moieties. Non-limiting examples of polymers with crystalline moieties and/or terminal units comprising crystalline moieties termed "CYC polymers," crystalline polymer systems and methods of making such polymers and systems are described in U.S. Pat. No. 8,524,259, the contents of which are herein incorporated by reference in its entirety.

Excipients

Pharmaceutical formulations may additionally comprise a pharmaceutically acceptable excipient, which, as used herein, includes, but are not limited to, any and all solvents, dispersion media, diluents, or other liquid vehicles, dispersion or suspension aids, surface active agents, isotonic agents, thickening or emulsifying agents, preservatives, solid binders, lubricants, flavoring agents, stabilizers, antioxidants, osmolality adjusting agents, pH adjusting agents and the like, as suited to the particular dosage form desired. Various excipients for formulating pharmaceutical compositions and techniques for preparing the composition are known in the art (see *Remington: The Science and Practice of Pharmacy*, 21$^{st}$ Edition, A. R. Gennaro (Lippincott, Williams & Wilkins, Baltimore, Md., 2006; incorporated herein by reference in its entirety). The use of a conventional excipient medium may be contemplated within the scope of the present disclosure, except insofar as any conventional excipient medium is incompatible with a substance or its derivatives, such as by producing any undesirable biological effect or otherwise interacting in a deleterious manner with any other component(s) of the pharmaceutical composition, its use is contemplated to be within the scope of this invention.

In some embodiments, a pharmaceutically acceptable excipient may be at least 95%, at least 96%, at least 97%, at least 98%, at least 99%, or 100% pure. In some embodiments, an excipient is approved for use for humans and for veterinary use. In some embodiments, an excipient may be approved by United States Food and Drug Administration. In some embodiments, an excipient may be of pharmaceutical grade. In some embodiments, an excipient may meet the standards of the United States Pharmacopoeia (USP), the European Pharmacopoeia (EP), the British Pharmacopoeia, and/or the International Pharmacopoeia.

Pharmaceutically acceptable excipients used in the manufacture of pharmaceutical compositions include, but are not limited to, inert diluents, dispersing and/or granulating agents, surface active agents and/or emulsifiers, disintegrating agents, binding agents, preservatives, buffering agents, lubricating agents, and/or oils. Such excipients may optionally be included in pharmaceutical compositions. The composition may also include excipients such as cocoa butter and suppository waxes, coloring agents, coating agents, sweetening, flavoring, and/or perfuming agents.

Exemplary diluents include, but are not limited to, calcium carbonate, sodium carbonate, calcium phosphate, dicalcium phosphate, calcium sulfate, calcium hydrogen phosphate, sodium phosphate lactose, sucrose, cellulose, microcrystalline cellulose, kaolin, mannitol, sorbitol, inositol, sodium chloride, dry starch, cornstarch, powdered sugar, etc., and/or combinations thereof.

Exemplary granulating and/or dispersing agents include, but are not limited to, potato starch, corn starch, tapioca starch, sodium starch glycolate, clays, alginic acid, guar gum, citrus pulp, agar, bentonite, cellulose and wood products, natural sponge, cation-exchange resins, calcium carbonate, silicates, sodium carbonate, cross-linked poly(vinyl-pyrrolidone) (crospovidone), sodium carboxymethyl starch (sodium starch glycolate), carboxymethyl cellulose, cross-linked sodium carboxymethyl cellulose (croscarmellose), methylcellulose, pregelatinized starch (starch 1500), microcrystalline starch, water insoluble starch, calcium carboxymethyl cellulose, magnesium aluminum silicate) (VEEGUM®, sodium lauryl sulfate, quaternary ammonium compounds, etc., and/or combinations thereof.

Exemplary surface active agents and/or emulsifiers include, but are not limited to, natural emulsifiers (e.g. acacia, agar, alginic acid, sodium alginate, tragacanth, chondrux, cholesterol, xanthan, pectin, gelatin, egg yolk, casein, wool fat, cholesterol, wax, and lecithin), colloidal clays (e.g. bentonite [aluminum silicate] and VEEGUM® [magnesium aluminum silicate]), long chain amino acid derivatives, high molecular weight alcohols (e.g. stearyl alcohol, cetyl alcohol, oleyl alcohol, triacetin monostearate, ethylene glycol distearate, glyceryl monostearate, and propylene glycol monostearate, polyvinyl alcohol), carbomers (e.g. carboxy polymethylene, polyacrylic acid, acrylic acid polymer, and carboxyvinyl polymer), carrageenan, cellulosic derivatives (e.g. carboxymethylcellulose sodium, powdered cellulose, hydroxymethyl cellulose, hydroxypropyl cellulose, hydroxypropyl methylcellulose, methylcellulose), sorbitan fatty acid esters (e.g. polyoxyethylene sorbitan monolaurate [TWEEN® 20], polyoxyethylene sorbitan [TWEEN® 60], polyoxyethylene sorbitan monooleate [TWEEN® 80], sorbitan monopalmitate [SPAN® 40], sorbitan monostearate [SPAN® 60], sorbitan tristearate [SPAN® 65], glyceryl monooleate, sorbitan monooleate [SPAN® 80]), polyoxyethylene esters (e.g. polyoxyethylene monostearate [MYRJ® 45], polyoxyethylene hydrogenated castor oil, polyethoxylated castor oil, polyoxymethylene stearate, and SOLUTOL®), sucrose fatty acid esters, polyethylene glycol fatty acid esters (e.g.)CREMOPHOR®), polyoxyethylene ethers, (e.g. polyoxyethylene lauryl ether [BRIJ 30]), poly(vinyl-pyrrolidone), diethylene glycol monolaurate, triethanolamine oleate, sodium oleate, potassium oleate, ethyl oleate, oleic acid, ethyl laurate, sodium lauryl sulfate, PLUORINC® F 68, POLOXAMER®188, cetrimonium bromide, cetylpyridinium chloride, benzalkonium chloride, docusate sodium, etc. and/or combinations thereof.

Exemplary binding agents include, but are not limited to, starch (e.g. cornstarch and starch paste); gelatin; sugars (e.g. sucrose, glucose, dextrose, dextrin, molasses, lactose, lactitol, mannitol); amino acids (e.g., glycine); natural and synthetic gums (e.g. acacia, sodium alginate, extract of Irish moss, panwar gum, ghatti gum, mucilage of isapol husks, carboxymethylcellulose, methylcellulose, ethylcellulose, hydroxyethylcellulose, hydroxypropyl cellulose, hydroxypropyl methylcellulose, microcrystalline cellulose, cellulose acetate, poly(vinyl-pyrrolidone), magnesium aluminum silicate (VEEGUM®), and larch arabogalactan); alginates; polyethylene oxide; polyethylene glycol; inorganic calcium salts; silicic acid; polymethacrylates; waxes; water; alcohol; etc.; and combinations thereof.

Exemplary preservatives may include, but are not limited to, antioxidants, chelating agents, antimicrobial preservatives, antifungal preservatives, alcohol preservatives, acidic preservatives, and/or other preservatives. Oxidation is a potential degradation pathway for mRNA, especially for liquid mRNA formulations. In order to prevent oxidation, antioxidants can be added to the formulation. Exemplary antioxidants include, but are not limited to, alpha tocopherol, ascorbic acid, acorbyl palmitate, benzyl alcohol, butylated hydroxyanisole, EDTA, m-cresol, methionine, butylated hydroxytoluene, monothioglycerol, potassium metabisulfite, propionic acid, propyl gallate, sodium ascorbate, sodium bisulfite, sodium metabisulfite, thioglycerol and/or sodium sulfite. Exemplary chelating agents include ethylenediaminetetraacetic acid (EDTA), citric acid monohydrate, disodium edetate, dipotassium edetate, edetic acid, fumaric acid, malic acid, phosphoric acid, sodium edetate, tartaric acid, and/or trisodium edetate. Exemplary antimicrobial preservatives include, but are not limited to, benzalkonium chloride, benzethonium chloride, benzyl alcohol, bronopol, cetrimide, cetylpyridinium chloride, chlorhexidine, chlorobutanol, chlorocresol, chloroxylenol, cresol, ethyl alcohol, glycerin, hexetidine, imidurea, phenol, phenoxyethanol, phenylethyl alcohol, phenylmercuric nitrate, propylene glycol, and/or thimerosal. Exemplary antifungal preservatives include, but are not limited to, butyl paraben, methyl paraben, ethyl paraben, propyl paraben, benzoic acid, hydroxybenzoic acid, potassium benzoate, potassium sorbate, sodium benzoate, sodium propionate, and/or sorbic acid. Exemplary alcohol preservatives include, but are not limited to, ethanol, polyethylene glycol, phenol, phenolic compounds, bisphenol, chlorobutanol, hydroxybenzoate, and/or phenylethyl alcohol. Exemplary acidic preservatives include, but are not limited to, vitamin A, vitamin C, vitamin E, beta-carotene, citric acid, acetic acid, dehydroacetic acid, ascorbic acid, sorbic acid, and/or phytic acid. Other preservatives include, but are not limited to, tocopherol, tocopherol acetate, deteroxime mesylate, cetrimide, butylated hydroxyanisol (BHA), butylated hydroxytoluened (BHT), ethylenediamine, sodium lauryl sulfate (SLS), sodium lauryl ether sulfate (SLES), sodium bisulfite, sodium metabisulfite, potassium sulfite, potassium metabisulfite, GLYDANT PLUS®, PHENONIP®, methylparaben, GERMALL 115, GERMABEN®II, NEOLONE™, KATHON™, and/or EUXYL®.

In some embodiments, the pH of polynucleotide solutions are maintained between pH 5 and pH 8 to improve stability. Exemplary buffers to control pH may include, but are not limited to sodium phosphate, sodium citrate, sodium succinate, histidine (or histidine-HCl), sodium carbonate, and/or sodium malate. In another embodiment, the exemplary buffers listed above may be used with additional monovalent counterions (including, but not limited to potassium). Divalent cations may also be used as buffer counterions; however, these are not preferred due to complex formation and/or mRNA degradation.

Exemplary buffering agents may also include, but are not limited to, citrate buffer solutions, acetate buffer solutions, phosphate buffer solutions, ammonium chloride, calcium carbonate, calcium chloride, calcium citrate, calcium glubionate, calcium gluceptate, calcium gluconate, D-gluconic acid, calcium glycerophosphate, calcium lactate, propanoic acid, calcium levulinate, pentanoic acid, dibasic calcium phosphate, phosphoric acid, tribasic calcium phosphate, calcium hydroxide phosphate, potassium acetate, potassium chloride, potassium gluconate, potassium mixtures, dibasic potassium phosphate, monobasic potassium phosphate, potassium phosphate mixtures, sodium acetate, sodium bicarbonate, sodium chloride, sodium citrate, sodium lactate, dibasic sodium phosphate, monobasic sodium phosphate, sodium phosphate mixtures, tromethamine, magnesium hydroxide, aluminum hydroxide, alginic acid, pyrogen-free water, isotonic saline, Ringer's solution, ethyl alcohol, etc., and/or combinations thereof.

Exemplary lubricating agents include, but are not limited to, magnesium stearate, calcium stearate, stearic acid, silica, talc, malt, glyceryl behanate, hydrogenated vegetable oils, polyethylene glycol, sodium benzoate, sodium acetate, sodium chloride, leucine, magnesium lauryl sulfate, sodium lauryl sulfate, etc., and combinations thereof.

Exemplary oils include, but are not limited to, almond, apricot kernel, avocado, babassu, bergamot, black current seed, borage, cade, camomile, canola, caraway, carnauba, castor, cinnamon, cocoa butter, coconut, cod liver, coffee, corn, cotton seed, emu, eucalyptus, evening primrose, fish, flaxseed, geraniol, gourd, grape seed, hazel nut, hyssop, isopropyl myristate, jojoba, kukui nut, lavandin, lavender, lemon, litsea cubeba, macademia nut, mallow, mango seed, meadowfoam seed, mink, nutmeg, olive, orange, orange roughy, palm, palm kernel, peach kernel, peanut, poppy seed, pumpkin seed, rapeseed, rice bran, rosemary, safflower, sandalwood, sasquana, savoury, sea buckthorn, sesame, shea butter, silicone, soybean, sunflower, tea tree, thistle, tsubaki, vetiver, walnut, and wheat germ oils. Exemplary oils include, but are not limited to, butyl stearate, caprylic triglyceride, capric triglyceride, cyclomethicone, diethyl sebacate, dimethicone 360, isopropyl myristate, mineral oil, octyldodecanol, oleyl alcohol, silicone oil, and/or combinations thereof.

Excipients such as cocoa butter and suppository waxes, coloring agents, coating agents, sweetening, flavoring, and/or perfuming agents can be present in the composition, according to the judgment of the formulator.

Exemplary additives include physiologically biocompatible buffers (e.g., trimethylamine hydrochloride), addition of chelants (such as, for example, DTPA or DTPA-bisamide) or calcium chelate complexes (as for example calcium DTPA, CaNaDTPA-bisamide), or, optionally, additions of calcium or sodium salts (for example, calcium chloride, calcium ascorbate, calcium gluconate or calcium lactate). In addition, antioxidants and suspending agents can be used.

Cryoprotectants for mRNA

In some embodiments, polynucleotide formulations may comprise cyroprotectants. As used herein, there term "cryoprotectant" refers to one or more agent that when combined with a given substance, helps to reduce or eliminate damage to that substance that occurs upon freezing. In some embodiments, cryoprotectants are combined with polynucleotides in order to stabilize them during freezing. Frozen storage of mRNA between $-20°$ C. and $-80°$ C. may be advantageous for long term (e.g. 36 months) stability of polynucleotide. In some embodiments, cryoprotectants are included in polynucleotide formulations to stabilize polynucleotide through freeze/thaw cycles and under frozen storage conditions. Cryoprotectants of the present invention may include, but are not limited to sucrose, trehalose, lactose, glycerol, dextrose, raffinose and/or mannitol. Trehalose is listed by the Food and Drug Administration as being generally regarded as safe (GRAS) and is commonly used in commercial pharmaceutical formulations.

Bulking Agents

In some embodiments, polynucleotide formulations may comprise bulking agents. As used herein, the term "bulking agent" refers to one or more agents included in formulations to impart a desired consistency to the formulation and/or stabilization of formulation components. In some embodiments, bulking agents are included in lyophilized polynucleotide formulations to yield a "pharmaceutically elegant" cake, stabilizing the lyophilized polynucleotides during long term (e.g. 36 month) storage. Bulking agents of the present invention may include, but are not limited to sucrose, trehalose, mannitol, glycine, lactose and/or raffinose. In some embodiments, combinations of cryoprotectants and bulking agents (for example, sucrose/glycine or trehalose/mannitol) may be included to both stabilize polynucleotides during freezing and provide a bulking agent for lyophilization.

Non-limiting examples of formulations and methods for formulating the polynucleotides of the present invention are also provided in International Publication No WO2013090648 filed Dec. 14, 2012, the contents of which are incorporated herein by reference in their entirety.

Inactive Ingredients

In some embodiments, polynucleotide formulations may comprise at least one excipient which is an inactive ingredient. As used herein, ther term "inactive ingredient" refers to one or more inactive agents included in formulations. In some embodiments, all, none or some of the inactive ingredients which may be used in the formulations of the present invention may be approved by the US Food and Drug Administration (FDA). A non-exhaustive list of inactive ingredients and the routes of administration the inactive ingredients may be formulated in are described in Table 4 of co-pending International Application No. PCT/US2014/027077.

Delivery

The present disclosure encompasses the delivery of polynucleotides for any of therapeutic, pharmaceutical, diagnostic or imaging by any appropriate route taking into consideration likely advances in the sciences of drug delivery. Delivery may be naked or formulated.

Naked Delivery

The polynucleotides of the present invention may be delivered to a cell naked. As used herein in, "naked" refers to delivering polynucleotides free from agents which promote transfection. For example, the polynucleotides delivered to the cell may contain no modifications. The naked polynucleotides may be delivered to the cell using routes of administration known in the art and described herein.

Formulated Delivery

The polynucleotides of the present invention may be formulated, using the methods described herein. The formulations may contain polynucleotides which may be modified and/or unmodified. The formulations may further include, but are not limited to, cell penetration agents, a pharmaceutically acceptable carrier, a delivery agent, a bioerodible or biocompatible polymer, a solvent, and a sustained-release delivery depot. The formulated polynucleotides may be delivered to the cell using routes of administration known in the art and described herein.

The compositions may also be formulated for direct delivery to an organ or tissue in any of several ways in the art including, but not limited to, direct soaking or bathing, via a catheter, by gels, powder, ointments, creams, gels, lotions, and/or drops, by using substrates such as fabric or biodegradable materials coated or impregnated with the compositions, and the like.

Administration

The polynucleotides of the present invention may be administered by any route which results in a therapeutically effective outcome. These include, but are not limited to enteral (into the intestine), gastroenteral, epidural (into the dura matter), oral (by way of the mouth), transdermal, peridural, intracerebral (into the cerebrum), intracerebroventricular (into the cerebral ventricles), epicutaneous (application onto the skin), intradermal, (into the skin itself), subcutaneous (under the skin), nasal administration (through the nose), intravenous (into a vein), intravenous bolus, intravenous drip, intraarterial (into an artery), intramuscular (into a muscle), intracardiac (into the heart), intraosseous infusion (into the bone marrow), intrathecal (into the spinal canal), intraperitoneal, (infusion or injection into the peritoneum), intravesical infusion, intravitreal, (through the eye), intracavernous injection (into a pathologic cavity) intracavitary (into the base of the penis), intravaginal administration, intrauterine, extra-amniotic administration, transdermal (diffusion through the intact skin for systemic distribution), transmucosal (diffusion through a mucous membrane), transvaginal, insufflation (snorting), sublingual, sublabial, enema, eye drops (onto the conjunctiva), in ear drops, auricular (in or by way of the ear), buccal (directed toward the cheek), conjunctival, cutaneous, dental (to a tooth or teeth), electro-osmosis, endocervical, endosinusial, endotracheal, extracorporeal, hemodialysis, infiltration, interstitial, intra-abdominal, intra-amniotic, intra-articular, intrabiliary, intrabronchial, intrabursal, intracartilaginous (within a cartilage), intracaudal (within the cauda equine), intracisternal (within the cisterna magna cerebellomedullaris), intracorneal (within the cornea), dental intracornal, intracoronary (within the coronary arteries), intracorporus cavernosum (within the dilatable spaces of the corporus cavernosa of the penis), intradiscal (within a disc), intraductal (within a duct of a gland), intraduodenal (within the duodenum), intradural (within or beneath the dura), intraepidermal (to the epidermis), intraesophageal (to the esophagus), intragastric (within the stomach), intragingival (within the gingivae), intraileal (within the distal portion of the small intestine), intralesional (within or introduced directly to a localized lesion), intraluminal (within a lumen of a tube), intralymphatic (within the lymph), intramedullary (within the marrow cavity of a bone), intrameningeal (within the meninges), intraocular (within the eye), intraovarian (within the ovary), intrapericardial (within the pericardium), intrapleural (within the pleura), intraprostatic (within the prostate gland), intrapulmonary (within the lungs or its bronchi), intrasinal (within the nasal or periorbital sinuses), intraspinal (within the vertebral column), intrasynovial (within the synovial cavity of a joint), intratendinous (within a tendon), intratesticular (within the testicle), intrathecal (within the cerebrospinal fluid at any level of the cerebrospinal axis), intrathoracic (within the thorax), intratubular (within the tubules of an organ), intratumor (within a tumor), intratympanic (within the aurus media), intravascular (within a vessel or vessels), intraventricular (within a ventricle), iontophoresis (by means of electric current where ions of soluble salts migrate into the tissues of the body), irrigation (to bathe or flush open wounds or body cavities), laryngeal (directly upon the larynx), nasogastric (through the nose and into the stomach), occlusive dressing technique (topical route administration which is then covered by a dressing which occludes the area), ophthalmic (to the external eye), oropharyngeal (directly to the mouth and pharynx), parenteral, percutaneous, periarticular, peridural, perineural, periodontal, rectal, respiratory (within the respiratory tract by inhaling orally or nasally for local or systemic effect), retrobulbar (behind the pons or behind the eyeball), intramyocardial (entering the myocardium), soft tissue, subarachnoid, subconjunctival, submucosal, topical, transplacental (through or across the placenta), transtracheal (through the wall of the trachea), transtympanic (across or through the tympanic cavity), ureteral (to the ureter), urethral (to the urethra), vaginal, caudal block, diagnostic, nerve block, biliary perfusion, cardiac perfusion, photopheresis or spinal. In specific embodiments, compositions may be administered in a way which allows them cross the blood-brain barrier, vascular barrier, or other epithelial barrier. In one embodiment, a formulation for a route of administration may include at least one inactive ingredient. Non-limiting examples of routes of administration and inactive ingredients which may be included in formulations for the specific route of administration is shown in Table 9. In Table 9, "AN" means anesthetic, "CNBLK" means cervical nerve block, "NBLK" means nerve block, "IV" means intravenous, "TM" means intramuscular and "SC" means subcutaneous.

TABLE 9

Routes of Adminsitration and Inactive Ingredients

| Route of Administration | Inactive Ingredient |
|---|---|
| Intrathecal (AN, CNBLK) | Acetone Sodium Bisulfite; Citric Acid; Hydrochloric Acid; Sodium Chloride; Sodium Hydroxide; Sodium Metabisulfite |
| Infiltration (AN) | Acetic Acid; Acetone Sodium Bisulfite; Ascorbic Acid; Benzyl Alcohol; Calcium Chloride; Carbon Dioxide; Chlorobutanol; Citric Acid; Citric Acid Monohydrate; Edetate Calcium Disodium; Edetate Disodium; Hydrochloric Acid; Hydrochloric Acid, Diluted; Lactic Acid; Methylparaben; Monothioglycerol; Nitrogen; Potassium Chloride; Potassium Metabisulfite; Potassium Phosphate, Monobasic; Propylparaben; Sodium Bisulfite; Sodium Carbonate; Sodium Chlorate; Sodium |

TABLE 9-continued

Routes of Adminsitration and Inactive Ingredients

| Route of Administration | Inactive Ingredient |
|---|---|
| | Chloride; Sodium Citrate; Sodium Hydroxide; Sodium Lactate; Sodium Metabisulfite; Sodium Phosphate, Dibasic, Heptahydrate |
| Sympathetic NBLK (AN) | Hydrochloric Acid; Sodium Chloride; Sodium Hydroxide |
| Auricular (Otic) | Acetic Acid; Aluminum Acetate; Aluminum Sulfate Anhydrous; Benzalkonium Chloride; Benzethonium Chloride; Benzyl Alcohol; Boric Acid; Calcium Carbonate; Cetyl Alcohol; Chlorobutanol; Chloroxylenol; Citric Acid; Creatinine; Cupric Sulfate; Cupric Sulfate Anhydrous; Edetate Disodium; Edetic Acid; Glycerin; Glyceryl Stearate; Hydrochloric Acid; Hydrocortisone; Hydroxyethyl Cellulose; Isopropyl Myristate; Lactic Acid; Lecithin, Hydrogenated; Methylparaben; Mineral Oil; Petrolatum; Petrolatum, White; Phenylethyl Alcohol; Polyoxyl 40 Stearate; Polyoxyl Stearate; Polysorbate 20; Polysorbate 80; Polyvinyl Alcohol; Potassium Metabisulfite; Potassium Phosphate, Monobasic; Povidone K90f; Povidones; Propylene Glycol; Propylene Glycol Diacetate; Propylparaben; Sodium Acetate; Sodium Bisulfite; Sodium Borate; Sodium Chloride; Sodium Citrate; Sodium Hydroxide; Sodium Phosphate, Dibasic, Anhydrous; Sodium Phosphate, Dibasic, Heptahydrate; Sodium Phosphate, Monobasic, Anhydrous; Sodium Sulfite; Sulfuric Acid; Thimerosal |
| Caudal Block | Ascorbic Acid; Calcium Chloride; Citric Acid; Edetate Calcium Disodium; Edetate Disodium; Hydrochloric Acid; Methylparaben; Monothioglycerol; Nitrogen; Potassium Chloride; Sodium Chloride; Sodium Hydroxide; Sodium Lactate; Sodium Metabisulfite |
| Dental | Acetone Sodium Bisulfite; Alcohol; Alcohol, Dehydrated; Alcohol, Denatured; Anethole; Benzyl Alcohol; Carboxymethylcellulose Sodium; Carrageenan; D&C Yellow No. 10; Dimethicone Medical Fluid 360; Eucalyptol; Fd&C Blue No. 1; Fd&C Green No. 3; Flavor 89-186; Flavor 89-259; Flavor Df-119; Flavor Df-1530; Flavor Enhancer; Gelatin; Gelatin, Crosslinked; Glycerin; Glyceryl Stearate; High Density Polyethylene; Hydrocarbon Gel, Plasticized; Hydrochloric Acid; Menthol; Mineral Oil; Nitrogen; Pectin; Peg-40 Sorbitan Diisostearate; Peppermint Oil; Petrolatum, White; Plastibase-50w; Polyethylene Glycol 1540; Polyglactin; Polyols; Polyoxyl 40 Hydrogenated Castor Oil; Polyoxyl 40 Stearate; Propylene Glycol; Pvm/Ma Copolymer; Saccharin Sodium; Silica, Dental; Silicon Dioxide; Sodium Benzoate; Sodium Chloride; Sodium Hydroxide; Sodium Lauryl Sulfate; Sodium Metabisulfite; Sorbitol; Titanium Dioxide |
| Diagnostic | Hydrochloric Acid |
| Endocervical | Colloidal Silicon Dioxide; Triacetin |
| Epidural | 1,2-Dioleoyl-Sn-Glycero-3-Phosphocholine; 1,2-Dipalmitoyl-Sn-Glycero-3-(Phospho-Rac-(1-Glycerol)); Ascorbic Acid; Benzyl Alcohol; Calcium Chloride; Cholesterol; Citric Acid; Edetate Calcium Disodium; Edetate Disodium; Glyceryl Trioleate; Hydrochloric Acid; Isotonic Sodium Chloride Solution; Methylparaben; Monothioglycerol; Nitrogen; Potassium Chloride; Sodium Bisulfite; Sodium Chloride; Sodium Citrate; Sodium Hydroxide; Sodium Lactate, L-; Sodium Metabisulfite; Sodium Sulfite; Sulfuric Acid; Tricaprylin |
| Extracorporeal | Acetic Acid; Alcohol, Dehydrated; Benzyl Alcohol; Hydrochloric Acid; Propylene Glycol; Sodium Acetate; Sodium Chloride; Sodium Hydroxide |
| Intramuscular-Intravenous | Acetic Acid; Alcohol; Alcohol, Dehydrated; Alcohol, Diluted; Anhydrous Dextrose; Anhydrous Lactose; Anhydrous Trisodium Citrate; Arginine; Ascorbic Acid; Benzethonium Chloride; Benzoic Acid; Benzyl Alcohol; Calcium Chloride; Carbon Dioxide; Chlorobutanol; Citric Acid; Citric Acid Monohydrate; Creatinine; Dextrose; Edetate Calcium Disodium; Edetate Disodium; Edetate Sodium; Gluconolactone; Glycerin; Hydrochloric Acid; Hydrochloric Acid, Diluted; Lactic Acid; Lactic Acid, Dl-; Lactose; Lactose Monohydrate; Lactose, Hydrous; Lysine; Mannitol; Methylparaben; Monothioglycerol; Niacinamide; Nitrogen; Phenol; Phenol, Liquefied; Phosphoric Acid; Polyethylene Glycol 300; Polyethylene Glycol 400; Polypropylene Glycol; Polysorbate 40; Potassium Metabisulfite; Potassium Phosphate, Monobasic; Propylene Glycol; Propylparaben; Saccharin Sodium; Saccharin Sodium Anhydrous; Silicone; Simethicone; Sodium Acetate; Sodium Acetate Anhydrous; Sodium Benzoate; Sodium Bicarbonate; Sodium Bisulfate; Sodium Bisulfate; Sodium Carbonate; Sodium Chloride; Sodium Citrate; Sodium Formaldehyde Sulfoxylate; Sodium Hydroxide; Sodium Lactate, L-; Sodium Metabisulfite; Sodium Phosphate; Sodium Phosphate, Dibasic; Sodium Phosphate, Dibasic, Anhydrous; Sodium Phosphate, Dibasic, Dihydrate; Sodium Phosphate, Dibasic, Heptahydrate; Sodium Phosphate, Monobasic; Sodium Phosphate, Monobasic, Anhydrous; Sodium Phosphate, Monobasic, Monohydrate; Sodium Sulfate; Sodium Sulfite; Sodium Tartrate; Sodium Thiomalate; Succinic Acid; Sulfuric Acid; Tartaric Acid, Dl-; Thimerosal; Trisodium Citrate Dihydrate; Tromethamine |
| Intramuscular-Intravenous-Subcutaneous | Acetic Acid; Alcohol; Alcohol, Dehydrated; Benzyl Alcohol; Chlorobutanol; Citric Acid; Citric Acid Monohydrate; Citric Acid, Hydrous; Creatinine; Dextrose; Edetate Disodium; Edetate Sodium; Gelatin; Glycerin; Glycine; Hydrochloric Acid; Hydrochloric Acid, Diluted; Lactic Acid; Lactose; Lactose Monohydrate; Metacresol; Methanesulfonic Acid; Methylparaben; Monothioglycerol; Nitrogen; Phenol; Phosphoric Acid; Polyoxyethylene Fatty Acid Esters; Propylparaben; Sodium Acetate; Sodium Bisulfate; Sodium Bisulfate; Sodium Chloride; Sodium |

TABLE 9-continued

Routes of Adminsitration and Inactive Ingredients

| Route of Administration | Inactive Ingredient |
|---|---|
| Intramuscular - Subcutaneous | Citrate; Sodium Dithionite; Sodium Hydroxide; Sodium Lactate; Sodium Lactate, L-; Sodium Metabisulfite; Sodium Phosphate, Dibasic, Heptahydrate; Thimerosal Acetic Acid; Anhydrous Dextrose; Benzyl Alcohol; Chlorobutanol; Citric Acid; Cysteine; Edetate Disodium; Gelatin; Glycerin; Glycine; Hydrochloric Acid; Lactose Monohydrate; Mannitol; Metacresol; Methylparaben; Nitrogen; Peg Vegetable Oil; Peg-40 Castor Oil; Phenol; Phenol, Liquefied; Phosphoric Acid; Polyoxyethylene Fatty Acid Esters; Polysorbate 20; Propylparaben; Protamine Sulfate; Sesame Oil; Sodium Acetate; Sodium Acetate Anhydrous; Sodium Chloride; Sodium Citrate; Sodium Formaldehyde Sulfoxylate; Sodium Hydroxide; Sodium Phosphate Dihydrate; Sodium Phosphate, Dibasic, Heptahydrate; Sulfuric Acid; Thimerosal; Zinc Chloride; Zinc Oxide |
| Implantation | Acetone; Crospovidone; Dimethylsiloxane/Methylvinylsiloxane Copolymer; Ethylene Vinyl Acetate Copolymer; Magnesium Stearate; Poly(Bis(P-Carboxyphenoxy)Propane Anhydride):Sebacic Acid; Polyglactin; Silastic Brand Medical Grade Tubing; Silastic Medical Adhesive, Silicone Type A; Stearic Acid |
| Infiltration | Cholesterol; Citric Acid; Diethyl Pyrocarbonate; Dipalmitoylphosphatidylglycerol, Dl-; Hydrochloric Acid; Nitrogen; Phosphoric Acid; Sodium Chloride; Sodium Hydroxide; Sodium Metabisulfite; Tricaprylin |
| Inhalation | Acetone Sodium Bisulfate; Acetylcysteine; Alcohol; Alcohol, Dehydrated; Ammonia; Ascorbic Acid; Benzalkonium Chloride; Carbon Dioxide; Cetylpyridinium Chloride; Chlorobutanol; Citric Acid; D&C Yellow No. 10; Dichlorodifluoromethane; Dichlorotetrafluoroethane; Edetate Disodium; Edetate Sodium; Fd&C Yellow No. 6; Fluorochlorohydrocarbons; Glycerin; Hydrochloric Acid; Hydrochloric Acid, Diluted; Lactose; Lecithin; Lecithin, Hydrogenated Soy; Lecithin, Soybean; Menthol; Methylparaben; Nitric Acid; Nitrogen; Norflurane; Oleic Acid; Propylene Glycol; Propylparaben; Saccharin; Saccharin Sodium; Sodium Bisulfate; Sodium Bisulfate; Sodium Chloride; Sodium Citrate; Sodium Hydroxide; Sodium Metabisulfite; Sodium Sulfate Anhydrous; Sodium Sulfite; Sorbitan Trioleate; Sulfuric Acid; Thymol; Trichloromonofluoromethane |
| Interstitial | Benzyl Alcohol; Dextrose; Hydrochloric Acid; Sodium Acetate; Sodium Hydroxide |
| Intra-amniotic | Citric Acid; Edetate Disodium Anhydrous; Hydrochloric Acid; Sodium Hydroxide |
| Intra-arterial | Anhydrous Trisodium Citrate; Benzyl Alcohol; Carbon Dioxide; Citric Acid; Diatrizoic Acid; Edetate Calcium Disodium; Edetate Disodium; Hydrochloric Acid; Hydrochloric Acid, Diluted; Iodine; Meglumine; Methylparaben; Nitrogen; Propylparaben; Sodium Bisulfite; Sodium Carbonate; Sodium Carbonate Monohydrate; Sodium Chloride; Sodium Citrate; Sodium Hydroxide; Tromethamine |
| Intra-articular | Acetic Acid; Anhydrous Trisodium Citrate; Benzalkonium Chloride; Benzyl Alcohol; Carboxymethylcellulose; Carboxymethylcellulose Sodium; Cellulose, Microcrystalline; Citric Acid; Creatine; Creatinine; Crospovidone; Diatrizoic Acid; Edetate Calcium Disodium; Edetate Disodium; Hyaluronate Sodium; Hydrochloric Acid; Iodine; Meglumine; Methylcelluloses; Methylparaben; Myristyl-.Gamma.-Picolinium Chloride; Niacinamide; Phenol; Phosphoric Acid; Polyethylene Glycol 3350; Polyethylene Glycol 4000; Polysorbate 80; Potassium Phosphate, Dibasic; Potassium Phosphate, Monobasic; Propylparaben; Sodium Acetate; Sodium Bisulfite; Sodium Chloride; Sodium Citrate; Sodium Hydroxide; Sodium Metabisulfite; Sodium Phosphate; Sodium Phosphate, Dibasic, Anhydrous; Sodium Phosphate, Dibasic, Heptahydrate; Sodium Phosphate, Monobasic, Anhydrous; Sodium Phosphate, Monobasic, Monohydrate; Sodium Sulfite; Sorbitol; Sorbitol Solution |
| Intrabursal | Anhydrous Trisodium Citrate; Benzalkonium Chloride; Benzyl Alcohol; Carboxymethylcellulose; Carboxymethylcellulose Sodium; Citric Acid; Creatinine; Edetate Disodium; Hydrochloric Acid; Methylparaben; Polysorbate 80; Propylparaben; Sodium Bisulfite; Sodium Chloride; Sodium Hydroxide; Sodium Metabisulfite; Sodium Phosphate; Sodium Phosphate, Dibasic, Heptahydrate; Sodium Phosphate, Monobasic, Anhydrous |
| Intracardiac | Carbon Dioxide; Citric Acid; Citric Acid Monohydrate; Diatrizoic Acid; Edetate Calcium Disodium; Edetate Disodium; Hydrochloric Acid; Iodine; Lactic Acid; Meglumine; Sodium Bisulfite; Sodium Carbonate Monohydrate; Sodium Chloride; Sodium Citrate; Sodium Hydroxide; Sodium Lactate; Sodium Lactate, L-; Sodium Metabisulfite |
| Intracaudal | Hydrochloric Acid; Sodium Chloride; Sodium Hydroxide |
| Intracavitary | Alcohol, Dehydrated; Alfadex; Anhydrous Lactose; Benzyl Alcohol; Dextrose; Hydrochloric Acid; Lactose; Lactose Monohydrate; Nitrogen; Sodium Acetate; Sodium Chloride; Sodium Citrate; Sodium Hydroxide |
| Intradermal | Benzalkonium Chloride; Benzyl Alcohol; Carboxymethylcellulose Sodium; Creatinine; Edetate Disodium; Glycerin; Hydrochloric Acid; Metacresol; Methylparaben; Phenol; Polysorbate 80; Protamine Sulfate; Sodium Acetate; Sodium Bisulfite; Sodium Chloride; Sodium Hydroxide; Sodium Phosphate; Sodium Phosphate, Dibasic; Sodium Phosphate, Dibasic, Heptahydrate; Sodium Phosphate, Monobasic, Anhydrous; Zinc Chloride |
| Intradiscal | Cysteine Hydrochloride Anhydrous; Cysteine, Dl-; Diatrizoic Acid; Edetate Calcium Disodium; Edetate Disodium; Iodine; Meglumine; Sodium Bisulfite; Sodium Hydroxide |
| Intralesional | Acetic Acid; Benzalkonium Chloride; Benzyl Alcohol; Carboxymethylcellulose; Carboxymethylcellulose Sodium; Citric Acid; Creatine; Creatinine; Edetate |

TABLE 9-continued

Routes of Adminsitration and Inactive Ingredients

| Route of Administration | Inactive Ingredient |
|---|---|
| | Disodium; Hydrochloric Acid; Methylcelluloses; Methylparaben; Myristyl-.Gamma.-Picolinium Chloride; Niacinamide; Phenol; Phosphoric Acid; Polyethylene Glycol 3350; Polyethylene Glycol 4000; Polysorbate 80; Propylparaben; Sodium Acetate; Sodium Bisulfite; Sodium Chloride; Sodium Citrate; Sodium Hydroxide; Sodium Phosphate; Sodium Phosphate, Dibasic; Sodium Phosphate, Dibasic, Anhydrous; Sodium Phosphate, Dibasic, Heptahydrate; Sodium Phosphate, Monobasic; Sodium Phosphate, Monobasic, Anhydrous; Sodium Phosphate, Monobasic, Monohydrate; Sodium Sulfite; Sorbitol; Sorbitol Solution |
| Intralymphatic | Poppy Seed Oil |
| Intramuscular | Acetic Acid; Activated Charcoal; Adipic Acid; Alcohol; Alcohol, Dehydrated; Ammonium Acetate; Anhydrous Dextrose; Ascorbic Acid; Benzalkonium Chloride; Benzethonium Chloride; Benzoic Acid; Benzyl Alcohol; Benzyl Benzoate; Butylated Hydroxyanisole; Butylated Hydroxytoluene; Butylparaben; Calcium; Calcium Chloride; Carbon Dioxide; Carboxymethylcellulose; Carboxymethylcellulose Sodium; Castor Oil; Cellulose, Microcrystalline; Chlorobutanol; Chlorobutanol Hemihydrate; Chlorobutanol, Anhydrous; Citric Acid; Citric Acid Monohydrate; Corn Oil; Cottonseed Oil; Creatine; Creatinine; Croscarmellose Sodium; Crospovidone; Dextrose; Diatrizoic Acid; Docusate Sodium; Edetate Calcium Disodium; Edetate Disodium; Edetate Disodium Anhydrous; Edetate Sodium; Ethyl Acetate; Gelatin; Glutathione; Glycerin; Glycine; Hyaluronate Sodium; Hydrochloric Acid; Hydroxide Ion; Lactic Acid; Lactic Acid, Dl-; Lactose; Lactose Monohydrate; Lactose, Hydrous; Lecithin; Magnesium Chloride; Maleic Acid; Mannitol; Meglumine; Metacresol; Methionine; Methylcelluloses; Methylparaben; Monothioglycerol; Myristyl-.Gamma.-Picolinium Chloride; N,N-Dimethylacetamide; Niacinamide; Nitrogen; Peanut Oil; Peg-20 Sorbitan Isostearate; Phenol; Phenylmercuric Nitrate; Phosphoric Acid; Polyethylene Glycol 200; Polyethylene Glycol 300; Polyethylene Glycol 3350; Polyethylene Glycol 4000; Polyglactin; Polylactide; Polysorbate 20; Polysorbate 40; Polysorbate 80; Polyvinyl Alcohol; Potassium Phosphate, Dibasic; Potassium Phosphate, Monobasic; Povidones; Propyl Gallate; Propylene Glycol; Propylparaben; Saccharin Sodium; Saccharin Sodium Anhydrous; Sesame Oil; Sodium Acetate; Sodium Acetate Anhydrous; Sodium Benzoate; Sodium Bicarbonate; Sodium Bisulfite; Sodium Carbonate; Sodium Chlorate; Sodium Chloride; Sodium Chloride Injection; Sodium Citrate; Sodium Formaldehyde Sulfoxylate; Sodium Hydroxide; Sodium Metabisulfite; Sodium Phosphate; Sodium Phosphate, Dibasic; Sodium Phosphate, Dibasic, Anhydrous; Sodium Phosphate, Dibasic, Heptahydrate; Sodium Phosphate, Monobasic; Sodium Phosphate, Monobasic, Anhydrous; Sodium Phosphate, Monobasic, Monohydrate; Sodium Sulfate Anhydrous; Sodium Sulfite; Sodium Tartrate; Sorbitan Monopalmitate; Sorbitol; Sorbitol Solution; Starch; Sucrose; Sulfobutylether .Beta.-Cyclodextrin; Sulfuric Acid; Sulfurous Acid; Tartaric Acid; Thimerosal; Tromantadine; Tromethamine; Urea |
| Intraocular | Benzalkonium Chloride; Calcium Chloride; Citric Acid Monohydrate; Hydrochloric Acid; Magnesium Chloride; Polyvinyl Alcohol; Potassium Chloride; Sodium Acetate; Sodium Chloride; Sodium Citrate; Sodium Hydroxide |
| Intraperitoneal | Benzyl Alcohol; Calcium Chloride; Dextrose; Edetate Calcium Disodium; Hydrochloric Acid; Magnesium Chloride; Sodium Acetate; Sodium Bicarbonate; Sodium Bisulfite; Sodium Carbonate; Sodium Chloride; Sodium Citrate; Sodium Hydroxide; Sodium Lactate; Sodium Metabisulfite; Sulfuric Acid |
| Intrapleural | Benzyl Alcohol; Citric Acid; Dextrose; Dichlorodifluoromethane; Hydrochloric Acid; Sodium Acetate; Sodium Carbonate; Sodium Chloride; Sodium Citrate; Sodium Hydroxide |
| Intraspinal | Dextrose; Hydrochloric Acid; Sodium Hydroxide |
| Intrasynovial | Acetic Acid; Benzyl Alcohol; Carboxymethylcellulose Sodium; Citric Acid; Creatinine; Edetate Disodium; Hydrochloric Acid; Methylcelluloses; Methylparaben; Myristyl-.Gamma.-Picolinium Chloride; Niacinamide; Phenol; Polyethylene Glycol 3350; Polyethylene Glycol 4000; Polysorbate 80; Propylparaben; Sodium Acetate; Sodium Bisulfite; Sodium Chloride; Sodium Citrate; Sodium Hydroxide; Sodium Phosphate, Dibasic; Sodium Phosphate, Dibasic, Heptahydrate; Sodium Phosphate, Monobasic; Sodium Phosphate, Monobasic, Anhydrous; Sorbitol |
| Intrathecal | Benzyl Alcohol; Carbon Dioxide; Citric Acid; Edetate Calcium Disodium; Hydrochloric Acid; Methionine; Nitrogen; Pentetate Calcium Trisodium; Pentetic Acid; Sodium Bicarbonate; Sodium Chloride; Sodium Citrate; Sodium Hydroxide; Sulfuric Acid; Tromethamine |
| Intratracheal | Acetic Acid; Benzyl Alcohol; Carboxymethylcellulose Sodium; Hydrochloric Acid; Isotonic Sodium Chloride Solution; Peanut Oil; Sodium Bicarbonate; Sodium Chloride; Sodium Citrate; Sodium Hydroxide; Tromethamine |
| Intratumor | Benzyl Alcohol; Hydrochloric Acid; Nitrogen; Sodium Carbonate; Sodium Chloride; Sodium Hydroxide |
| Intrauterine | Barium Sulfate; Crospovidone; Diatrizoic Acid; Dimethylsiloxane/Methylvinylsiloxane Copolymer; Edetate Calcium Disodium; Edetate Disodium; Ethylene Vinyl Acetate Copolymer; High Density Polyethylene; Meglumine; Polyethylene High Density Containing Ferric Oxide Black (<1%); Polyethylene Low Density Containing Barium Sulfate (20-24%); Polyethylene T; |

TABLE 9-continued

Routes of Adminsitration and Inactive Ingredients

| Route of Administration | Inactive Ingredient |
|---|---|
| | Polypropylene; Poppy Seed Oil; Potassium Phosphate, Monobasic; Silicone; Sodium Citrate; Sodium Hydroxide; Titanium Dioxide |
| Intravascular | Alcohol; Alcohol, Dehydrated; Calcium Chloride; Carbon Dioxide; Citric Acid; Diatrizoic Acid; Edetate Calcium Disodium; Edetate Disodium; Hydrochloric Acid; Hydrochloric Acid, Diluted; Iodine; Meglumine; Nitrogen; Potassium Hydroxide; Sodium Carbonate; Sodium Chloride; Sodium Citrate; Sodium Hydroxide; Sodium Phosphate, Monobasic, Anhydrous; Sodium Phosphate, Monobasic, Monohydrate; Tromethamine |
| Intravenous | Alpha-Tocopherol; Alpha-Tocopherol, Dl-; 1,2-Dimyristoyl-Sn-Glycero-3-Phosphocholine; 1,2-Distearoyl-Sn-Glycero-3-(Phospho-Rac-(1-Glycerol)); 1,2-Distearoyl-Sn-Glycero-3-Phosphocholine; Acetic Acid; Acetic Acid, Glacial; Acetic Anhydride; Acetylated Monoglycerides; Acetyltryptophan, Dl-; Activated Charcoal; Albumin Aggregated; Albumin Colloidal; Albumin Human; Alcohol; Alcohol, Dehydrated; Alcohol, Denatured; Ammonium Acetate; Ammonium Hydroxide; Ammonium Sulfate; Anhydrous Citric Acid; Anhydrous Dextrose; Anhydrous Lactose; Anhydrous Trisodium Citrate; Arginine; Ascorbic Acid; Benzenesulfonic Acid; Benzethonium Chloride; Benzoic Acid; Benzyl Alcohol; Benzyl Chloride; Bibapcitide; Boric Acid; Butylated Hydroxytoluene; Calcium Chloride; Calcium Gluceptate; Calcium Hydroxide; Calcobutrol; Caldiamide Sodium; Caloxetate Trisodium; Calteridol Calcium; Captisol; Carbon Dioxide; Cellulose, Microcrystalline; Chlorobutanol; Chlorobutanol Hemihydrate; Chlorobutanol, Anhydrous; Cholesterol; Citrate; Citric Acid; Citric Acid Monohydrate; Citric Acid, Hydrous; Cysteine; Cysteine Hydrochloride; Dalfampridine; Dextran; Dextran 40; Dextrose; Dextrose Monohydrate; Dextrose Solution; Diatrizoic Acid; Dimethicone Medical Fluid 360; Edetate Calcium Disodium; Edetate Disodium; Edetate Disodium Anhydrous; Egg Phospholipids; Ethanolamine Hydrochloride; Ethylenediamine; Exametazime; Ferric Chloride; Gadolinium Oxide; Gamma Cyclodextrin; Gelatin; Gentisic Acid; Gluceptate Sodium; Gluceptate Sodium Dihydrate; Gluconolactone; Glucuronic Acid; Glycerin; Glycine; Guanidine Hydrochloride; Hetastarch; Histidine; Human Albumin Microspheres; Hydrochloric Acid; Hydrochloric Acid, Diluted; Hydroxyethylpiperazine Ethane Sulfonic Acid; Hydroxypropyl-Bcyclodextrin; Iodine; Iodoxamic Acid; Iofetamine Hydrochloride; Isopropyl Alcohol; Isotonic Sodium Chloride Solution; Lactic Acid; Lactic Acid, Dl-; Lactic Acid, L-; Lactobionic Acid; Lactose; Lactose Monohydrate; Lactose, Hydrous; Lecithin, Egg; Lecithin, Hydrogenated Soy; Lidofenin; Mannitol; Mebrofenin; Medronate Disodium; Medronic Acid; Meglumine; Methionine; Methylboronic Acid; Methylene Blue; Methylparaben; Monothioglycerol; N-(Carbamoyl-Methoxy Peg-40)-1,2-Distearoyl-Cephalin Sodium; N,N-Dimethylacetamide; Nioxime; Nitrogen; Octanoic Acid; Oxidronate Disodium; Oxyquinoline; Pentasodium Pentetate; Pentetate Calcium Trisodium; Pentetic Acid; Perflutren; Phenol; Phenol, Liquefied; Phosphatidyl Glycerol, Egg; Phospholipid, Egg; Phosphoric Acid; Poloxamer 188; Polyethylene Glycol 300; Polyethylene Glycol 400; Polyethylene Glycol 600; Polysiloxane; Polysorbate 20; Polysorbate 80; Potassium Bisulfite; Potassium Chloride; Potassium Hydroxide; Potassium Metabisulfite; Potassium Phosphate, Dibasic; Potassium Phosphate, Monobasic; Povidones; Propylene Glycol; Propylparaben; Saccharin Sodium; Sodium Acetate; Sodium Acetate Anhydrous; Sodium Ascorbate; Sodium Benzoate; Sodium Bicarbonate; Sodium Bisulfite; Sodium Carbonate; Sodium Carbonate Decahydrate; Sodium Carbonate Monohydrate; Sodium Chloride; Sodium Chloride Injection, Bacteriostatic; Sodium Citrate; Sodium Dithionite; Sodium Gluconate; Sodium Hydroxide; Sodium Iodide; Sodium Lactate; Sodium Metabisulfite; Sodium Phosphate; Sodium Phosphate, Dibasic; Sodium Phosphate, Dibasic, Anhydrous; Sodium Phosphate, Dibasic, Dihydrate; Sodium Phosphate, Dibasic, Heptahydrate; Sodium Phosphate, Monobasic, Anhydrous; Sodium Phosphate, Monobasic, Dihydrate; Sodium Phosphate, Monobasic, Monohydrate; Sodium Pyrophosphate; Sodium Succinate Hexahydrate; Sodium Sulfite; Sodium Tartrate; Sodium Thiosulfate; Sodium Thiosulfate Anhydrous; Sodium Trimetaphosphate; Sorbitol; Sorbitol Solution; Soybean Oil; Stannous Chloride; Stannous Chloride Anhydrous; Stannous Fluoride; Stannous Tartrate; Succimer; Succinic Acid; Sucrose; Sulfobutylether .Beta.-Cyclodextrin; Sulfuric Acid; Tartaric Acid; Tartaric Acid, Dl-; Tert-Butyl Alcohol; Tetrakis(2-Methoxyisobutylisocyanide)Copper(I) Tetrafluoroborate; Theophylline; Thimerosal; Threonine; Tin; Trisodium Citrate Dihydrate; Tromantadine; Tromethamine; Versetamide |
| Intravenous Bolus | Sodium Chloride |
| Intravesical | Alcohol, Dehydrated; Edetate Calcium Disodium; Hydrochloric Acid; Nitrogen; Polyoxyl 35 Castor Oil; Potassium Phosphate, Monobasic; Sodium Chloride; Sodium Hydroxide; Sodium Phosphate, Dibasic, Anhydrous; Sodium Phosphate, Monobasic, Anhydrous |
| Intravitreal | Calcium Chloride; Carboxymethylcellulose Sodium; Cellulose, Microcrystalline; Hyaluronate Sodium; Hydrochloric Acid; Magnesium Chloride; Magnesium Stearate; Polysorbate 80; Polyvinyl Alcohol; Potassium Chloride; Sodium Acetate; Sodium Bicarbonate; Sodium Carbonate; Sodium Chloride; Sodium Hydroxide; Sodium Phosphate, Dibasic, Heptahydrate; Sodium Phosphate, Monobasic, Monohydrate; Trisodium Citrate Dihydrate |

TABLE 9-continued

Routes of Adminsitration and Inactive Ingredients

| Route of Administration | Inactive Ingredient |
|---|---|
| Iontophoresis | Cetylpyridinium Chloride; Citric Acid; Edetate Disodium; Glycerin; Hydrochloric Acid; Methylparaben; Phenonip; Polacrilin; Polyvinyl Alcohol; Povidone Hydrogel; Sodium Bisulfite; Sodium Chloride; Sodium Citrate; Sodium Hydroxide; Sodium Metabisulfite; Sodium Phosphate, Monobasic |
| Irrigation | Acetic Acid; Activated Charcoal; Benzoic Acid; Hydrochloric Acid; Hypromelloses; Methylparaben; Nitrogen; Sodium Bisulfite; Sodium Citrate; Sodium Hydroxide; Sulfuric Acid |
| Intravenous - Subcutaneous | Acetic Acid; Alcohol; Benzyl Alcohol; Calcium Hydroxide; Chlorobutanol; Glycerin; Hydrochloric Acid; Lactose Monohydrate; Methylparaben; Nitrogen; Phenol; Phenol, Liquefied; Phosphoric Acid; Propylparaben; Sodium Acetate; Sodium Carbonate; Sodium Chloride; Sodium Hydroxide |
| Intravenous (Infusion) | 1,2-Dimyristoyl-Sn-Glycero-3-(Phospho-S-(1-Glycerol)); 1,2-Dimyristoyl-Sn-Glycero-3-Phosphocholine; Acetic Acid; Acetic Acid, Glacial; Activated Charcoal; Alanine; Albumin Human; Alcohol; Alcohol, Dehydrated; Ammonium Acetate; Anhydrous Citric Acid; Anhydrous Dextrose; Anhydrous Lactose; Anhydrous Trisodium Citrate; Arginine; Ascorbic Acid; Aspartic Acid; Benzenesulfonic Acid; Benzethonium Chloride; Benzoic Acid; Benzyl Alcohol; Brocrinat; Butylated Hydroxyanisole; Butylated Hydroxytoluene; Carbon Dioxide; Chlorobutanol; Citric Acid; Citric Acid Monohydrate; Citric Acid, Hydrous; Cysteine; Cysteine Hydrochloride; Deoxycholic Acid; Dextrose; Dextrose Solution; Diatrizoic Acid; Diethanolamine; Dimethyl Sulfoxide; Disodium Sulfosalicylate; Disofenin; Edetate Calcium Disodium; Edetate Disodium; Edetate Disodium Anhydrous; Edetate Sodium; Egg Phospholipids; Ethylenediamine; Fructose; Gelatin; Gentisic Acid Ethanolamide; Glycerin; Glycine; Histidine; Hydrochloric Acid; Hydrochloric Acid, Diluted; Hydroxide Ion; Hydroxypropyl-Bcyclodextrin; Isoleucine; Isotonic Sodium Chloride Solution; Lactic Acid; Lactic Acid, Dl-; Lactobionic Acid; Lactose; Lactose Monohydrate; Lactose, Hydrous; Leucine; Lysine; Lysine Acetate; Magnesium Chloride; Maleic Acid; Mannitol; Meglumine; Metacresol; Metaphosphoric Acid; Methanesulfonic Acid; Methionine; Methylparaben; Monothioglycerol; N,N-Dimethylacetamide; Nitric Acid; Nitrogen; Peg Vegetable Oil; Peg-40 Castor Oil; Peg-60 Castor Oil; Pentetate Calcium Trisodium; Phenol; Phenylalanine; Phospholipid; Phospholipid, Egg; Phosphoric Acid; Polyethylene Glycol 300; Polyethylene Glycol 400; Polyoxyl 35 Castor Oil; Polysorbate 20; Polysorbate 80; Potassium Chloride; Potassium Hydroxide; Potassium Metabisulfite; Potassium Phosphate, Dibasic; Potassium Phosphate, Monobasic; Povidones; Proline; Propylene Glycol; Propylparaben; Saccharin Sodium; Saccharin Sodium Anhydrous; Serine; Sodium Acetate; Sodium Acetate Anhydrous; Sodium Benzoate; Sodium Bicarbonate; Sodium Bisulfite; Sodium Carbonate; Sodium Chlorate; Sodium Chloride; Sodium Cholesteryl Sulfate; Sodium Citrate; Sodium Desoxycholate; Sodium Dithionite; Sodium Formaldehyde Sulfoxylate; Sodium Gluconate; Sodium Hydroxide; Sodium Hypochlorite; Sodium Lactate; Sodium Lactate, L-; Sodium Metabisulfite; Sodium Phosphate; Sodium Phosphate, Dibasic; Sodium Phosphate, Dibasic, Anhydrous; Sodium Phosphate, Dibasic, Dihydrate; Sodium Phosphate, Dibasic, Heptahydrate; Sodium Phosphate, Monobasic; Sodium Phosphate, Monobasic, Anhydrous; Sodium Phosphate, Monobasic, Dihydrate; Sodium Phosphate, Monobasic, Monohydrate; Sodium Sulfite; Sodium Tartrate; Sorbitol; Sorbitol Solution; Soybean Oil; Stannous Chloride; Stannous Chloride Anhydrous; Sterile Water For Inhalation; Sucrose; Sulfobutylether .Beta.-Cyclodextrin; Sulfur Dioxide; Sulfuric Acid; Tartaric Acid; Tartaric Acid, Dl-; Tert-Butyl Alcohol; Tetrofosmin; Theophylline; Threonine; Trifluoroacetic Acid; Trisodium Citrate Dihydrate; Tromethamine; Tryptophan; Tyrosine; Valine |
| Any Delivery Route | Alcohol; Benzyl Alcohol; Citric Acid Monohydrate; Gelfoam Sponge; Hydrochloric Acid; Methylparaben; Poly(Dl-Lactic-Co-Glycolic Acid), (50:50; Poly(Dl-Lactic-Co-Glycolic Acid), Ethyl Ester Terminated, (50:50; Polyquaternium-7 (70/30 Acrylamide/Dadmac; Propylene Glycol; Propylparaben; Sodium Chloride; Sodium Citrate; Sodium Hydroxide; Sodium Lactate; Sodium Phosphate, Monobasic, Monohydrate |
| Nasal | Acetic Acid; Alcohol, Dehydrated; Allyl .Alpha.-Ionone; Anhydrous Dextrose; Anhydrous Trisodium Citrate; Benzalkonium Chloride; Benzethonium Chloride; Benzyl Alcohol; Butylated Hydroxyanisole; Butylated Hydroxytoluene; Caffeine; Carbon Dioxide; Carboxymethylcellulose Sodium; Cellulose, Microcrystalline; Chlorobutanol; Citric Acid; Citric Acid Monohydrate; Dextrose; Dichlorodifluoromethane; Dichlorotetrafluoroethane; Edetate Disodium; Glycerin; Glycerol Ester Of Hydrogenated Rosin; Hydrochloric Acid; Hypromellose 2910 (15000 Mpa.S); Methylcelluloses; Methylparaben; Nitrogen; Norflurane; Oleic Acid; Petrolatum, White; Phenylethyl Alcohol; Polyethylene Glycol 3350; Polyethylene Glycol 400; Polyoxyl 400 Stearate; Polysorbate 20; Polysorbate 80; Potassium Phosphate, Monobasic; Potassium Sorbate; Propylene Glycol; Propylparaben; Sodium Acetate; Sodium Chloride; Sodium Citrate; Sodium Hydroxide; Sodium Phosphate; Sodium Phosphate, Dibasic; Sodium Phosphate, Dibasic, Anhydrous; Sodium Phosphate, Dibasic, Dihydrate; Sodium Phosphate, Dibasic, Dodecahydrate; Sodium Phosphate, Dibasic, Heptahydrate; Sodium Phosphate, Monobasic, Anhydrous; Sodium Phosphate, Monobasic, Dihydrate; Sorbitan Trioleate; Sorbitol; Sorbitol Solution; Sucralose; Sulfuric Acid; Trichloromonofluoromethane; Trisodium Citrate Dihydrate |

TABLE 9-continued

Routes of Adminsitration and Inactive Ingredients

| Route of Administration | Inactive Ingredient |
|---|---|
| Nerve Block | Acetic Acid; Acetone Sodium Bisulfite; Ascorbic Acid; Benzyl Alcohol; Calcium Chloride; Carbon Dioxide; Chlorobutanol; Citric Acid; Citric Acid Monohydrate; Edetate Calcium Disodium; Edetate Disodium; Hydrochloric Acid; Hydrochloric Acid, Diluted; Lactic Acid; Methylparaben; Monothioglycerol; Nitrogen; Potassium Chloride; Potassium Metabisulfite; Potassium Phosphate, Monobasic; Propylparaben; Sodium Bisulfite; Sodium Carbonate; Sodium Chlorate; Sodium Chloride; Sodium Citrate; Sodium Hydroxide; Sodium Lactate; Sodium Lactate, L-; Sodium Metabisulfite; Sodium Phosphate; Sodium Phosphate, Dibasic, Heptahydrate |
| Ophthalmic | Acetic Acid; Alcohol; Alcohol, Dehydrated; Alginic Acid; Amerchol-Cab; Ammonium Hydroxide; Anhydrous Trisodium Citrate; Antipyrine; Benzalkonium Chloride; Benzethonium Chloride; Benzododecinium Bromide; Boric Acid; Caffeine; Calcium Chloride; Carbomer 1342; Carbomer 934p; Carbomer 940; Carbomer Homopolymer Type B (Allyl Pentaerythritol Crosslinked); Carboxymethylcellulose Sodium; Castor Oil; Cetyl Alcohol; Chlorobutanol; Chlorobutanol, Anhydrous; Cholesterol; Citric Acid; Citric Acid Monohydrate; Creatinine; Diethanolamine; Diethylhexyl Phthalate **See Cder Guidance: Limiting The Use Of Certain Phthalates As Excipients In Cder-Regulated Products; Divinylbenzene Styrene Copolymer; Edetate Disodium; Edetate Disodium Anhydrous; Edetate Sodium; Ethylene Vinyl Acetate Copolymer; Gellan Gum (Low Acyl); Glycerin; Glyceryl Stearate; High Density Polyethylene; Hydrocarbon Gel, Plasticized; Hydrochloric Acid; Hydrochloric Acid, Diluted; Hydroxyethyl Cellulose; Hydroxypropyl Methylcellulose 2906; Hypromellose 2910 (15000 Mpa.S);Hypromelloses; Jelene; Lanolin; Lanolin Alcohols; Lanolin Anhydrous; Lanolin Nonionic Derivatives; Lauralkonium Chloride; Lauroyl Sarcosine; Light Mineral Oil; Magnesium Chloride; Mannitol; Methylcellulose (4000 Mpa.S); Methylcelluloses; Methylparaben; Mineral Oil; Nitric Acid; Nitrogen; Nonoxynol-9; Octoxynol-40; Octylphenol Polymethylene; Petrolatum; Petrolatum, White; Phenylethyl Alcohol; Phenylmercuric Acetate; Phenylmercuric Nitrate; Phosphoric Acid; Polidronium Chloride; Poloxamer 188; Poloxamer 407; Polycarbophil; Polyethylene Glycol 300; Polyethylene Glycol 400; Polyethylene Glycol 8000; Polyoxyethylene-Polyoxypropylene 1800; Polyoxyl 35 Castor Oil; Polyoxyl 40 Hydrogenated Castor Oil; Polyoxyl 40 Stearate; Polypropylene Glycol; Polysorbate 20; Polysorbate 60; Polysorbate 80; Polyvinyl Alcohol; Potassium Acetate; Potassium Chloride; Potassium Phosphate, Monobasic; Potassium Sorbate; Povidone K29/32; Povidone K30; Povidone K90; Povidones; Propylene Glycol; Propylparaben; Soda Ash; Sodium Acetate; Sodium Bisulfate; Sodium Bisulfate; Sodium Borate; Sodium Borate Decahydrate; Sodium Carbonate; Sodium Carbonate Monohydrate; Sodium Chloride; Sodium Citrate; Sodium Hydroxide; Sodium Metabisulfite; Sodium Nitrate; Sodium Phosphate; Sodium Phosphate Dihydrate; Sodium Phosphate, Dibasic; Sodium Phosphate, Dibasic, Anhydrous; Sodium Phosphate, Dibasic, Dihydrate; Sodium Phosphate, Dibasic, Heptahydrate; Sodium Phosphate, Monobasic; Sodium Phosphate, Monobasic, Anhydrous; Sodium Phosphate, Monobasic, Dihydrate; Sodium Phosphate, Monobasic, Monohydrate; Sodium Sulfate; Sodium Sulfate Anhydrous; Sodium Sulfate Decahydrate; Sodium Sulfite; Sodium Thiosulfate; Sorbic Acid; Sorbitan Monolaurate; Sorbitol; Sorbitol Solution; Stabilized Oxychloro Complex; Sulfuric Acid; Thimerosal; Titanium Dioxide; Tocophersolan; Trisodium Citrate Dihydrate; Triton 720; Tromethamine; Tyloxapol; Zinc Chloride |
| Parenteral | Hydrochloric Acid; Mannitol; Nitrogen; Sodium Acetate; Sodium Chloride; Sodium Hydroxide |
| Percutaneous | Duro-Tak 87-2287; Silicone Adhesive 4102 |
| Perfusion, Biliary | Glycerin |
| Perfusion, Cardiac | Hydrochloric Acid; Sodium Hydroxide |
| Periarticular | Diatrizoic Acid; Edetate Calcium Disodium; Iodine; Meglumine |
| Peridural | Citric Acid; Hydrochloric Acid; Methylparaben; Sodium Chloride; Sodium Hydroxide; Sodium Metabisulfite |
| Perineural | Hydrochloric Acid; Sodium Chloride; Sodium Hydroxide |
| Periodontal | Ethylene Vinyl Acetate Copolymer; Hydrochloric Acid; Methyl Pyrrolidone; Poloxamer 188; Poloxamer 407; Polylactide |
| Photopheresis | Acetic Acid; Alcohol, Dehydrated; Propylene Glycol; Sodium Acetate; Sodium Chloride; Sodium Hydroxide |
| Rectal | Alcohol; Alcohol, Dehydrated; Aluminum Subacetate; Anhydrous Citric Acid; Aniseed Oil; Ascorbic Acid; Ascorbyl Palmitate; Balsam Peru; Benzoic Acid; Benzyl Alcohol; Bismuth Subgallate; Butylated Hydroxyanisole; Butylated Hydroxytoluene; Butylparaben; Caramel; Carbomer 934; Carbomer 934p; Carboxypolymethylene; Cerasynt-Se; Cetyl Alcohol; Cocoa Butter; Coconut Oil, Hydrogenated; Coconut Oil/Palm Kernel Oil Glycerides, Hydrogenated; Cola Nitida Seed Extract; D&C Yellow No. 10; Dichlorodifluoromethane; Dichlorotetrafluoroethane; Dimethyldioctadecylammonium Bentonite; Edetate Calcium Disodium; Edetate Disodium; Edetic Acid; Epilactose; Ethylenediamine; Fat, Edible; Fat, Hard; Fd&C Blue No. 1; Fd&C Green No. 3; Fd&C Yellow No. 6; Flavor Fig 827118; Flavor Raspberry Pfc-8407; Fructose; Galactose; Glycerin; |

TABLE 9-continued

Routes of Adminsitration and Inactive Ingredients

| Route of Administration | Inactive Ingredient |
|---|---|
| | Glyceryl Palmitate; Glyceryl Stearate; Glyceryl Stearate/Peg Stearate; Glyceryl Stearate/Peg-40 Stearate; Glycine; Hydrocarbon; Hydrochloric Acid; Hydrogenated Palm Oil; Hypromelloses; Lactose; Lanolin; Lecithin; Light Mineral Oil; Magnesium Aluminum Silicate; Magnesium Aluminum Silicate Hydrate; Methylparaben; Nitrogen; Palm Kernel Oil; Paraffin; Petrolatum, White; Polyethylene Glycol 1000; Polyethylene Glycol 1540; Polyethylene Glycol 3350; Polyethylene Glycol 400; Polyethylene Glycol 4000; Polyethylene Glycol 6000; Polyethylene Glycol 8000; Polysorbate 60; Polysorbate 80; Potassium Acetate; Potassium Metabisulfite; Propylene Glycol; Propylparaben; Saccharin Sodium; Saccharin Sodium Anhydrous; Silicon Dioxide, Colloidal; Simethicone; Sodium Benzoate; Sodium Carbonate; Sodium Chloride; Sodium Citrate; Sodium Hydroxide; Sodium Metabisulfite; Sorbitan Monooleate; Sorbitan Sesquioleate; Sorbitol; Sorbitol Solution; Starch; Steareth-10; Steareth-40; Sucrose; Tagatose, D-; Tartaric Acid, Dl-; Trolamine; Tromethamine; Vegetable Oil Glyceride, Hydrogenated; Vegetable Oil, Hydrogenated; Wax, Emulsifying; White Wax; Xanthan Gum; Zinc Oxide |
| Respiratory (Inhalation) | Alcohol; Alcohol, Dehydrated; Apaflurane; Benzalkonium Chloride; Calcium Carbonate; Edetate Disodium; Gelatin; Glycine; Hydrochloric Acid; Lactose Monohydrate; Lysine Monohydrate; Mannitol; Norflurane; Oleic Acid; Polyethylene Glycol 1000; Povidone K25; Silicon Dioxide, Colloidal; Sodium Chloride; Sodium Citrate; Sodium Hydroxide; Sodium Lauryl Sulfate; Sulfuric Acid; Titanium Dioxide; Tromethamine; Zinc Oxide |
| Retrobulbar | Hydrochloric Acid; Sodium Hydroxide |
| Soft Tissue | Acetic Acid; Anhydrous Trisodium Citrate; Benzyl Alcohol; Carboxymethylcellulose; Carboxymethylcellulose Sodium; Citric Acid; Creatinine; Edetate Disodium; Hydrochloric Acid; Methylcelluloses; Methylparaben; Myristyl-.Gamma.-Picolinium Chloride; Phenol; Phosphoric Acid; Polyethylene Glycol 3350; Polyethylene Glycol 4000; Polysorbate 80; Propylparaben; Sodium Acetate; Sodium Bisulfite; Sodium Chloride; Sodium Citrate; Sodium Hydroxide; Sodium Phosphate; Sodium Phosphate, Dibasic; Sodium Phosphate, Dibasic, Heptahydrate; Sodium Phosphate, Monobasic; Sodium Phosphate, Monobasic, Anhydrous; Sodium Sulfite |
| Spinal | Anhydrous Dextrose; Dextrose; Hydrochloric Acid; Sodium Hydroxide |
| Subarachnoid | Hydrochloric Acid; Sodium Chloride; Sodium Hydroxide |
| Subconjunctival | Benzyl Alcohol; Hydrochloric Acid; Sodium Hydroxide |
| Subcutaneous | Acetic Acid; Acetic Acid, Glacial; Albumin Human; Ammonium Hydroxide; Ascorbic Acid; Benzyl Alcohol; Calcium Chloride; Carboxymethylcellulose Sodium; Chlorobutanol; Cresol; Diatrizoic Acid; Dimethyl Sulfoxide; Edetate Calcium Disodium; Edetate Disodium; Ethylene Vinyl Acetate Copolymer; Glycerin; Glycine; Glycine Hydrochloride; Histidine; Hydrochloric Acid; Lactic Acid; Lactic Acid, L-; Lactose; Magnesium Chloride; Magnesium Stearate; Mannitol; Metacresol; Methanesulfonic Acid; Methionine; Methyl Pyrrolidone; Methylparaben; Nitrogen; Phenol; Phenol, Liquefied; Phosphoric Acid; Poloxamer 188; Polyethylene Glycol 3350; Polyglactin; Polysorbate 20; Polysorbate 80; Potassium Phosphate, Dibasic; Potassium Phosphate, Monobasic; Povidone K17; Povidones; Propylene Glycol; Propylparaben; Protamine Sulfate; Sodium Acetate; Sodium Acetate Anhydrous; Sodium Bicarbonate; Sodium Bisulfite; Sodium Chloride; Sodium Citrate; Sodium Hydroxide; Sodium Metabisulfite; Sodium Phosphate; Sodium Phosphate Dihydrate; Sodium Phosphate, Dibasic; Sodium Phosphate, Dibasic, Anhydrous; Sodium Phosphate, Dibasic, Dihydrate; Sodium Phosphate, Dibasic, Heptahydrate; Sodium Phosphate, Monobasic; Sodium Phosphate, Monobasic, Anhydrous; Sodium Phosphate, Monobasic, Dihydrate; Sodium Phosphate, Monobasic, Monohydrate; Sodium Sulfite; Sodium Thioglycolate; Stearic Acid; Sucrose; Thimerosal; Tromethamine; Zinc; Zinc Acetate; Zinc Carbonate; Zinc Chloride; Zinc Oxide |
| Sublingual | Alcohol, Dehydrated |
| Submucosal | Acetic Acid; Edetic Acid; Mannitol; Nitrogen; Sodium Acetate; Sodium Chloride; Sodium Hydroxide; Sodium Metabisulfite |
| Topical | .Alpha.-Terpineol; .Alpha.-Tocopherol; .Alpha.-Tocopherol Acetate, Dl-; .Alpha.-Tocopherol, Dl-; 1,2,6-Hexanetriol; 1-O-Tolylbiguanide; 2-Ethyl-1,6-Hexanediol; Acetic Acid; Acetone; Acetylated Lanolin Alcohols; Acrylates Copolymer; Adhesive Tape; Alcohol; Alcohol, Dehydrated; Alcohol, Denatured; Alcohol, Diluted; Alkyl Ammonium Sulfonic Acid Betaine; Alkyl Aryl Sodium Sulfonate; Allantoin; Almond Oil; Aluminum Acetate; Aluminum Chlorhydroxy Allantoinate; Aluminum Hydroxide; Aluminum Hydroxide-Sucrose, Hydrated; Aluminum Hydroxide Gel; Aluminum Hydroxide Gel F 500; Aluminum Hydroxide Gel F 5000; Aluminum Monostearate; Aluminum Oxide; Aluminum Silicate; Aluminum Starch Octenylsuccinate; Aluminum Stearate; Aluminum Sulfate Anhydrous; Amerchol C; Amerchol-Cab; Aminomethylpropanol; Ammonia Solution; Ammonia Solution, Strong; Ammonium Hydroxide; Ammonium Lauryl Sulfate; Ammonium Nonoxynol-4 Sulfate; Ammonium Salt Of C-12-C-15 Linear Primary Alcohol Ethoxylate; Ammonyx; Amphoteric-2; Amphoteric-9; Anhydrous Citric Acid; Anhydrous Trisodium Citrate; Anoxid Sbn; Antifoam; Apricot Kernel Oil Peg-6 Esters; Aquaphor; Arlacel; Ascorbic Acid; Ascorbyl Palmitate; Beeswax; Beeswax, Synthetic; Beheneth-10; Bentonite; Benzalkonium Chloride; Benzoic Acid; Benzyl Alcohol; Betadex; Boric Acid; Butane; Butyl Alcohol; Butyl Ester Of Vinyl Methyl |

TABLE 9-continued

Routes of Adminsitration and Inactive Ingredients

| Route of Administration | Inactive Ingredient |
|---|---|
| | Ether/Maleic Anhydride Copolymer (125000 Mw); Butyl Stearate; Butylated Hydroxyanisole; Butylated Hydroxytoluene; Butylene Glycol; Butylparaben; C20-40 Pareth-24; Calcium Chloride; Calcium Hydroxide; Canada Balsam; Caprylic/Capric Triglyceride; Caprylic/Capric/Stearic Triglyceride; Captan; Caramel; Carbomer 1342; Carbomer 1382; Carbomer 934; Carbomer 934p; Carbomer 940; Carbomer 941; Carbomer 980; Carbomer 981; Carbomer Homopolymer Type B (Allyl Pentaerythritol Crosslinked); Carbomer Homopolymer Type C (Allyl Pentaerythritol Crosslinked); Carboxy Vinyl Copolymer; Carboxymethylcellulose; Carboxymethylcellulose Sodium; Carboxypolymethylene; Carrageenan; Carrageenan Salt; Castor Oil; Cedar Leaf Oil; Cellulose; Cerasynt-Se; Ceresin; Ceteareth-12; Ceteareth-15; Ceteareth-30; Cetearyl Alcohol/Ceteareth-20; Cetearyl Ethylhexanoate; Ceteth-10; Ceteth-2; Ceteth-20; Ceteth-23; Cetostearyl Alcohol; Cetrimonium Chloride; Cetyl Alcohol; Cetyl Esters Wax; Cetyl Palmitate; Chlorobutanol; Chlorocresol; Chloroxylenol; Cholesterol; Choleth-24; Citric Acid; Citric Acid Monohydrate; Cocamide Ether Sulfate; Cocamine Oxide; Coco Betaine; Coco Diethanolamide; Coco Monoethanolamide; Cocoa Butter; Coco-Glycerides; Coconut Oil; Cocoyl Caprylocaprate; Collagen; Coloring Suspension; Cream Base; Creatinine; Crospovidone; Cyclomethicone; Cyclomethicone/Dimethicone Copolyol; D&C Red No. 28; D&C Red No. 33; D&C Red No. 36; D&C Red No. 39; D&C Yellow No. 10; Decyl Methyl Sulfoxide; Dehydag Wax Sx; Dehydroacetic Acid; Dehymuls E; Denatonium Benzoate; Dextrin; Diazolidinyl Urea; Dichlorobenzyl Alcohol; Dichlorodifluoromethane; Dichlorotetrafluoroethane; Diethanolamine; Diethyl Sebacate; Diethylene Glycol Monoethyl Ether; Dihydroxyaluminum Aminoacetate; Diisopropanolamine; Diisopropyl Adipate; Diisopropyl Dilinoleate; Dimethicone 350; Dimethicone Copolyol; Dimethicone Medical Fluid 360; Dimethyl Isosorbide; Dimethyl Sulfoxide; Dinoseb Ammonium Salt; Disodium Cocoamphodiacetate; Disodium Laureth Sulfosuccinate; Disodium Lauryl Sulfosuccinate; Dmdm Hydantoin; Docosanol; Docusate Sodium; Edetate Disodium; Edetate Sodium; Edetic Acid; Entsufon; Entsufon Sodium; Epitetracycline Hydrochloride; Essence Bouquet 9200; Ethyl Acetate; Ethylcelluloses; Ethylene Glycol; Ethylenediamine; Ethylenediamine Dihydrochloride; Ethylhexyl Hydroxystearate; Ethylparaben; Fatty Acid Pentaerythriol Ester; Fatty Acids; Fatty Alcohol Citrate; Fd&C Blue No. 1; Fd&C Red No. 4; Fd&C Red No. 40; Fd&C Yellow No. 10 (Delisted); Fd&C Yellow No. 5; Fd&C Yellow No. 6; Ferric Oxide; Flavor Rhodia Pharmaceutical No. Rf 451; Formaldehyde; Formaldehyde Solution; Fractionated Coconut Oil; Fragrance 3949-5; Fragrance 520a; Fragrance 6.007; Fragrance 91-122; Fragrance 9128-Y; Fragrance 93498g; Fragrance Balsam Pine No. 5124; Fragrance Bouquet 10328; Fragrance Chemoderm 6401-B; Fragrance Chemoderm 6411; Fragrance Cream No. 73457; Fragrance Cs-28197; Fragrance Felton 066m; Fragrance Firmenich 47373; Fragrance Givaudan Ess 9090/1c; Fragrance H-6540; Fragrance Herbal 10396; Fragrance Nj-1085; Fragrance P O F1-147; Fragrance Pa 52805; Fragrance Pera Derm D; Fragrance Rbd-9819; Fragrance Shaw Mudge U-7776; Fragrance Tf 044078; Fragrance Ungerer Honeysuckle K 2771; Fragrance Ungerer N5195; Gelatin; Gluconolactone; Glycerin; Glyceryl Citrate; Glyceryl Isostearate; Glyceryl Monostearate; Glyceryl Oleate; Glyceryl Oleate/Propylene Glycol; Glyceryl Palmitate; Glyceryl Ricinoleate; Glyceryl Stearate; Glyceryl Stearate-Laureth-23; Glyceryl Stearate/Peg-100 Stearate; Glyceryl Stearate-Stearamidoethyl Diethylamine; Glycol Distearate; Glycol Stearate; Guar Gum; Hair Conditioner (18n195-1m); Hexylene Glycol; High Density Polyethylene; Hyaluronate Sodium; Hydrocarbon Gel, Plasticized; Hydrochloric Acid; Hydrochloric Acid, Diluted; Hydrogen Peroxide; Hydrogenated Castor Oil; Hydrogenated Palm/Palm Kernel Oil Peg-6 Esters; Hydroxyethyl Cellulose; Hydroxymethyl Cellulose; Hydroxyoctacosanyl Hydroxystearate; Hydroxypropyl Cellulose; Hypromelloses; Imidurea; Irish Moss Extract; Isobutane; Isoceteth-20; Isooctyl Acrylate; Isopropyl Alcohol; Isopropyl Isostearate; Isopropyl Myristate; Isopropyl Myristate-Myristyl Alcohol; Isopropyl Palmitate; Isopropyl Stearate; Isostearic Acid; Isostearyl Alcohol; Jelene; Kaolin; Kathon Cg; Kathon Cg Ii; Lactate; Lactic Acid; Lactic Acid, Dl-; Laneth; Lanolin; Lanolin Alcohol-Mineral Oil; Lanolin Alcohols; Lanolin Anhydrous; Lanolin Cholesterols; Lanolin, Ethoxylated; Lanolin, Hydrogenated; Law-amine Oxide; Laurdimonium Hydrolyzed Animal Collagen; Laureth Sulfate; Laureth-2; Laureth-23; Laureth-4; Lauric Diethanolamide; Lauric Myristic Diethanolamide; Lauryl Sulfate; Lavandula Angustifolia Flowering Top; Lecithin; Lecithin Unbleached; Lemon Oil; Light Mineral Oil; Light Mineral Oil (85 Ssu); Limonene, (+/−)-; Lipocol Sc-15; Magnesium Aluminum Silicate; Magnesium Aluminum Silicate Hydrate; Magnesium Nitrate; Magnesium Stearate; Mannitol; Maprofix; Medical Antiform A-F Emulsion; Menthol; Methyl Gluceth-10; Methyl Gluceth-20; Methyl Gluceth-20 Sesquistearate; Methyl Glucose Sesquistearate; Methyl Salicylate; Methyl Stearate; Methylcelluloses; Methylchloroisothiazolinone; Methylisothiazolinone; Methylparaben; Microcrystalline Wax; Mineral Oil; Mono And Diglyceride; Monostearyl Citrate; Multisterol Extract; Myristyl Alcohol; Myristyl Lactate; Niacinamide; Nitric Acid; Nitrogen; Nonoxynol Iodine; Nonoxynol-15; Nonoxynol-9; Oatmeal; Octadecene-1/Maleic Acid Copolymer; Octoxynol-1; Octoxynol-9; Octyldodecanol; Oleic Acid; Oleth-10/Oleth-5; Oleth-2; Oleth-20; Oleyl Alcohol; Oleyl Oleate; Olive Oil; Palmitamine Oxide; Parabens; |

TABLE 9-continued

Routes of Adminsitration and Inactive Ingredients

| Route of Administration | Inactive Ingredient |
|---|---|
| | Paraffin; Paraffin, White Soft; Parfum Creme 45/3; Peanut Oil; Peanut Oil, Refined; Pectin; Peg 6-32 Stearate/Glycol Stearate; Peg-100 Stearate; Peg-12 Glyceryl Laurate; Peg-120 Glyceryl Stearate; Peg-120 Methyl Glucose Dioleate; Peg-15 Cocamine; Peg-150 Distearate; Peg-2 Stearate; Peg-22 Methyl Ether/Dodecyl Glycol Copolymer; Peg-25 Propylene Glycol Stearate; Peg-4 Dilaurate; Peg-4 Laurate; Peg-45/Dodecyl Glycol Copolymer; Peg-5 Oleate; Peg-50 Stearate; Peg-54 Hydrogenated Castor Oil; Peg-6 Isostearate; Peg-60 Hydrogenated Castor Oil; Peg-7 Methyl Ether; Peg-75 Lanolin; Peg-8 Laurate; Peg-8 Stearate; Pegoxol 7 Stearate; Pentaerythritol Cocoate; Peppermint Oil; Perfume 25677; Perfume Bouquet; Perfume E-1991; Perfume Gd 5604; Perfume Tana 90/42 Scba; Perfume W-1952-1; Petrolatum; Petrolatum, White; Petroleum Distillates; Phenonip; Phenoxyethanol; Phenylmercuric Acetate; Phosphoric Acid; Pine Needle Oil (Pinus Sylvestris); Plastibase-50w; Polidronium Chloride; Poloxamer 124; Poloxamer 181; Poloxamer 182; Poloxamer 188; Poloxamer 237; Poloxamer 407; Polycarbophil; Polyethylene Glycol 1000; Polyethylene Glycol 1450; Polyethylene Glycol 1500; Polyethylene Glycol 1540; Polyethylene Glycol 200; Polyethylene Glycol 300; Polyethylene Glycol 300-1600; Polyethylene Glycol 3350; Polyethylene Glycol 400; Polyethylene Glycol 4000; Polyethylene Glycol 540; Polyethylene Glycol 600; Polyethylene Glycol 6000; Polyethylene Glycol 8000; Polyethylene Glycol 900; Polyhydroxyethyl Methacrylate; Polyisobutylene; Polyisobutylene (1100000 Mw); Polyoxyethylene-Polyoxypropylene 1800; Polyoxyethylene Alcohols; Polyoxyethylene Fatty Acid Esters; Polyoxyethylene Propylene; Polyoxyl 20 Cetostearyl Ether; Polyoxyl 40 Hydrogenated Castor Oil; Polyoxyl 40 Stearate; Polyoxyl 400 Stearate; Polyoxyl 6 And Polyoxyl 32 Palmitostearate; Polyoxyl Distearate; Polyoxyl Glyceryl Stearate; Polyoxyl Lanolin; Polyoxyl Stearate; Polypropylene; Polyquaternium-10; Polysorbate 20; Polysorbate 40; Polysorbate 60; Polysorbate 65; Polysorbate 80; Polyvinyl Alcohol; Potash; Potassium Citrate; Potassium Hydroxide; Potassium Soap; Potassium Sorbate; Povidone Acrylate Copolymer; Povidone Hydrogel; Povidone K90; Povidone/Eicosene Copolymer; Povidones; Ppg-12/Smdi Copolymer; Ppg-15 Stearyl Ether; Ppg-20 Methyl Glucose Ether Distearate; Ppg-26 Oleate; Product Wat; Promulgen D; Promulgen G; Propane; Propellant A-46; Propyl Gallate; Propylene Carbonate; Propylene Glycol; Propylene Glycol Diacetate; Propylene Glycol Dicaprylate; Propylene Glycol Monopalmitostearate; Propylene Glycol Palmitostearate; Propylene Glycol Ricinoleate; Propylene Glycol/Diazolidinyl Urea/Methylparaben/Propylparben; Propylparaben; Protein Hydrolysate; Quaternium-15; Quaternium-15 Cis-Form; Quaternium-52; Saccharin; Saccharin Sodium; Safflower Oil; Sd Alcohol 3a; Sd Alcohol 40; Sd Alcohol 40-2; Sd Alcohol 40b; Sepineo P 600; Shea Butter; Silicon; Silicon Dioxide; Silicone; Silicone Adhesive Bio-Psa Q7-4201; Silicone Adhesive Bio-Psa Q7-4301; Silicone Emulsion; Simethicone; Simethicone Emulsion; Sipon Ls 20np; Sodium Acetate; Sodium Acetate Anhydrous; Sodium Alkyl Sulfate; Sodium Benzoate; Sodium Bisulfite; Sodium Borate; Sodium Cetostearyl Sulfate; Sodium Chloride; Sodium Citrate; Sodium Cocoyl Sarcosinate; Sodium Dodecylbenzenesulfonate; Sodium Formaldehyde Sulfoxylate; Sodium Hydroxide; Sodium Iodide; Sodium Lactate; Sodium Laureth-2 Sulfate; Sodium Laureth-3 Sulfate; Sodium Laureth-5 Sulfate; Sodium Lauroyl Sarcosinate; Sodium Lauryl Sulfate; Sodium Lauryl Sulfoacetate; Sodium Metabisulfite; Sodium Phosphate; Sodium Phosphate, Dibasic; Sodium Phosphate, Dibasic, Anhydrous; Sodium Phosphate, Dibasic, Dihydrate; Sodium Phosphate, Dibasic, Heptahydrate; Sodium Phosphate, Monobasic; Sodium Phosphate, Monobasic, Anhydrous; Sodium Phosphate, Monobasic, Dihydrate; Sodium Phosphate, Monobasic, Monohydrate; Sodium Polyacrylate (2500000 Mw); Sodium Pyrrolidone Carboxylate; Sodium Sulfite; Sodium Sulfosuccinated Undecylenic Monoalkylolamide; Sodium Thiosulfate; Sodium Xylenesulfonate; Somay 44; Sorbic Acid; Sorbitan; Sorbitan Isostearate; Sorbitan Monolaurate; Sorbitan Monooleate; Sorbitan Monopalmitate; Sorbitan Monostearate; Sorbitan Sesquioleate; Sorbitan Tristearate; Sorbitol; Sorbitol Solution; Soybean Flour; Soybean Oil; Spearmint Oil; Spermaceti; Squalane; Starch; Stearalkonium Chloride; Stearamidoethyl Diethylamine; Steareth-10; Steareth-100; Steareth-2; Steareth-20; Steareth-21; Steareth-40; Stearic Acid; Stearic Diethanolamide; Stearoxytrimethylsilane; Steartrimonium Hydrolyzed Animal Collagen; Stearyl Alcohol; Styrene/Isoprene/Styrene Block Copolymer; Sucrose; Sucrose Distearate; Sucrose Polyesters; Sulfacetamide Sodium; Sulfuric Acid; Surfactol Qs; Talc; Tall Oil; Tallow Glycerides; Tartaric Acid; Tenox; Tenox-2; Tert-Butyl Alcohol; Tert-Butyl Hydroperoxide; Thimerosal; Titanium Dioxide; Tocopherol; Tocophersolan; Trichloromonofluoromethane; Trideceth-10; Triethanolamine Lauryl Sulfate; Triglycerides, Medium Chain; Trihydroxystearin; Trilaneth-4 Phosphate; Trilaureth-4 Phosphate; Trisodium Citrate Dihydrate; Trisodium Hedta; Triton X-200; Trolamine; Tromethamine; Tyloxapol; Undecylenic Acid; Vegetable Oil; Vegetable Oil, Hydrogenated; Viscarin; Vitamin E; Wax, Emulsifying; Wecobee Fs; White Wax; Xanthan Gum; Zinc Acetate |
| Transdermal | Acrylates Copolymer; Acrylic Acid-Isooctyl Acrylate Copolymer; Acrylic Adhesive 788; Adcote 72a103; Aerotex Resin 3730; Alcohol; Alcohol, Dehydrated; Aluminum Polyester; Bentonite; Butylated Hydroxytoluene; Butylene Glycol; Butyric Acid; Caprylic/Capric Triglyceride; Carbomer 1342; Carbomer 940; Carbomer 980; Carrageenan; Cetylpyridinium Chloride; Citric Acid; Crospovidone; |

TABLE 9-continued

Routes of Adminsitration and Inactive Ingredients

| Route of Administration | Inactive Ingredient |
|---|---|
| | Daubert 1-5 Pestr (Matte) 164z; Diethylene Glycol Monoethyl Ether; Diethylhexyl Phthalate **See Cder Guidance: Limiting The Use Of Certain Phthalates As Excipients In Cder-Regulated Products; Dimethicone Copolyol; Dimethicone Mdx4-4210; Dimethicone Medical Fluid 360; Dimethylaminoethyl Methacrylate-Butyl Methacrylate-Methyl Methacrylate Copolymer; Dipropylene Glycol; Duro-Tak 280-2516; Duro-Tak 387-2516; Duro-Tak 80-1196; Duro-Tak 87-2070; Duro-Tak 87-2194; Duro-Tak 87-2287; Duro-Tak 87-2296; Duro-Tak 87-2888; Duro-Tak 87-2979; Edetate Disodium; Ethyl Acetate; Ethyl Oleate; Ethylcelluloses; Ethylene Vinyl Acetate Copolymer; Ethylene-Propylene Copolymer; Fatty Acid Esters; Gelva 737; Glycerin; Glyceryl Laurate; Glyceryl Oleate; Heptane; High Density Polyethylene; Hydrochloric Acid; Hydrogenated Polybutene 635-690; Hydroxyethyl Cellulose; Hydroxypropyl Cellulose; Isopropyl Myristate; Isopropyl Palmitate; Lactose; Lanolin Anhydrous; Lauryl Lactate; Lecithin; Levulinic Acid; Light Mineral Oil; Medical Adhesive Modified S-15; Methyl Alcohol; Methyl Laurate; Mineral Oil; Nitrogen; Octisalate; Octyldodecanol; Oleic Acid; Oleyl Alcohol; Oleyl Oleate; Pentadecalactone; Petrolatum, White; Polacrilin; Polyacrylic Acid (250000 Mw); Polybutene (1400 Mw); Polyester; Polyester Polyamine Copolymer; Polyester Rayon; Polyethylene Terephthalates; Polyisobutylene; Polyisobutylene (1100000 Mw); Polyisobutylene (35000 Mw); Polyisobutylene 178-236; Polyisobutylene 241-294; Polyisobutylene 35-39; Polyisobutylene Low Molecular Weight; Polyisobutylene Medium Molecular Weight; Polyisobutylene/Polybutene Adhesive; Polypropylene; Polyvinyl Acetate; Polyvinyl Alcohol; Polyvinyl Chloride; Polyvinyl Chloride-Polyvinyl Acetate Copolymer; Polyvinylpyridine; Povidone K29/32; Povidones; Propylene Glycol; Propylene Glycol Monolaurate; Ra-2397; Ra-3011; Silicon; Silicon Dioxide, Colloidal; Silicone; Silicone Adhesive 4102; Silicone Adhesive 4502; Silicone Adhesive Bio-Psa Q7-4201; Silicone Adhesive Bio-Psa Q7-4301; Silicone/Polyester Film Strip; Sodium Chloride; Sodium Citrate; Sodium Hydroxide; Sorbitan Monoclate; Stearalkonium Hectorite/Propylene Carbonate; Titanium Dioxide; Triacetin; Trolamine; Tromethamine; Union 76 Amsco-Res 6038; Viscose/Cotton |
| Transmucosal | Magnesium Stearate; Mannitol; Potassium Bicarbonate; Sodium Starch Glycolate |
| Ureteral | Benzyl Alcohol; Diatrizoic Acid; Edetate Calcium Disodium; Edetate Disodium; Hydrochloric Acid; Meglumine; Methylparaben; Propylparaben; Sodium Citrate; Sodium Hydroxide |
| Urethral | Diatrizoic Acid; Edetate Calcium Disodium; Edetate Disodium; Hydrochloric Acid; Meglumine; Methylparaben; Polyethylene Glycol 1450; Propylparaben; Sodium Hydroxide; Sodium Phosphate, Dibasic, Heptahydrate; Tromethamine |
| Vaginal | Adipic Acid; Alcohol, Denatured; Allantoin; Anhydrous Lactose; Apricot Kernel Oil Peg-6 Esters; Barium Sulfate; Beeswax; Bentonite; Benzoic Acid; Benzyl Alcohol; Butylated Hydroxyanisole; Butylated Hydroxytoluene; Calcium Lactate; Carbomer 934; Carbomer 934p; Cellulose, Microcrystalline; Ceteth-20; Cetostearyl Alcohol; Cetyl Alcohol; Cetyl Esters Wax; Cetyl Palmitate; Cholesterol; Choleth; Citric Acid; Citric Acid Monohydrate; Coconut Oil/Palm Kernel Oil Glycerides, Hydrogenated; Crospovidone; Edetate Disodium; Ethylcelluloses; Ethylene-Vinyl Acetate Copolymer (28% Vinyl Acetate); Ethylene-Vinyl Acetate Copolymer (9% Vinylacetate); Fatty Alcohols; Fd&C Yellow No. 5; Gelatin; Glutamic Acid, Dl-; Glycerin; Glyceryl Isostearate; Glyceryl Monostearate; Glyceryl Stearate; Guar Gum; High Density Polyethylene; Hydrogel Polymer; Hydrogenated Palm Oil; Hypromellose 2208 (15000 Mpa.S); Hypromelloses; Isopropyl Myristate; Lactic Acid; Lactic Acid, Dl-; Lactose; Lactose Monohydrate; Lactose, Hydrous; Lanolin; Lanolin Anhydrous; Lecithin; Lecithin, Soybean; Light Mineral Oil; Magnesium Aluminum Silicate; Magnesium Aluminum Silicate Hydrate; Magnesium Stearate; Methyl Stearate; Methylparaben; Microcrystalline Wax; Mineral Oil; Nitric Acid; Octyldodecanol; Peanut Oil; Peg 6-32 Stearate/Glycol Stearate; Peg-100 Stearate; Peg-120 Glyceryl Stearate; Peg-2 Stearate; Peg-5 Oleate; Pegoxol 7 Stearate; Petrolatum, White; Phenylmercuric Acetate; Phospholipon 90g; Phosphoric Acid; Piperazine Hexahydrate; Poly(Dimethylsiloxane/Methylvinylsiloxane/Methylhydrogensiloxane) Dimethylvinyl Or Dimethylhydroxy Or Trimethyl Endblocked; Polycarbophil; Polyester; Polyethylene Glycol 1000; Polyethylene Glycol 3350; Polyethylene Glycol 400; Polyethylene Glycol 4000; Polyethylene Glycol 6000; Polyethylene Glycol 8000; Polyglyceryl-3 Oleate; Polyglyceryl-4 Oleate; Polyoxyl Palmitate; Polysorbate 20; Polysorbate 60; Polysorbate 80; Polyurethane; Potassium Alum; Potassium Hydroxide; Povidone K29/32; Povidones; Promulgen D; Propylene Glycol; Propylene Glycol Monopalmitostearate; Propylparaben; Quaternium-15 Cis-Form; Silicon Dioxide; Silicon Dioxide, Colloidal; Silicone; Sodium Bicarbonate; Sodium Citrate; Sodium Hydroxide; Sodium Lauryl Sulfate; Sodium Metabisulfite; Sodium Phosphate, Dibasic, Anhydrous; Sodium Phosphate, Monobasic, Anhydrous; Sorbic Acid; Sorbitan Monostearate; Sorbitol; Sorbitol Solution; Spermaceti; Stannous 2-Ethylhexanoate; Starch; Starch 1500, Pregelatinized; Starch, Corn; Stearamidoethyl Diethylamine; Stearic Acid; Stearyl Alcohol; Tartaric Acid, Dl-; Tert-Butylhydroquinone; Tetrapropyl Orthosilicate; Trolamine; Urea; Vegetable Oil, Hydrogenated; Wecobee Fs; White Ceresin Wax; White Wax |

Non-limiting routes of administration for the polynucleotides of the present invention are described below.

Parenteral and Injectable Administration

Liquid dosage forms for parenteral administration include, but are not limited to, pharmaceutically acceptable emulsions, microemulsions, solutions, suspensions, syrups, and/or elixirs. In addition to active ingredients, liquid dosage forms may comprise inert diluents commonly used in the art such as, for example, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (in particular, cottonseed, groundnut, corn, germ, olive, castor, and sesame oils), glycerol, tetrahydrofurfuryl alcohol, polyethylene glycols and fatty acid esters of sorbitan, and mixtures thereof. Besides inert diluents, oral compositions can include adjuvants such as wetting agents, emulsifying and suspending agents, sweetening, flavoring, and/or perfuming agents. In certain embodiments for parenteral administration, compositions are mixed with solubilizing agents such as CREMOPHOR®, alcohols, oils, modified oils, glycols, polysorbates, cyclodextrins, polymers, and/or combinations thereof.

A pharmaceutical composition for parenteral administration may comprise at least one inactive ingredient. Any or none of the inactive ingredients used may have been approved by the US Food and Drug Administration (FDA). A non-exhaustive list of inactive ingredients for use in pharmaceutical compositions for parenteral administration includes hydrochloric acid, mannitol, nitrogen, sodium acetate, sodium chloride and sodium hydroxide.

Injectable preparations, for example, sterile injectable aqueous or oleaginous suspensions may be formulated according to the known art using suitable dispersing agents, wetting agents, and/or suspending agents. Sterile injectable preparations may be sterile injectable solutions, suspensions, and/or emulsions in nontoxic parenterally acceptable diluents and/or solvents, for example, as a solution in 1,3-butanediol. Among the acceptable vehicles and solvents that may be employed are water, Ringer's solution, U.S.P., and isotonic sodium chloride solution. Sterile, fixed oils are conventionally employed as a solvent or suspending medium. For this purpose any bland fixed oil can be employed including synthetic mono- or diglycerides. Fatty acids such as oleic acid can be used in the preparation of injectables. The sterile formulation may also comprise adjuvants such as local anesthetics, preservatives and buffering agents.

Injectable formulations can be sterilized, for example, by filtration through a bacterial-retaining filter, and/or by incorporating sterilizing agents in the form of sterile solid compositions which can be dissolved or dispersed in sterile water or other sterile injectable medium prior to use.

Injectable formulations may be for direct injection into a region of a tissue, organ and/or subject. As a non-limiting example, a tissue, organ and/or subject may be directly injected a formulation by intramyocardial injection into the ischemic region. (See e.g., Zangi et al. Nature Biotechnology 2013; the contents of which are herein incorporated by reference in its entirety).

In order to prolong the effect of an active ingredient, it is often desirable to slow the absorption of the active ingredient from subcutaneous or intramuscular injection. This may be accomplished by the use of a liquid suspension of crystalline or amorphous material with poor water solubility. The rate of absorption of the drug then depends upon its rate of dissolution which, in turn, may depend upon crystal size and crystalline form. Alternatively, delayed absorption of a parenterally administered drug form is accomplished by dissolving or suspending the drug in an oil vehicle. Injectable depot forms are made by forming microencapsule matrices of the drug in biodegradable polymers such as polylactide-polyglycolide. Depending upon the ratio of drug to polymer and the nature of the particular polymer employed, the rate of drug release can be controlled. Examples of other biodegradable polymers include poly (orthoesters) and poly(anhydrides). Depot injectable formulations are prepared by entrapping the drug in liposomes or microemulsions which are compatible with body tissues.

Rectal and Vaginal Administration

In one embodiment, the polynucleotides described here may be formulated for rectal and vaginal administration by the methods or compositions described in International Patent Application No. PCT/US2014/027077, the contents of which are incorporated by reference in its entirety, such as in paragraphs [000910]-[000913].

Oral Administration

In one embodiment, the polynucleotides described here may be formulated for oral administration by the methods or compositions described in International Patent Application No. PCT/US2014/027077, the contents of which are incorporated by reference in its entirety, such as in paragraphs [000914]-[000924]. The oral administration may be a liquid dosage for or a solid dosage form.

Topical or Transdermal Administration

In one embodiment, the polynucleotides described here may be formulated for topical or transdermal administration by the methods or compositions described in International Patent Application No. PCT/US2014/027077, the contents of which are incorporated by reference in its entirety, such as in paragraphs [000925]-[000941].

Depot Administration

In one embodiment, the polynucleotides described here may be formulated for depot administration by the methods or compositions described in International Patent Application No. PCT/US2014/027077, the contents of which are incorporated by reference in its entirety, such as in paragraphs [000942]-[000948]. Pulmonary Administration In one embodiment, the polynucleotides described here may be formulated for pulmonary administration by the methods or compositions described in International Patent Application No. PCT/US2014/027077, the contents of which are incorporated by reference in its entirety, such as in paragraphs [000949]-[000954].

Intranasal, Nasal and Buccal Administration

In one embodiment, the polynucleotides described here may be formulated for intranasal, nasal or buccal administration by the methods or compositions described in International Patent Application No. PCT/US2014/027077, the contents of which are incorporated by reference in its entirety, such as in paragraphs [000955]-[000958].

Ophthalmic and Auricular (Otic) Administration

In one embodiment, the polynucleotides described here may be formulated for ophthalmic or auricular (otic) administration by the methods or compositions described in International Patent Application No. PCT/US2014/027077, the contents of which are incorporated by reference in its entirety, such as in paragraphs [000959]-[000965].

Payload Administration: Detectable Agents and Therapeutic Agents

The polynucleotides described herein can be used in a number of different scenarios in which delivery of a substance (the "payload") to a biological target is desired, for example delivery of detectable substances for detection of the target, or delivery of a therapeutic agent. Detection methods can include, but are not limited to, both imaging in vitro and in vivo imaging methods, e.g., immunohistochemistry, bioluminescence imaging (BLI), Magnetic Resonance Imaging (MM), positron emission tomography (PET), electron microscopy, X-ray computed tomography, Raman imaging, optical coherence tomography, absorption imaging, thermal imaging, fluorescence reflectance imaging, fluorescence microscopy, fluorescence molecular tomographic imaging, nuclear magnetic resonance imaging, X-ray imaging, ultrasound imaging, photoacoustic imaging, lab assays, or in any situation where tagging/staining/imaging is required.

The polynucleotides can be designed to include both a linker and a payload in any useful orientation. For example, a linker having two ends is used to attach one end to the payload and the other end to the nucleobase, such as at the C-7 or C-8 positions of the deaza-adenosine or deaza-guanosine or to the N-3 or C-5 positions of cytosine or uracil. The polynucleotide of the invention can include more than one payload (e.g., a label and a transcription inhibitor), as well as a cleavable linker. In one embodiment, the modified nucleotide is a modified 7-deaza-adenosine triphosphate, where one end of a cleavable linker is attached to the C7 position of 7-deaza-adenine, the other end of the linker is attached to an inhibitor (e.g., to the C5 position of the nucleobase on a cytidine), and a label (e.g., Cy5) is attached to the center of the linker (see, e.g., compound 1 of A*pCp C5 Parg Capless in FIG. 5 and columns 9 and 10 of U.S. Pat. No. 7,994,304, incorporated herein by reference). Upon incorporation of the modified 7-deaza-adenosine triphosphate to an encoding region, the resulting polynucleotide having a cleavable linker attached to a label and an inhibitor (e.g., a polymerase inhibitor). Upon cleavage of the linker (e.g., with reductive conditions to reduce a linker having a cleavable disulfide moiety), the label and inhibitor are released. Additional linkers and payloads (e.g., therapeutic agents, detectable labels, and cell penetrating payloads) are described herein and in International Application PCT/US2013/30062 filed Mar. 9, 2013, the contents of which are incorporated herein by reference in their entirety.

The polynucleotides described herein can be used in intracellular targeting of a payload, e.g., detectable or therapeutic agent, to specific organelle. Exemplary intracellular targets can include, but are not limited to, the nuclear localization for advanced mRNA processing, or a nuclear localization sequence (NLS) linked to the mRNA containing an inhibitor.

In one example, the linker is attached at the 2'-position of the ribose ring and/or at the 3' and/or 5' position of the polynucleotides (See e.g., International Pub. No. WO2012030683, herein incorporated by reference in its entirety). The linker may be any linker disclosed herein, known in the art and/or disclosed in International Pub. No. WO2012030683, herein incorporated by reference in its entirety.

In another example, the polynucleotides can be attached to the polynucleotides a viral inhibitory peptide (VIP) through a cleavable linker. The cleavable linker can release the VIP and dye into the cell. In another example, the polynucleotides can be attached through the linker to an ADP-ribosylate, which is responsible for the actions of some bacterial toxins, such as cholera toxin, diphtheria toxin, and pertussis toxin. These toxin proteins are ADP-ribosyltransferases that modify target proteins in human cells. For example, cholera toxin ADP-ribosylates G proteins modifies human cells by causing massive fluid secretion from the lining of the small intestine, which results in life-threatening diarrhea.

In some embodiments, the payload may be a therapeutic agent such as a cytotoxin, radioactive ion, chemotherapeutic, or other therapeutic agent. A cytotoxin or cytotoxic agent includes any agent that may be detrimental to cells. Examples include, but are not limited to, taxol, cytochalasin B, gramicidin D, ethidium bromide, emetine, mitomycin, etoposide, teniposide, vincristine, vinblastine, colchicine, doxorubicin, daunorubicin, dihydroxyanthracinedione, mitoxantrone, mithramycin, actinomycin D, 1-dehydrotestosterone, glucocorticoids, procaine, tetracaine, lidocaine, propranolol, puromycin, maytansinoids, e.g., maytansinol (see U.S. Pat. No. 5,208,020 incorporated herein in its entirety), rachelmycin (CC-1065, see U.S. Pat. Nos. 5,475,092, 5,585,499, and 5,846,545, all of which are incorporated herein by reference), and analogs or homologs thereof. Radioactive ions include, but are not limited to iodine (e.g., iodine 125 or iodine 131), strontium 89, phosphorous, palladium, cesium, iridium, phosphate, cobalt, yttrium 90, samarium 153, and praseodymium. Other therapeutic agents include, but are not limited to, antimetabolites (e.g., methotrexate, 6-mercaptopurine, 6-thioguanine, cytarabine, 5-fluorouracil decarbazine), alkylating agents (e.g., mechlorethamine, thiotepa chlorambucil, rachelmycin (CC-1065), melphalan, carmustine (BSNU), lomustine (CCNU), cyclophosphamide, busulfan, dibromomannitol, streptozotocin, mitomycin C, and cis-dichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC)), and anti-mitotic agents (e.g., vincristine, vinblastine, taxol and maytansinoids).

In some embodiments, the payload may be a detectable agent, such as various organic small molecules, inorganic compounds, nanoparticles, enzymes or enzyme substrates, fluorescent materials, luminescent materials (e.g., luminol), bioluminescent materials (e.g., luciferase, luciferin, and aequorin), chemiluminescent materials, radioactive materials (e.g., $^{18}$F, $^{67}$Ga, $^{81m}$Kr, $^{82}$Rb, $^{111}$In, $^{123}$I, $^{133}$Xe, $^{201}$Tl, $^{125}$I, $^{35}$S, $^{14}$C, $^{3}$H, or $^{99m}$Tc (e.g., as pertechnetate (technetate (VII), TcO$_4^-$)), and contrast agents (e.g., gold (e.g., gold nanoparticles), gadolinium (e.g., chelated Gd), iron oxides (e.g., superparamagnetic iron oxide (SPIO), monocrystalline iron oxide nanoparticles (MIONs), and ultrasmall superparamagnetic iron oxide (USPIO)), manganese chelates (e.g., Mn-DPDP), barium sulfate, iodinated contrast media (iohexol), microbubbles, or perfluorocarbons). Such optically-detectable labels include for example, without limitation, 4-acetamido-4'-isothiocyanatostilbene-2,2'disulfonic acid; acridine and derivatives (e.g., acridine and acridine isothiocyanate); 5-(2'-aminoethyl)aminonaphthalene-1-sulfonic acid (EDANS); 4-amino-N-[3-vinylsulfonyl)phenyl]naphthalimide-3,5 disulfonate; N-(4-anilino-1-naphthyl)maleimide; anthranilamide; BODIPY; Brilliant Yellow; coumarin and derivatives (e.g., coumarin, 7-amino-4-methylcoumarin (AMC, Coumarin 120), and 7-amino-4-trifluoromethylcoumarin (Coumarin 151)); cyanine dyes; cyanosine; 4',6-diaminidino-2-phenylindole (DAPI); 5' 5"-dibromopyrogallol-sulfonaphthalein (Bromopyrogallol Red); 7-diethylamino-3-(4'-isothiocyanatophenyl)-4-methylcoumarin; diethylenetriamine pentaacetate; 4,4'-diisothiocyanatodihydro-stilbene-2,2'-disulfonic acid; 4,4'-diisothiocyanatostilbene-2,2'-disulfonic acid; 5-[dimethylamino]-naphthalene-1-sulfonyl chloride (DNS, dansylchloride); 4-dimethylaminophenylazophenyl-4'-isothiocyanate (DABITC); eosin and derivatives (e.g., eosin and eosin isothiocyanate); erythrosin and derivatives (e.g., erythrosin B and erythrosin isothiocyanate); ethidium; fluorescein and derivatives (e.g., 5-carboxyfluorescein (FAM), 5-(4,6-dichlorotriazin-2-yl)aminofluorescein (DTAF), 2',7'-dimethoxy-4'5'-dichloro-6-carboxyfluorescein, fluorescein, fluorescein isothiocyanate, X-rhodamine-5-(and-6)-isothiocyanate (QFITC or XRITC), and fluorescamine); 2-[2-[3-[[1,3-dihydro-1,1-dimethyl-3-(3-sulfopropyl)-2H-benz[e]indol-2-ylidene]ethylidene]-2-[4-(ethoxycarbonyl)-1-piperazinyl]-1-cyclopenten-1-yl]ethenyl]-1,1-dimethyl-3-(3-sulforpropyl)-1H-benz[e]indolium hydroxide, inner salt, compound with n,n-diethylethanamine(1:1) (IR144); 5-chloro-2-[2-[3-[(5-chloro-3-ethyl-2(3H)-benzothiazol-ylidene)ethylidene]-2-(diphenylamino)-1-cyclopenten-1-yl] ethenyl]-3-ethyl benzothiazolium perchlorate (IR140); Malachite Green isothiocyanate; 4-methylumbelliferone orthocresolphthalein; nitrotyrosine; pararosaniline; Phenol Red; B-phycoerythrin; o-phthaldialdehyde; pyrene and derivatives(e.g., pyrene, pyrene butyrate, and succinimidyl 1-pyrene); butyrate quantum dots; Reactive Red 4 (CIBACRON™ Brilliant Red 3B-A); rhodamine and derivatives (e.g., 6-carboxy-X-rhodamine (ROX), 6-carboxyrhodamine (R6G), lissamine rhodamine B sulfonyl chloride rhodarnine (Rhod), rhodamine B, rhodamine 123, rhodamine X isothiocyanate, sulforhodamine B, sulforhodamine 101, sulfonyl chloride derivative of sulforhodamine 101 (Texas Red), N,N,N',N'tetramethyl-6-carboxyrhodamine (TAMRA) tetramethyl rhodamine, and tetramethyl rhodamine isothiocyanate (TRITC)); riboflavin; rosolic acid; terbium chelate derivatives; Cyanine-3 (Cy3); Cyanine-5 (Cy5); cyanine-5.5 (Cy5.5), Cyanine-7 (Cy7); IRD 700; IRD 800; Alexa 647; La Jolta Blue; phthalo cyanine; and naphthalo cyanine.

In some embodiments, the detectable agent may be a non-detectable pre-cursor that becomes detectable upon activation (e.g., fluorogenic tetrazine-fluorophore constructs (e.g., tetrazine-BODIPY FL, tetrazine-Oregon Green 488, or tetrazine-BODIPY TMR-X) or enzyme activatable fluorogenic agents (e.g., PROSENSE® (VisEn Medical))). In vitro assays in which the enzyme labeled compositions can be used include, but are not limited to, enzyme linked immunosorbent assays (ELISAs), immunoprecipitation assays, immunofluorescence, enzyme immunoassays (EIA), radioimmunoassays (RIA), and Western blot analysis.

Combinations

The polynucleotides may be used in combination with one or more other therapeutic, prophylactic, diagnostic, or imaging agents. By "in combination with," it is not intended to imply that the agents must be administered at the same time and/or formulated for delivery together, although these methods of delivery are within the scope of the present disclosure. Compositions can be administered concurrently with, prior to, or subsequent to, one or more other desired therapeutics or medical procedures. In general, each agent will be administered at a dose and/or on a time schedule determined for that agent. In some embodiments, the present disclosure encompasses the delivery of pharmaceutical, prophylactic, diagnostic, or imaging compositions in combination with agents that may improve their bioavailability, reduce and/or modify their metabolism, inhibit their excretion, and/or modify their distribution within the body. In one embodiment, the polynucleotides described here may be used in combination with one or more other agents as described in International Patent Application No. PCT/US2014/027077, the contents of which are incorporated by reference in its entirety, such as in paragraphs [000978]-[001023].

It will further be appreciated that therapeutically, prophylactically, diagnostically, or imaging active agents utilized in combination may be administered together in a single composition or administered separately in different compositions. In general, it is expected that agents utilized in combination with be utilized at levels that do not exceed the levels at which they are utilized individually. In some embodiments, the levels utilized in combination will be lower than those utilized individually. In one embodiment, the combinations, each or together may be administered according to the split dosing regimens described herein.

Dosing

The present invention provides methods comprising administering modified mRNAs and their encoded proteins or complexes in accordance with the invention to a subject in need thereof. Nucleic acids, proteins or complexes, or pharmaceutical, imaging, diagnostic, or prophylactic compositions thereof, may be administered to a subject using any amount and any route of administration effective for preventing, treating, diagnosing, or imaging a disease, disorder, and/or condition (e.g., a disease, disorder, and/or condition relating to working memory deficits). The exact amount required will vary from subject to subject, depending on the species, age, and general condition of the subject, the severity of the disease, the particular composition, its mode of administration, its mode of activity, and the like. Compositions in accordance with the invention are typically formulated in dosage unit form for ease of administration and uniformity of dosage. It will be understood, however, that the total daily usage of the compositions of the present invention may be decided by the attending physician within the scope of sound medical judgment. The specific therapeutically effective, prophylactically effective, or appropriate imaging dose level for any particular patient will depend upon a variety of factors including the disorder being treated and the severity of the disorder; the activity of the specific compound employed; the specific composition employed; the age, body weight, general health, sex and diet of the patient; the time of administration, route of administration, and rate of excretion of the specific compound employed; the duration of the treatment; drugs used in combination or coincidental with the specific compound employed; and like factors well known in the medical arts.

In certain embodiments, compositions in accordance with the present invention may be administered at dosage levels sufficient to deliver from about 0.0001 mg/kg to about 100 mg/kg, from about 0.001 mg/kg to about 0.05 mg/kg, from about 0.005 mg/kg to about 0.05 mg/kg, from about 0.001 mg/kg to about 0.005 mg/kg, from about 0.05 mg/kg to about 0.5 mg/kg, from about 0.01 mg/kg to about 50 mg/kg, from about 0.1 mg/kg to about 40 mg/kg, from about 0.5 mg/kg to about 30 mg/kg, from about 0.01 mg/kg to about 10 mg/kg, from about 0.1 mg/kg to about 10 mg/kg, or from about 1 mg/kg to about 25 mg/kg, of subject body weight per day, one or more times a day, to obtain the desired therapeutic, diagnostic, prophylactic, or imaging effect (see e.g., the range of unit doses described in International Publication No WO2013078199, herein incorporated by reference in its entirety). The desired dosage may be delivered three times a day, two times a day, once a day, every other day, every third day, every week, every two weeks, every three weeks, or every four weeks. In certain embodiments, the desired dosage may be delivered using multiple administrations (e.g., two, three, four, five, six, seven, eight, nine, ten, eleven, twelve, thirteen, fourteen, or more administrations). When multiple administrations are employed, split dosing regimens such as those described herein may be used.

According to the present invention, it has been discovered that administration of polynucleotides in split-dose regimens produce higher levels of proteins in mammalian subjects. As used herein, a "split dose" is the division of single unit dose or total daily dose into two or more doses, e.g, two or more administrations of the single unit dose. As used herein, a "single unit dose" is a dose of any therapeutic administed in one dose/at one time/single route/single point of contact, i.e., single administration event. As used herein, a "total daily dose" is an amount given or prescribed in 24 hr period. It may be administered as a single unit dose. In one embodiment, the polynucleotides of the present invention are administed to a subject in split doses. The polynucleotides may be formulated in buffer only or in a formulation described herein.

Dosage Forms

A pharmaceutical composition described herein can be formulated into a dosage form described herein, such as a topical, intranasal, intratracheal, or injectable (e.g., intravenous, intraocular, intravitreal, intramuscular, intracardiac, intraperitoneal, subcutaneous).

Liquid Dosage Forms

Liquid dosage forms for parenteral administration include, but are not limited to, pharmaceutically acceptable emulsions, microemulsions, solutions, suspensions, syrups, and/or elixirs. In addition to active ingredients, liquid dosage forms may comprise inert diluents commonly used in the art including, but not limited to, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (in particular, cottonseed, groundnut, corn, germ, olive, castor, and sesame oils), glycerol, tetrahydrofurfuryl alcohol, polyethylene glycols and fatty acid esters of sorbitan, and mixtures thereof. In certain embodiments for parenteral administration, compositions may be mixed with solubilizing agents such as CREMOPHOR®, alcohols, oils, modified oils, glycols, polysorbates, cyclodextrins, polymers, and/or combinations thereof.

Injectable

Injectable preparations, for example, sterile injectable aqueous or oleaginous suspensions may be formulated according to the known art and may include suitable dispersing agents, wetting agents, and/or suspending agents. Sterile injectable preparations may be sterile injectable solutions, suspensions, and/or emulsions in nontoxic parenterally acceptable diluents and/or solvents, for example, a solution in 1,3-butanediol. Among the acceptable vehicles and solvents that may be employed include, but are not limited to, water, Ringer's solution, U.S.P., and isotonic sodium chloride solution. Sterile, fixed oils are conventionally employed as a solvent or suspending medium. For this purpose any bland fixed oil can be employed including synthetic mono- or diglycerides. Fatty acids such as oleic acid can be used in the preparation of injectables.

Injectable formulations can be sterilized, for example, by filtration through a bacterial-retaining filter, and/or by incorporating sterilizing agents in the form of sterile solid compositions which can be dissolved or dispersed in sterile water or other sterile injectable medium prior to use.

In order to prolong the effect of an active ingredient, it may be desirable to slow the absorption of the active ingredient from subcutaneous or intramuscular injection. This may be accomplished by the use of a liquid suspension of crystalline or amorphous material with poor water solubility. The rate of absorption of the polynucleotides then depends upon its rate of dissolution which, in turn, may depend upon crystal size and crystalline form. Alternatively, delayed absorption of a parenterally administered polynucleotides may be accomplished by dissolving or suspending the polynucleotides in an oil vehicle. Injectable depot forms are made by forming microencapsule matrices of the polynucleotides in biodegradable polymers such as polylactide-polyglycolide. Depending upon the ratio of polynucleotides to polymer and the nature of the particular polymer employed, the rate of polynucleotides release can be controlled. Examples of other biodegradable polymers include, but are not limited to, poly(orthoesters) and poly(anhydrides). Depot injectable formulations may be prepared by entrapping the polynucleotides in liposomes or microemulsions which are compatible with body tissues.

Pulmonary

Formulations described herein as being useful for pulmonary delivery may also be used for intranasal delivery of a pharmaceutical composition. Another formulation suitable for intranasal administration may be a coarse powder comprising the active ingredient and having an average particle from about 0.2 μm to 500 μm. Such a formulation may be administered in the manner in which snuff is taken, i.e. by rapid inhalation through the nasal passage from a container of the powder held close to the nose.

Formulations suitable for nasal administration may, for example, comprise from about as little as 0.1% (w/w) and as much as 100% (w/w) of active ingredient, and may comprise one or more of the additional ingredients described herein. A pharmaceutical composition may be prepared, packaged, and/or sold in a formulation suitable for buccal administration. Such formulations may, for example, be in the form of tablets and/or lozenges made using conventional methods, and may, for example, contain about 0.1% to 20% (w/w) active ingredient, where the balance may comprise an orally dissolvable and/or degradable composition and, optionally, one or more of the additional ingredients described herein. Alternately, formulations suitable for buccal administration may comprise a powder and/or an aerosolized and/or atomized solution and/or suspension comprising active ingredient. Such powdered, aerosolized, and/or aerosolized formulations, when dispersed, may have an average particle and/or droplet size in the range from about 0.1 nm to about 200 nm, and may further comprise one or more of any additional ingredients described herein.

General considerations in the formulation and/or manufacture of pharmaceutical agents may be found, for example, in Remington: The Science and Practice of Pharmacy $21^{st}$ ed., Lippincott Williams & Wilkins, 2005 (incorporated herein by reference in its entirety).

Coatings or Shells

Solid dosage forms of tablets, dragees, capsules, pills, and granules can be prepared with coatings and shells such as enteric coatings and other coatings well known in the pharmaceutical formulating art. They may optionally comprise opacifying agents and can be of a composition that they release the active ingredient(s) only, or preferentially, in a certain part of the intestinal tract, optionally, in a delayed manner. Examples of embedding compositions which can be used include polymeric substances and waxes. Solid compositions of a similar type may be employed as fillers in soft and hard-filled gelatin capsules using such excipients as lactose or milk sugar as well as high molecular weight polyethylene glycols and the like.

Multi-Dose and Repeat-Dose Administration

In some embodiments, compounds and/or compositions of the present invention may be administered in two or more doses (referred to herein as "multi-dose administration").

Such doses may comprise the same components or may comprise components not included in a previous dose. Such doses may comprise the same mass and/or volume of components or an altered mass and/or volume of components in comparison to a previous dose. In some embodiments, multi-dose administration may comprise repeat-dose administration. As used herein, the term "repeat-dose administration" refers to two or more doses administered consecutively or within a regimen of repeat doses comprising substantially the same components provided at substantially the same mass and/or volume. In some embodiments, subjects may display a repeat-dose response. As used herein, the term "repeat-dose response" refers to a response in a subject to a repeat-dose that differs from that of another dose administered within a repeat-dose administration regimen. In some embodiments, such a response may be the expression of a protein in response to a repeat-dose comprising mRNA. In such embodiments, protein expression may be elevated in comparison to another dose administered within a repeat-dose administration regimen or protein expression may be reduced in comparison to another dose administered within a repeat-dose administration regimen. Alteration of protein expression may be from about 1% to about 20%, from about 5% to about 50% from about 10% to about 60%, from about 25% to about 75%, from about 40% to about 100% and/or at least 100%. A reduction in expression of mRNA administered as part of a repeat-dose regimen, wherein the level of protein translated from the administered RNA is reduced by more than 40% in comparison to another dose within the repeat-dose regimen is referred to herein as "repeat-dose resistance."

Properties of the Pharmaceutical Compositions

The pharmaceutical compositions described herein can be characterized by one or more of the following properties:

Bioavailability

The polynucleotides, when formulated into a composition with a delivery agent as described herein, can exhibit an increase in bioavailability as compared to a composition lacking a delivery agent as described herein. As used herein, the term "bioavailability" refers to the systemic availability of a given amount of polynucleotides administered to a mammal. Bioavailability can be assessed by measuring the area under the curve (AUC) or the maximum serum or plasma concentration ($C_{max}$) of the unchanged form of a compound following administration of the compound to a mammal. AUC is a determination of the area under the curve plotting the serum or plasma concentration of a compound along the ordinate (Y-axis) against time along the abscissa (X-axis). Generally, the AUC for a particular compound can be calculated using methods known to those of ordinary skill in the art and as described in G. S. Banker, Modern Pharmaceutics, Drugs and the Pharmaceutical Sciences, v. 72, Marcel Dekker, New York, Inc., 1996, herein incorporated by reference in its entirety.

The $C_{max}$ value is the maximum concentration of the compound achieved in the serum or plasma of a mammal following administration of the compound to the mammal. The $C_{max}$ value of a particular compound can be measured using methods known to those of ordinary skill in the art. The phrases "increasing bioavailability" or "improving the pharmacokinetics," as used herein mean that the systemic availability of a first polynucleotides, measured as AUC, $C_{max}$, or $C_{min}$ in a mammal is greater, when co-administered with a delivery agent as described herein, than when such co-administration does not take place. In some embodiments, the bioavailability of the polynucleotides can increase by at least about 2%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%.

In some embodiments, liquid formulations of polynucleotides may have varying in vivo half-life, requiring modulation of doses to yield a therapeutic effect. To address this, in some embodiments of the present invention, polynucleotides formulations may be designed to improve bioavailability and/or therapeutic effect during repeat administrations. Such formulations may enable sustained release of polynucleotides and/or reduce polynucleotide degradation rates by nucleases. In some embodiments, suspension formulations are provided comprising polynucleotides, water immiscible oil depots, surfactants and/or co-surfactants and/or co-solvents. Combinations of oils and surfactants may enable suspension formulation with polynucleotides. Delivery of polynucleotides in a water immiscible depot may be used to improve bioavailability through sustained release of polynucleotides from the depot to the surrounding physiologic environment and/or prevent polynucleotide degradation by nucleases.

In some embodiments, cationic nanoparticles comprising combinations of divalent and monovalent cations may be formulated with polynucleotides. Such nanoparticles may form spontaneously in solution over a given period (e.g. hours, days, etc). Such nanoparticles do not form in the presence of divalent cations alone or in the presence of monovalent cations alone. The delivery of polynucleotides in cationic nanoparticles or in one or more depot comprising cationic nanoparticles may improve polynucleotide bioavailability by acting as a long-acting depot and/or reducing the rate of degradation by nucleases.

Therapeutic Window

The polynucleotides, when formulated into a composition with a delivery agent as described herein, can exhibit an increase in the therapeutic window of the administered polynucleotides composition as compared to the therapeutic window of the administered polynucleotides composition lacking a delivery agent as described herein. As used herein "therapeutic window" refers to the range of plasma concentrations, or the range of levels of therapeutically active substance at the site of action, with a high probability of eliciting a therapeutic effect. In some embodiments, the therapeutic window of the polynucleotides when co-administered with a delivery agent as described herein can increase by at least about 2%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%.

Volume of Distribution

The polynucleotides, when formulated into a composition with a delivery agent as described herein, can exhibit an improved volume of distribution ($V_{dist}$), e.g., reduced or targeted, relative to a composition lacking a delivery agent as described herein. The volume of distribution ($V_{dist}$) relates the amount of the drug in the body to the concentration of the drug in the blood or plasma. As used herein, the term "volume of distribution" refers to the fluid volume that would be required to contain the total amount of the drug in the body at the same concentration as in the blood or plasma:

Vdist equals the amount of drug in the body/concentration of drug in blood or plasma. For example, for a 10 mg dose and a plasma concentration of 10 mg/L, the volume of distribution would be 1 liter. The volume of distribution reflects the extent to which the drug is present in the extravascular tissue. A large volume of distribution reflects the tendency of a compound to bind to the tissue components compared with plasma protein binding. In a clinical setting, Vdist can be used to determine a loading dose to achieve a steady state concentration. In some embodiments, the volume of distribution of the polynucleotides when co-administered with a delivery agent as described herein can decrease at least about 2%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%.

Biological Effect

In one embodiment, the biological effect of the modified mRNA delivered to the animals may be categorized by analyzing the protein expression in the animals. The protein expression may be determined from analyzing a biological sample collected from a mammal administered the modified mRNA of the present invention. In one embodiment, the expression protein encoded by the modified mRNA administered to the mammal of at least 50 pg/ml may be preferred. For example, a protein expression of 50-200 pg/ml for the protein encoded by the modified mRNA delivered to the mammal may be seen as a therapeutically effective amount of protein in the mammal.

Detection of Polynucleotides Acids by Mass Spectrometry

Mass spectrometry (MS) is an analytical technique that can provide structural and molecular mass/concentration information on molecules after their conversion to ions. The molecules are first ionized to acquire positive or negative charges and then they travel through the mass analyzer to arrive at different areas of the detector according to their mass/charge (m/z) ratio.

Mass spectrometry is performed using a mass spectrometer which includes an ion source for ionizing the fractionated sample and creating charged molecules for further analysis. For example ionization of the sample may be performed by electrospray ionization (ESI), atmospheric pressure chemical ionization (APCI), photoionization, electron ionization, fast atom bombardment (FAB)/liquid secondary ionization (LSIMS), matrix assisted laser desorption/ionization (MALDI), field ionization, field desorption, thermospray/plasmaspray ionization, and particle beam ionization. The skilled artisan will understand that the choice of ionization method can be determined based on the analyte to be measured, type of sample, the type of detector, the choice of positive versus negative mode, etc.

After the sample has been ionized, the positively charged or negatively charged ions thereby created may be analyzed to determine a mass-to-charge ratio (i.e., m/z). Suitable analyzers for determining mass-to-charge ratios include quadropole analyzers, ion traps analyzers, and time-of-flight analyzers. The ions may be detected using several detection modes. For example, selected ions may be detected (i.e., using a selective ion monitoring mode (SIM)), or alternatively, ions may be detected using a scanning mode, e.g., multiple reaction monitoring (MRM) or selected reaction monitoring (SRM).

Liquid chromatography-multiple reaction monitoring (LC-MS/MRM) coupled with stable isotope labeled dilution of peptide standards has been shown to be an effective method for protein verification (e.g., Keshishian et al., Mol Cell Proteomics 2009 8: 2339-2349; Kuhn et al., Clin Chem 2009 55:1108-1117; Lopez et al., Clin Chem 2010 56:281-290; each of which are herein incorporated by reference in its entirety). Unlike untargeted mass spectrometry frequently used in biomarker discovery studies, targeted MS methods are peptide sequence-based modes of MS that focus the full analytical capacity of the instrument on tens to hundreds of selected peptides in a complex mixture. By restricting detection and fragmentation to only those peptides derived from proteins of interest, sensitivity and reproducibility are improved dramatically compared to discovery-mode MS methods. This method of mass spectrometry-based multiple reaction monitoring (MRM) quantitation of proteins can dramatically impact the discovery and quantitation of biomarkers via rapid, targeted, multiplexed protein expression profiling of clinical samples.

In one embodiment, a biological sample which may contain at least one protein encoded by at least one modified mRNA of the present invention may be analyzed by the method of MRM-MS. The quantification of the biological sample may further include, but is not limited to, isotopically labeled peptides or proteins as internal standards.

According to the present invention, the biological sample, once obtained from the subject, may be subjected to enzyme digestion. As used herein, the term "digest" means to break apart into shorter peptides. As used herein, the phrase "treating a sample to digest proteins" means manipulating a sample in such a way as to break down proteins in a sample. These enzymes include, but are not limited to, trypsin, endoproteinase Glu-C and chymotrypsin. In one embodiment, a biological sample which may contain at least one protein encoded by at least one modified mRNA of the present invention may be digested using enzymes.

In one embodiment, a biological sample which may contain protein encoded by modified mRNA of the present invention may be analyzed for protein using electrospray ionization. Electrospray ionization (ESI) mass spectrometry (ESIMS) uses electrical energy to aid in the transfer of ions from the solution to the gaseous phase before they are analyzed by mass spectrometry. Samples may be analyzed using methods known in the art (e.g., Ho et al., Clin Biochem Rev. 2003 24(1):3-12; herein incorporated by reference in its entirety). The ionic species contained in solution may be transferred into the gas phase by dispersing a fine spray of charge droplets, evaporating the solvent and ejecting the ions from the charged droplets to generate a mist of highly charged droplets. The mist of highly charged droplets may be analyzed using at least 1, at least 2, at least 3 or at least 4 mass analyzers such as, but not limited to, a quadropole mass analyzer. Further, the mass spectrometry method may include a purification step. As a non-limiting example, the first quadrapole may be set to select a single m/z ratio so it may filter out other molecular ions having a different m/z ratio which may eliminate complicated and time-consuming sample purification procedures prior to MS analysis.

In one embodiment, a biological sample which may contain protein encoded by modified mRNA of the present invention may be analyzed for protein in a tandem ESIMS system (e.g., MS/MS). As non-limiting examples, the droplets may be analyzed using a product scan (or daughter scan) a precursor scan (parent scan) a neutral loss or a multiple reaction monitoring.

In one embodiment, a biological sample which may contain protein encoded by modified mRNA of the present invention may be analyzed using matrix-assisted laser desorption/ionization (MALDI) mass spectrometry (MALDIMS). MALDI provides for the nondestructive vaporization and ionization of both large and small molecules, such as proteins. In MALDI analysis, the analyte is first co-crystallized with a large molar excess of a matrix compound, which may also include, but is not limited to, an ultraviolet absorbing weak organic acid. Non-limiting examples of matrices used in MALDI are α-cyano-4-hydroxycinnamic acid, 3,5-dimethoxy-4-hydroxycinnamic acid and 2,5-dihydroxybenzoic acid. Laser radiation of the analyte-matrix mixture may result in the vaporization of the matrix and the analyte. The laser induced desorption provides high ion yields of the intact analyte and allows for measurement of compounds with high accuracy. Samples may be analyzed using methods known in the art (e.g., Lewis, Wei and Siuzdak, Encyclopedia of Analytical Chemistry 2000:5880-5894; herein incorporated by reference in its entirety). As non-limiting examples, mass analyzers used in the MALDI analysis may include a linear time-of-flight (TOF), a TOF reflectron or a Fourier transform mass analyzer.

In one embodiment, the analyte-matrix mixture may be formed using the dried-droplet method. A biologic sample is mixed with a matrix to create a saturated matrix solution where the matrix-to-sample ratio is approximately 5000:1. An aliquot (approximately 0.5-2.0 uL) of the saturated matrix solution is then allowed to dry to form the analyte-matrix mixture.

In one embodiment, the analyte-matrix mixture may be formed using the thin-layer method. A matrix homogeneous film is first formed and then the sample is then applied and may be absorbed by the matrix to form the analyte-matrix mixture.

In one embodiment, the analyte-matrix mixture may be formed using the thick-layer method. A matrix homogeneous film is formed with a nitro-cellulose matrix additive. Once the uniform nitro-cellulose matrix layer is obtained the sample is applied and absorbed into the matrix to form the analyte-matrix mixture.

In one embodiment, the analyte-matrix mixture may be formed using the sandwich method. A thin layer of matrix crystals is prepared as in the thin-layer method followed by the addition of droplets of aqueous trifluoroacetic acid, the sample and matrix. The sample is then absorbed into the matrix to form the analyte-matrix mixture.

V. Uses of Polynucleotides of the Invention

The polynucleotides of the present invention are designed, in preferred embodiments, to provide for avoidance or evasion of deleterious bio-responses such as the immune response and/or degradation pathways, overcoming the threshold of expression and/or improving protein production capacity, improved expression rates or translation efficiency, improved drug or protein half life and/or protein concentrations, optimized protein localization, to improve one or more of the stability and/or clearance in tissues, receptor uptake and/or kinetics, cellular access by the compositions, engagement with translational machinery, secretion efficiency (when applicable), accessibility to circulation, and/or modulation of a cell's status, function and/or activity.

Therapeutics

LDLR Related Diseases, Disorders and/or Conditions

In one embodiment, the polynucleotides of the present invention may be used to treat and/or prevent LDLR-related diseases, disorders or conditions. Non-limiting examples of LDLR-related diseases, disorders or conditions include LDL lowering, cholesterol lowering, hypercholesterolemia, hyperlipidemia and atherosclerosis.

In one embodiment, the polynucleotides of the present invention may be used to reduce the risk of heart disease.

In one embodiment, the polynucleotides of the present invention may be used to reduce the risk of developing atherosclerosis. While not wishing to be bound by theory, atherosclerosis is responsible for a majority of cardiovascular diseases.

In one embodiment, the polynucleotides of the present invention may be used to treat and/or prevent hypercholesterolemia. As a non-limiting example, hypercholesterolemia is familial hypercholesterolemia.

In one embodiment, the polynucleotides of the present invention may be used to lower LDL.

In one embodiment, the polynucleotides of the present invention may be used to lower cholesterol in a subject. As a non-limiting example, the polynucleotides described herein may be able to lower cholesterol levels in the plasma of a subject.

In one embodiment, the polynucleotides of the present invention may be used to treat or prevent hyperlipidemia.

Metabolic Diseases, Disorders and/or Conditions

In one embodiment, the polynucleotides of the present invention may be used to treat and/or prevent metabolic diseases, disorders and/or conditions. As a non-limiting example, the metabolic disease, disorder or condition may be Acid Lipase Disease, Barth Syndrome (BTHS), Central Pontine Myelinolysis, Farber's Disease, Gangliosidoses, Hunter Syndrome, Hurler Syndrome, Trimethylaminuria, Lesch-Nyhan Syndrome, Lipid Storage Disease, Metabolic Myopathy, Mitochondrial Myopathy, Mucolipidoses, Mucolipidoses, Mucopolysaccharidoses, Pompe Disase, Glycogen Storage Disease, Urea Cycle Disease, Hyperoxaluria and Oxalosis.

Cardiovascular Diseases, Disorders and/or Conditions

In one embodiment, the polynucleotides of the present invention may be used to treat and/or prevent cardiovascular diseases, disorders and/or conditions. As a non-limiting example, the cardiovascular disease, disorder or condition may be heart failure, ischemic stroke, hemorrhagic stroke, arrhythmia, stenosis, regurgitation, mitral valve prolapase.

Therapeutic Agents

The polynucleotides of the present invention, such as modified nucleic acids and modified RNAs, and the proteins translated from them described herein can be used as therapeutic or prophylactic agents. They are provided for use in medicine. For example, a polynucleotide described herein can be administered to a subject, wherein the polynucleotide is translated in vivo to produce a therapeutic or prophylactic polypeptide in the subject. Provided are compositions, methods, kits, and reagents for diagnosis, treatment or prevention of a disease or condition in humans and other mammals. The active therapeutic agents of the invention include polynucleotides, cells containing polynucleotides or polypeptides translated from the polynucleotides.

In certain embodiments, provided herein are combination therapeutics containing one or more polynucleotides containing translatable regions that encode for a protein or proteins that boost a mammalian subject's immunity along with a protein that induces antibody-dependent cellular toxicity. For example, provided herein are therapeutics containing one or more nucleic acids that encode trastuzumab and granulocyte-colony stimulating factor (G-CSF). In particular, such combination therapeutics are useful in Her2+ breast cancer patients who develop induced resistance to trastuzumab. (See, e.g., Albrecht, Immunotherapy. 2(6): 795-8 (2010)).

Provided herein are methods of inducing translation of a recombinant polypeptide in a cell population using the polynucleotides described herein. Such translation can be in vivo, ex vivo, in culture, or in vitro. The cell population is contacted with an effective amount of a composition containing a nucleic acid that has at least one nucleoside modification, and a translatable region encoding the recombinant polypeptide. The population is contacted under conditions such that the nucleic acid is localized into one or more cells of the cell population and the recombinant polypeptide is translated in the cell from the nucleic acid.

An "effective amount" of the composition is provided based, at least in part, on the target tissue, target cell type, means of administration, physical characteristics of the nucleic acid (e.g., size, and extent of modified nucleosides), and other determinants. In general, an effective amount of the composition provides efficient protein production in the cell, preferably more efficient than a composition containing a corresponding unmodified nucleic acid. Increased efficiency may be demonstrated by increased cell transfection (i.e., the percentage of cells transfected with the nucleic acid), increased protein translation from the nucleic acid, decreased nucleic acid degradation (as demonstrated, e.g., by increased duration of protein translation from a modified nucleic acid), or reduced innate immune response of the host cell.

Aspects of the invention are directed to methods of inducing in vivo translation of a recombinant polypeptide in a mammalian subject in need thereof. Therein, an effective amount of a composition containing a nucleic acid that has at least one structural or chemical modification and a translatable region encoding the recombinant polypeptide is administered to the subject using the delivery methods described herein. The nucleic acid is provided in an amount and under other conditions such that the nucleic acid is localized into a cell of the subject and the recombinant polypeptide is translated in the cell from the nucleic acid. The cell in which the nucleic acid is localized, or the tissue in which the cell is present, may be targeted with one or more than one rounds of nucleic acid administration.

In certain embodiments, the administered polynucleotides directs production of one or more recombinant polypeptides that provide a functional activity which is substantially absent in the cell, tissue or organism in which the recombinant polypeptide is translated. For example, the missing functional activity may be enzymatic, structural, or gene regulatory in nature. In related embodiments, the administered polynucleotides directs production of one or more recombinant polypeptides that increases (e.g., synergistically) a functional activity which is present but substantially deficient in the cell in which the recombinant polypeptide is translated.

In other embodiments, the administered polynucleotides directs production of one or more recombinant polypeptides that replace a polypeptide (or multiple polypeptides) that is substantially absent in the cell in which the recombinant polypeptide is translated. Such absence may be due to genetic mutation of the encoding gene or regulatory pathway thereof. In some embodiments, the recombinant polypeptide increases the level of an endogenous protein in the cell to a desirable level; such an increase may bring the level of the endogenous protein from a subnormal level to a normal level or from a normal level to a super-normal level.

Alternatively, the recombinant polypeptide functions to antagonize the activity of an endogenous protein present in, on the surface of, or secreted from the cell. Usually, the activity of the endogenous protein is deleterious to the subject; for example, due to mutation of the endogenous protein resulting in altered activity or localization. Additionally, the recombinant polypeptide antagonizes, directly or indirectly, the activity of a biological moiety present in, on the surface of, or secreted from the cell. Examples of antagonized biological moieties include lipids (e.g., cholesterol), a lipoprotein (e.g., low density lipoprotein), a nucleic acid, a carbohydrate, a protein toxin such as shiga and tetanus toxins, or a small molecule toxin such as botulinum, cholera, and diphtheria toxins. Additionally, the antagonized biological molecule may be an endogenous protein that exhibits an undesirable activity, such as a cytotoxic or cytostatic activity.

The recombinant proteins described herein may be engineered for localization within the cell, potentially within a specific compartment such as the nucleus, or are engineered for secretion from the cell or translocation to the plasma membrane of the cell.

In some embodiments, polynucleotides and their encoded polypeptides in accordance with the present invention may be used for treatment of any of a variety of diseases, disorders, and/or conditions, including but not limited to one or more of the following: autoimmune disorders (e.g. diabetes, lupus, multiple sclerosis, psoriasis, rheumatoid arthritis); inflammatory disorders (e.g. arthritis, pelvic inflammatory disease); infectious diseases (e.g. viral infections (e.g., HIV, HCV, RSV), bacterial infections, fungal infections, sepsis); neurological disorders (e.g. Alzheimer's disease, Huntington's disease; autism; Duchenne muscular dystrophy); cardiovascular disorders (e.g. atherosclerosis, hypercholesterolemia, thrombosis, clotting disorders, angiogenic disorders such as macular degeneration); proliferative disorders (e.g. cancer, benign neoplasms); respiratory disorders (e.g. chronic obstructive pulmonary disease); digestive disorders (e.g. inflammatory bowel disease, ulcers); musculoskeletal disorders (e.g. fibromyalgia, arthritis); endocrine, metabolic, and nutritional disorders (e.g. diabetes, osteoporosis); urological disorders (e.g. renal disease); psychological disorders (e.g. depression, schizophrenia); skin disorders (e.g. wounds, eczema); blood and lymphatic disorders (e.g. anemia, hemophilia); etc.

In another embodiment, the present invention provides a method for treating hyperlipidemia in a subject, by introducing into a cell population of the subject with a modified mRNA molecule encoding Sortilin, a protein recently characterized by genomic studies, thereby ameliorating the hyperlipidemia in a subject. The SORT1 gene encodes a trans-Golgi network (TGN) transmembrane protein called Sortilin. Genetic studies have shown that one of five individuals has a single nucleotide polymorphism, rs12740374, in the 1p13 locus of the SORT1 gene that predisposes them to having low levels of low-density lipoprotein (LDL) and very-low-density lipoprotein (VLDL). Each copy of the minor allele, present in about 30% of people, alters LDL cholesterol by 8 mg/dL, while two copies of the minor allele, present in about 5% of the population, lowers LDL cholesterol 16 mg/dL. Carriers of the minor allele have also been shown to have a 40% decreased risk of myocardial infarction. Functional in vivo studies in mice describes that overexpression of SORT1 in mouse liver tissue led to significantly lower LDL-cholesterol levels, as much as 80% lower, and that silencing SORT1 increased LDL cholesterol approximately 200% (Musunuru K et al. From noncoding variant to phenotype via SORT1 at the 1p13 cholesterol locus. *Nature* 2010; 466: 714-721).

Other aspects of the present disclosure relate to transplantation of cells containing polynucleotides to a mammalian subject. Administration of cells to mammalian subjects is known to those of ordinary skill in the art, and include, but is not limited to, local implantation (e.g., topical or subcutaneous administration), organ delivery or systemic injection (e.g., intravenous injection or inhalation), and the formulation of cells in pharmaceutically acceptable carrier. Such compositions containing polynucleotides can be formulated for administration intramuscularly, transarterially, intraperitoneally, intravenously, intranasally, subcutaneously, endoscopically, transdermally, or intrathecally. In some embodiments, the composition may be formulated for extended release.

The subject to whom the therapeutic agent may be administered suffers from or may be at risk of developing a disease, disorder, or deleterious condition. Provided are methods of identifying, diagnosing, and classifying subjects on these bases, which may include clinical diagnosis, biomarker levels, genome-wide association studies (GWAS), and other methods known in the art.

Modulation of the Immune Response
Avoidance of the Immune Response

As described herein, a useful feature of the polynucleotides of the invention is the capacity to reduce, evade or avoid the innate immune response of a cell. In one aspect, provided herein are polynucleotides encoding a polypeptide of interest which when delivered to cells, results in a reduced immune response from the host as compared to the response triggered by a reference compound, e.g. an unmodified polynucleotide corresponding to a polynucleotide of the invention, or different polynucleotides of the invention. As used herein, a "reference compound" is any molecule or substance which when administered to a mammal, results in an innate immune response having a known degree, level or amount of immune stimmulation. A reference compound need not be a nucleic acid molecule and it need not be any of the polynucleotides of the invention. Hence, the measure of a polynucleotides avoidance, evasion or failure to trigger an immune response can be expressed in terms relative to any compound or substance which is known to trigger such a response.

The term "innate immune response" includes a cellular response to exogenous single stranded nucleic acids, generally of viral or bacterial origin, which involves the induction of cytokine expression and release, particularly the interferons, and cell death. As used herein, the innate immune response or interferon response operates at the single cell level causing cytokine expression, cytokine release, global inhibition of protein synthesis, global destruction of cellular RNA, upregulation of major histocompatibility molecules, and/or induction of apoptotic death, induction of gene transcription of genes involved in apoptosis, anti-growth, and innate and adaptive immune cell activation. Some of the genes induced by type I IFNs include PKR, ADAR (adenosine deaminase acting on RNA), OAS (2',5'-oligoadenylate synthetase), RNase L, and Mx proteins. PKR and ADAR lead to inhibition of translation initiation and RNA editing, respectively. OAS is a dsRNA-dependent synthetase that activates the endoribonuclease RNase L to degrade ssRNA.

In some embodiments, the innate immune response comprises expression of a Type I or Type II interferon, and the expression of the Type I or Type II interferon is not increased more than two-fold compared to a reference from a cell which has not been contacted with a polynucleotide of the invention.

In some embodiments, the innate immune response comprises expression of one or more IFN signature genes and where the expression of the one of more IFN signature genes is not increased more than three-fold compared to a reference from a cell which has not been contacted with the polynucleotides of the invention.

While in some circumstances, it might be advantageous to eliminate the innate immune response in a cell, the invention provides polynucleotides that upon administration result in a substantially reduced (significantly less) the immune response, including interferon signaling, without entirely eliminating such a response.

In some embodiments, the immune response is lower by 10%, 20%, 30%, 40%, 50%, 60%, 70%, 80%, 90%, 95%, 99%, 99.9%, or greater than 99.9% as compared to the immune response induced by a reference compound. The immune response itself may be measured by determining the expression or activity level of Type 1 interferons or the expression of interferon-regulated genes such as the toll-like receptors (e.g., TLR7 and TLR8). Reduction of innate immune response can also be measured by measuring the level of decreased cell death following one or more administrations to a cell population; e.g., cell death is 10%, 25%, 50%, 75%, 85%, 90%, 95%, or over 95% less than the cell death frequency observed with a reference compound. Moreover, cell death may affect fewer than 50%, 40%, 30%, 20%, 10%, 5%, 1%, 0.1%, 0.01% or fewer than 0.01% of cells contacted with the polynucleotides.

In another embodiment, the polynucleotides of the present invention are significantly less immunogenic than an unmodified in vitro-synthesized polynucleotide with the same sequence or a reference compound. As used herein, "significantly less immunogenic" refers to a detectable decrease in immunogenicity. In another embodiment, the term refers to a fold decrease in immunogenicity. In another embodiment, the term refers to a decrease such that an effective amount of the polynucleotides can be administered without triggering a detectable immune response. In another embodiment, the term refers to a decrease such that the polynucleotides can be repeatedly administered without eliciting an immune response sufficient to detectably reduce expression of the recombinant protein. In another embodiment, the decrease is such that the polynucleotides can be repeatedly administered without eliciting an immune response sufficient to eliminate detectable expression of the recombinant protein.

In another embodiment, the polynucleotides is 2-fold less immunogenic than its unmodified counterpart or reference compound. In another embodiment, immunogenicity is reduced by a 3-fold factor. In another embodiment, immunogenicity is reduced by a 5-fold factor. In another embodiment, immunogenicity is reduced by a 7-fold factor. In another embodiment, immunogenicity is reduced by a 10-fold factor. In another embodiment, immunogenicity is reduced by a 15-fold factor. In another embodiment, immunogenicity is reduced by a fold factor. In another embodiment, immunogenicity is reduced by a 50-fold factor. In another embodiment, immunogenicity is reduced by a 100-fold factor. In another embodiment, immunogenicity is reduced by a 200-fold factor. In another embodiment, immunogenicity is reduced by a 500-fold factor. In another embodiment, immunogenicity is reduced by a 1000-fold factor. In another embodiment, immunogenicity is reduced by a 2000-fold factor. In another embodiment, immunogenicity is reduced by another fold difference.

Methods of determining immunogenicity are well known in the art, and include, e.g. measuring secretion of cytokines (e.g. IL-12, IFNalpha, TNF-alpha, RANTES, MIP-1alpha or beta, IL-6, IFN-beta, or IL-8), measuring expression of DC activation markers (e.g. CD83, HLA-DR, CD80 and CD86), or measuring ability to act as an adjuvant for an adaptive immune response.

The polynucleotides of the invention, including the combination of modifications taught herein may have superior properties making them more suitable as therapeutic modalities.

It has been determined that the "all or none" model in the art is sorely insufficient to describe the biological phenomena associated with the therapeutic utility of the polynucleotides. The present inventors have determined that to improve protein production, one may consider the nature of the modification, or combination of modifications, the percent modification and survey more than one cytokine or metric to determine the efficacy and risk profile of a particular polynucleotide.

In one aspect of the invention, methods of determining the effectiveness of a polynucleotide as compared to unmodified involves the measure and analysis of one or more cytokines whose expression is triggered by the administration of the exogenous nucleic acid of the invention. These values are compared to administration of an umodified nucleic acid or to a standard metric such as cytokine response, PolyIC, R-848 or other standard known in the art.

One example of a standard metric developed herein is the measure of the ratio of the level or amount of encoded polypeptide (protein) produced in the cell, tissue or organism to the level or amount of one or more (or a panel) of cytokines whose expression is triggered in the cell, tissue or organism as a result of administration or contact with the modified nucleic acid. Such ratios are referred to herein as the Protein:Cytokine Ratio or "PC" Ratio. The higher the PC ratio, the more efficacioius the modified nucleic acid (polynucleotide encoding the protein measured). Preferred PC Ratios, by cytokine, of the present invention may be greater than 1, greater than 10, greater than 100, greater than 1000, greater than 10,000 or more. Modified nucleic acids having higher PC Ratios than a modified nucleic acid of a different or unmodified construct are preferred.

The PC ratio may be further qualified by the percent modification present in the polynucleotide. For example, normalized to a 100% modified nucleic acid, the protein production as a function of cytokine (or risk) or cytokine profile can be determined.

In one embodiment, the present invention provides a method for determining, across chemistries, cytokines or percent modification, the relative efficacy of any particular modified the polynucleotides by comparing the PC Ratio of the modified nucleic acid (polynucleotides).

Polynucleotides containing varying levels of nucleobase substitutions could be produced that maintain increased protein production and decreased immunostimulatory potential. The relative percentage of any modified nucleotide to its naturally occurring nucleotide counterpart can be varied during the IVT reaction (for instance, 100, 50, 25, 10, 5, 2.5, 1, 0.1, 0.01% 5 methyl cytidine usage versus cytidine; 100, 50, 25, 10, 5, 2.5, 1, 0.1, 0.01% pseudouridine or N1-methyl-pseudouridine usage versus uridine). Polynucleotides can also be made that utilize different ratios using 2 or more different nucleotides to the same base (for instance, different ratios of pseudouridine and N1-methyl-pseudouridine). Polynucleotides can also be made with mixed ratios at more than 1 "base" position, such as ratios of 5 methyl cytidine/ cytidine and pseudouridine/N1-methyl-pseudouridine/uridine at the same time. Use of modified mRNA with altered ratios of modified nucleotides can be beneficial in reducing potential exposure to chemically modified nucleotides.

Lastly, positional introduction of modified nucleotides into the polynucleotides which modulate either protein production or immunostimulatory potential or both is also possible. The ability of such polynucleotides to demonstrate these improved properties can be assessed in vitro (using assays such as the PBMC assay described herein), and can also be assessed in vivo through measurement of both polynucleotides-encoded protein production and mediators of innate immune recognition such as cytokines.

In another embodiment, the relative immunogenicity of the polynucleotides and its unmodified counterpart are determined by determining the quantity of the polynucleotides required to elicit one of the above responses to the same degree as a given quantity of the unmodified nucleotide or reference compound. For example, if twice as much polynucleotides are required to elicit the same response, than the polynucleotides is two-fold less immunogenic than the unmodified nucleotide or the reference compound.

In another embodiment, the relative immunogenicity of the polynucleotides and its unmodified counterpart are determined by determining the quantity of cytokine (e.g. IL-12, IFNalpha, TNF-alpha, RANTES, MIP-1alpha or beta, IL-6, IFN-beta, or IL-8) secreted in response to administration of the polynucleotides, relative to the same quantity of the unmodified nucleotide or reference compound. For example, if one-half as much cytokine is secreted, than the polynucleotides is two-fold less immunogenic than the unmodified nucleotide. In another embodiment, background levels of stimulation are subtracted before calculating the immunogenicity in the above methods.

Provided herein are also methods for performing the titration, reduction or elimination of the immune response in a cell or a population of cells. In some embodiments, the cell is contacted with varied doses of the same polynucleotides and dose response is evaluated. In some embodiments, a cell is contacted with a number of different polynucleotides at the same or different doses to determine the optimal composition for producing the desired effect. Regarding the immune response, the desired effect may be to avoid, evade or reduce the immune response of the cell. The desired effect may also be to alter the efficiency of protein production.

The polynucleotides of the present invention may be used to reduce the immune response using the method described in International Publication No. WO2013003475, the contents of which are herein incorporated by reference in its entirety.

Naturally Occurring Mutants

In another embodiment, the polynucleotides can be utilized to express variants of naturally occurring proteins that have an improved disease modifying activity, including increased biological activity, improved patient outcomes, or a protective function, etc. Many such modifier genes have been described in mammals (Nadeau, Current Opinion in Genetics & Development 2003 13:290-295; Hamilton and Yu, PLoS Genet. 2012; 8:e1002644; Corder et al., Nature Genetics 1994 7:180-184; all herein incorporated by reference in their entireties). Examples in humans include Apo E2 protein, Apo A-I variant proteins (Apo A-I Milano, Apo A-I Paris), hyperactive Factor IX protein (Factor IX Padua Arg338Lys), transthyretin mutants (TTR Thr119Met). Expression of ApoE2 (cys112, cys158) has been shown to confer protection relative to other ApoE isoforms (ApoE3 (cys112, arg158), and ApoE4 (arg112, arg158)) by reducing susceptibility to Alzheimer's disease and possibly other conditions such as cardiovascular disease (Corder et al., Nature Genetics 1994 7:180-184; Seripa et al., Rejuvenation Res. 2011 14:491-500; Liu et al. Nat Rev Neurol. 2013

9:106-118; all herein incorporated by reference in their entireties). Expression of Apo A-I variants has been associated with reduced cholesterol (deGoma and Rader, 2011 Nature Rev Cardiol 8:266-271; Nissen et al., 2003 JAMA 290:2292-2300; all herein incorporated by reference in its entirety). The amino acid sequence of ApoA-I in certain populations has been changed to cysteine in Apo A-I Milano (Arg 173 changed to Cys) and in Apo A-I Paris (Arg 151 changed to Cys). Factor IX mutation at position R338L (FIX Padua) results in a Factor IX protein that has ~10-fold increased activity (Simioni et al., N Engl J Med. 2009 361:1671-1675; Finn et al., Blood. 2012 120:4521-4523; Cantore et al., Blood. 2012 120:4517-20; all herein incorporated by reference in their entireties). Mutation of transthyretin at positions 104 or 119 (Arg104 His, Thr119Met) has been shown to provide protection to patients also harboring the disease causing Val30Met mutations (Saraiva, Hum Mutat. 2001 17:493-503; DATA BASE ON TRANSTHYRETIN MUTATIONS www.ibmc.up.pt/mjsaraiva/ttrmut.html; all herein incorporated by reference in its entirety). Differences in clinical presentation and severity of symptoms among Portuguese and Japanese Met 30 patients carrying respectively the Met 119 and the His104 mutations are observed with a clear protective effect exerted by the non pathogenic mutant (Coelho et al. 1996 Neuromuscular Disorders (Suppl) 6: S20; Terazaki et al. 1999. Biochem Biophys Res Commun 264: 365-370; all herein incorporated by reference in its entirety), which confer more stability to the molecule. A modified mRNA encoding these protective TTR alleles can be expressed in TTR amyloidosis patients, thereby reducing the effect of the pathogenic mutant TTR protein.

Low Density Lipoprotein Receptor (LDLR)

Figure 14:
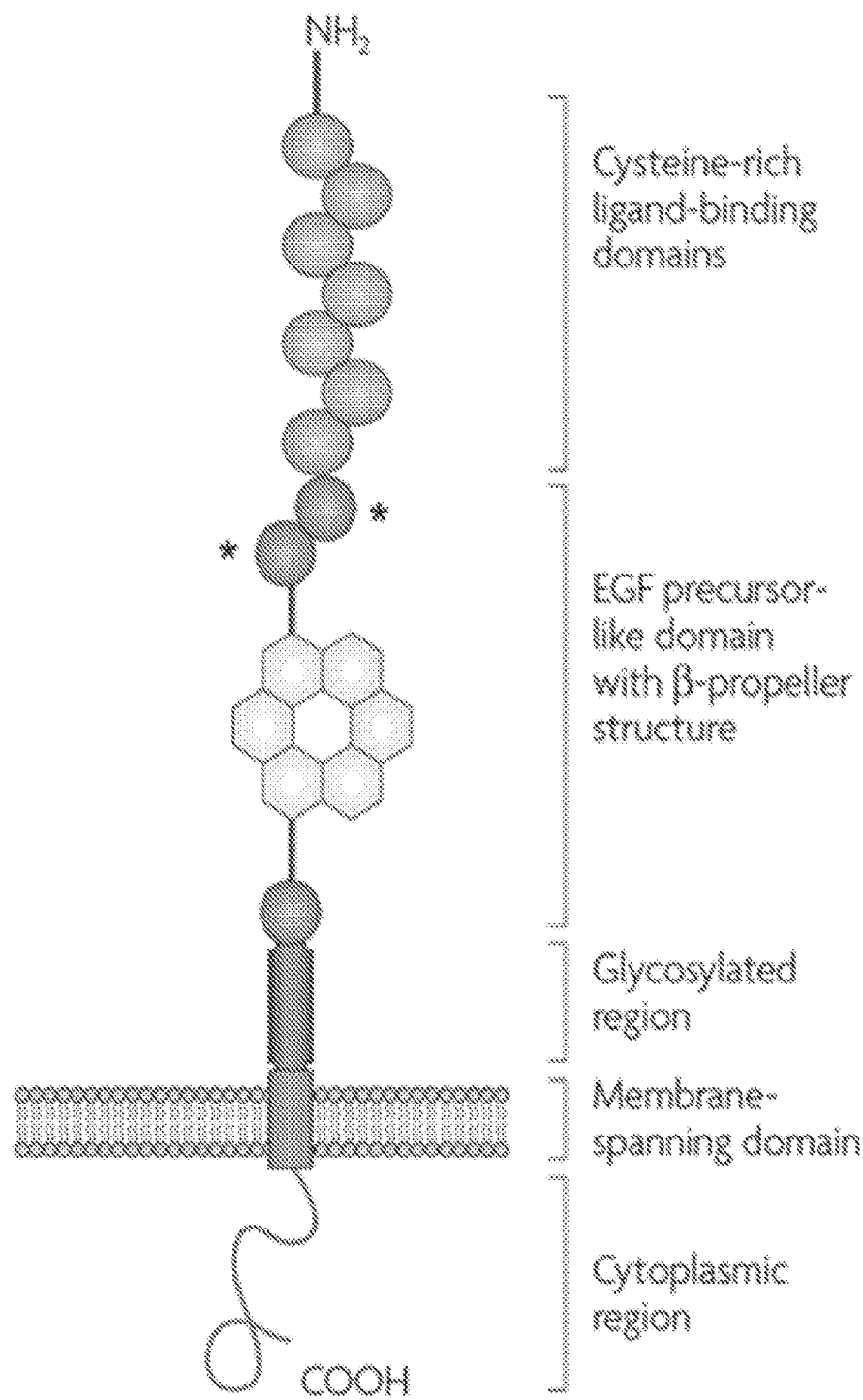
FIG. 14 is a diagram from Watson et al. (Nature Reviews Drug Discovery 7, 84-99 (January 2008)) showing the structure of LDLR.

In one embodiment, the polynucleotides described herein encode at least one low density lipoprotein receptor (LDLR) protein or variant thereof. FIG. 14 from Watson et al., shows the structure of LDLR (see FIG. 4a in Watson et al., Nature Reviews Drug Discovery 7, 84-99 (January 2008); the contents of which are herein incorporated by reference in its entirety) and the asterisks represent regions that are stabilized by calcium binding. LDLR comprises a ligand-binding domain, epidermal growth factor (EGF)-like regions, β-propeller structure, a glycosylated region, a membrane spanning domain and cytoplasmic region. The receptor consists of seven repeats of a cysteine-rich ligand-binding domain, three EGF precursor-like repeats, a six-bladed β-propeller structure composed of Tyr-Trp-Thr-Asp, a heavily glycosylated region, a membrane-spanning domain and a small cytosolic domain containing a NPXY motif for signal transduction.

LDLR plays a critical role in regulating the amount of cholesterol in the blood. LDLR is particularly abundant in the liver, which is the organ responsible for removing most excess cholesterol from the body. The number of LDLRs on the surface of liver cells determines how quickly cholesterol (in the form of low-density lipoproteins) is removed from the bloodstream. Variants, such as mutants, in the LDLR protein can cause the autosomal dominant disorder familial hypercholesterolemia (FH) also known as the inherited form of high cholesterol.

Figure 15:
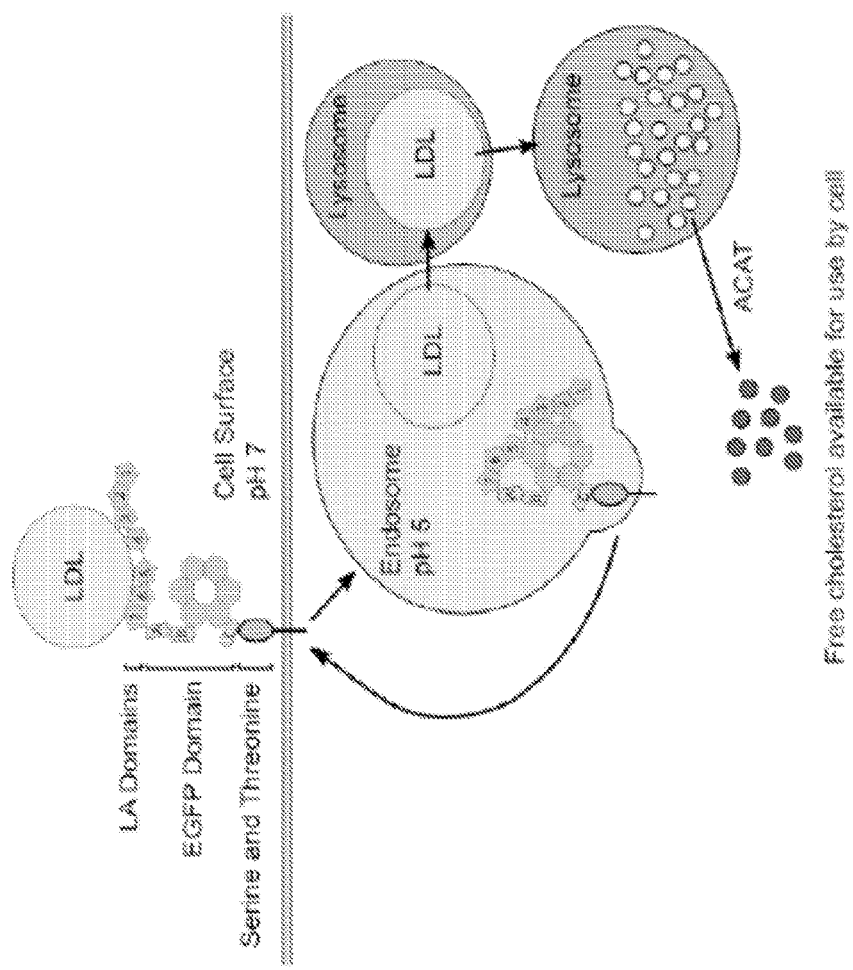
FIG. 15 is a diagram from Daniels et al. (Int J Biol Sci 2009; 5(5): 474-488) showing the function of LDLR.

As shown in FIG. 15 from Daniels et al., LDLR transports circulating LDL in the bloodstream into the cell where LDL is broken down to release cholesterol to be used, stored and/or removed from the body (see e.g., FIG. 4 in Daniels et al. Int J Biol Sci 2009; 5(5): 474-488, the contents of which are herein incorporated by reference in its entirety). Receptors are then recycled to the cell surface. Defective LDLR results in FH and can increase the risk of atherosclerosis and heart disease.

In one embodiment, the polynucleotides described herein encode at least one LDLR protein comprising at least one mutation (e.g., a LDLR cell surface expression enhancing mutation, a mutation increasing the residence time of LDLR at the cell surface or a mutation resulting in increased levels of LDLR at the cell surface). The LDLR protein may include at least one, at least two, at least three, at least four, at least five, at least six, at least seven, at least eight, at least nine or at least 10 mutations. The mutations may be located in 1, 2, 3, 4, 5 or more than 5 different domains of the LDLR protein. In one aspect, the mutation or mutations may be located in the same domain of the LDLR protein. In another aspect, the mutations may be located in 2 different domains of the LDLR. Non-limiting examples of domains of the LDLR protein where mutations may be located include the EGF-A domain, the intracellular domain and the PCSK9 interacting domain.

In one embodiment, when the LDLR protein comprises more than one mutation, and the mutations may be located in the same domain of the LDLR protein or may be located in different domains of the LDLR protein. As a non-limiting example, the mutations may be located in the intracellular domain of the LDLR protein. As another non-limiting example, the EGF-A domain of the LDLR protein.

In one embodiment, the polynucleotides described herein comprise at least one mutation (e.g., a LDLR cell surface expression-enhancing mutation, a mutation increasing the residence time of LDLR at the cell surface or a mutation resulting in increased levels of LDLR at the cell surface).

LDLR Mutants—EGF-A Domain

In one embodiment, the polynucleotides described herein encode at least one LDLR protein comprising at least one mutation (e.g., a LDLR cell surface expression-enhancing mutation, a mutation increasing the residence time of LDLR at the cell surface or a mutation resulting in increased levels of LDLR at the cell surface) in the EGF-A domain of the LDLR protein. As a non-limiting example, the intracellular domain of the LDLR protein may comprise a sequence at least 20%, at least 30%, at least 40%, at least 50%, at least 60%, at least 70%, at least 80%, at least 90%, at least 95%, at least 98% or at least 99% homologous to the sequence GTNECLDNNGGCSHVCNDLKIGYECLCPDG-FQLVAQRRCE (SEQ ID NO: 719). As a non-limiting example, the intracellular domain of the LDLR protein may comprise the sequence GTNECLDNNGGCSHVCNDLKI-GYECLCPDGFQLVAQRRCE (SEQ ID NO: 719). In one aspect, the mutation may be the replacement of an amino acid with electrically charged side chain, acidic (e.g., aspartic acid or glutamic acid) with another acidic amino acid with an electrically charged side chain, acid. As a non-limiting example, Aspartic acid (Asp, D) may be replaced with Glutamic Acid (Glu, E). In another aspect, the mutation may be the replacement of an amino acid with a hydrophobic side chain, aliphatic (e.g., alanine, isoleucine, leucine or valine) with an amino acid with electrically charged side chain, acidic (e.g., aspartic acid or glutamic acid). As a non-limiting example, Leucine (Leu, L) may be replaced with Aspartic acid (Asp, D). In yet another aspect, the mutation may be the replacement of an amino acid with polar neutral side chains (e.g., asparagine, cysteine, glutamine, methionine, serine or threonine) with an amino acid with a hydrophobic side chain, aliphatic (e.g., alanine, isoleucine, leucine or valine). As a non-limiting example, Asparagine (Asn, N) may be replaced with Alanine (Ala, A).

In another aspect, the mutation may be the replacement of an amino acid with electrically charged side chain, acidic (e.g., aspartic acid or glutamic acid) with an amino acid with a hydrophobic side chain, aliphatic (e.g., alanine, isoleucine, leucine or valine) As a non-limiting example, Glutamic acid (Glu, E) may be replaced with Alanine (Ala, A).

In one embodiment, the polynucleotides described herein encode at least one human LDLR protein where the protein is SEQ ID NO: 43 and the EGF-A domain is defined as amino acid 314-amino acid 353 of SEQ ID NO: 43. The LDLR protein may include at least one mutation (e.g., a LDLR cell surface expression-enhancing mutation, a mutation increasing the residence time of LDLR at the cell surface or a mutation resulting in increased levels of LDLR at the cell surface) in the EGF-A domain such as, but not limited to, Aspartic acid at position 331 replaced with Glutamic acid (referred to as D331E), Leucine at position 339 replaced with Aspartic acid (referred to as L339D), Asparagine at position 316 replaced at Alanine (referred to as N316A), Glutamic acid at position 317 replaced with Alanine (referred to as E317A) or a combination thereof. As a non-limiting example, the LDLR protein includes at least one mutation in the EGF-A domain which is D331E. As another non-limiting example, the LDLR protein includes at least one mutation in the EGF-A domain which is L339D. As yet another non-limiting example, the LDLR protein includes at least one mutation in the EGF-A domain which is N316A. As yet another non-limiting example, the LDLR protein includes at least one mutation in the EGF-A domain which is E317A. As another non-limiting example, the LDLR protein includes at least one mutation in the EGF-A domain which is D331E and L339D. As another non-limiting example, the LDLR protein includes at least one mutation in the EGF-A domain which is D331E and N316A. As another non-limiting example, the LDLR protein includes at least one mutation in the EGF-A domain which is D331E and E317A. As another non-limiting example, the LDLR protein includes at least one mutation in the EGF-A domain which is L339D and N316A. As another non-limiting example, the LDLR protein includes at least one mutation in the EGF-A domain which is L339D and E317A. As another non-limiting example, the LDLR protein includes at least one mutation in the EGF-A domain which is N316A and E317A.

LDLR Mutants—Intracellular Domain

In one embodiment, the polynucleotides described herein encode at least one LDLR protein comprising at least one mutation (e.g., a LDLR cell surface expression-enhancing mutation, a mutation increasing the residence time of LDLR at the cell surface or a mutation resulting in increased levels of LDLR at the cell surface) in the intracellular domain of the LDLR protein. As a non-limiting example, the intracellular domain of the LDLR protein may comprise may comprise a sequence at least 20%, at least 30%, at least 40%, at least 50%, at least 60%, at least 70%, at least 80%, at least 90%, at least 95%, at least 98% or at least 99% homologous to the sequence KNWRLKNINSINFDNPVYQKT-TEDEVHICHNQDGYSYPSRQMVSLEDDVA (SEQ ID NO: 720). As a non-limiting example, the intracellular domain of the LDLR protein may comprise may comprise the sequence KNWRLKNINSINFDNPVYQKT-TEDEVHICHNQDGYSYPSRQMVSLEDDVA (SEQ ID NO: 720). In one aspect, the mutation may be the replacement of an amino acid with electrically charged side chain, basic (e.g., arginine, histidine, lysine) with another amino acid with electrically charged side chain, basic. As a non-limiting example, Lysine (Lys, K) may be replaced with Arginine (Arg, R). In another aspect, the mutation may be the replacement of an amino acid with polar neutral side chains (e.g., asparagine, cysteine, glutamine, methionine, serine or threonine) with an amino acid with a hydrophobic side chain, aliphatic (e.g., alanine, isoleucine, leucine or valine). As a non-limiting example, Cysteine (Cys, C) may be replaced with Alanine (Ala, A).

In one embodiment, the polynucleotides described herein encode at least one LDLR protein where the protein is SEQ ID NO: 43 and the intracellular domain is defined as amino acid 811-amino acid 860 of SEQ ID NO: 43. The LDLR protein may include at least one mutation (e.g., a LDLR cell surface expression-enhancing mutation, a mutation increasing the residence time of LDLR at the cell surface or a mutation resulting in increased levels of LDLR at the cell surface) in the intracellular domain such as, but not limited to, Lysine at position 811 replaced with Arginine (referred to as K811R), Lysine at position 816 replaced with Arginine (referred to as K816R), Lysine at position 830 replaced with Arginine (referred to as K830R) and Cysteine at position 839 replaced with Alanine (referred to as C839A).

In one embodiment, the polynucleotides described herein encode at least one LDLR protein comprising two mutations (e.g., a LDLR cell surface expression-enhancing mutation, a mutation increasing the residence time of LDLR at the cell surface or a mutation resulting in increased levels of LDLR at the cell surface) in the intracellular domain of the human LDLR protein sequence. As a non-limiting example, the LDLR protein comprises the mutations K830R and C839A in the intracellular domain. As another non-limiting example, the LDLR protein has the protein sequence shown SEQ ID NO: 54 comprising the mutations K830R and C839A in the intracellular domain.

In one embodiment, the polynucleotides described herein encode at least one LDLR protein comprising three mutations (e.g., a LDLR cell surface expression-enhancing mutation, a mutation increasing the residence time of LDLR at the cell surface or a mutation resulting in increased levels of LDLR at the cell surface) in the intracellular domain of the LDLR protein. As a non-limiting example, the LDLR protein comprises the mutations K816R, K830R and C839A in the intracellular domain. As another non-limiting example, the LDLR protein has the protein sequence shown SEQ ID NO: 55 comprising the mutations K816R, K830R and C839A in the intracellular domain.

LDLR Mutants—EGF-A Domain and Intracellular Domain

In one embodiment, the polynucleotides described herein encode at least one LDLR protein comprising at least one mutation (e.g., a LDLR cell surface expression-enhancing mutation, a mutation increasing the residence time of LDLR at the cell surface or a mutation resulting in increased levels of LDLR at the cell surface) in the EGF-A domain and at least one mutation (e.g., a LDLR cell surface expression-enhancing mutation, a mutation increasing the residence time of LDLR at the cell surface or a mutation resulting in increased levels of LDLR at the cell surface) in the intracellular domain of the LDLR protein.

In one embodiment, the polynucleotides described herein encode at least one LDLR protein comprising one mutation (e.g., a LDLR cell surface expression-enhancing mutation, a mutation increasing the residence time of LDLR at the cell surface or a mutation resulting in increased levels of LDLR at the cell surface mutation) in the EGF-A domain and two mutations (e.g., a LDLR cell surface expression-enhancing mutation, a mutation increasing the residence time of LDLR at the cell surface or a mutation resulting in increased levels of LDLR at the cell surface) in the intracellular domain. As a non-limiting example, the LDLR protein comprises the mutation N316A in the EGF-A domain and the mutations K830R and C839A in the intracellular domain. As another non-limiting example, the LDLR protein has the protein sequence shown SEQ ID NO: 50 comprising the mutation N316A in the EGF-A domain and the mutations K830R and C839A in the intracellular domain. As a non-limiting example, the LDLR protein comprises the mutation L339D in the EGF-A domain and the mutations K830R and C839A in the intracellular domain. As another non-limiting example, the LDLR protein has the protein sequence shown SEQ ID NO: 52 comprising the mutation L339D in the EGF-A domain and the mutations K830R and C839A in the intracellular domain.

In another embodiment, the polynucleotides described herein encode at least one LDLR protein comprising one mutation (e.g., a LDLR cell surface expression-enhancing mutation, a mutation increasing the residence time of LDLR at the cell surface or a mutation resulting in increased levels of LDLR at the cell surface) in the EGF-A domain and three mutations (e.g., a LDLR cell surface expression-enhancing mutation, a mutation increasing the residence time of LDLR at the cell surface or a mutation resulting in increased levels of LDLR at the cell surface) in the intracellular domain. As a non-limiting example, the LDLR protein comprises the mutation N316A in the EGF-A domain and the mutations K816R, K830R and C839A in the intracellular domain. As another non-limiting example, the LDLR protein has the protein sequence shown SEQ ID NO: 51 comprising the mutation N316A in the EGF-A domain and the mutations K816R, K830R and C839A in the intracellular domain. As a non-limiting example, the LDLR protein comprises the mutation L339D in the EGF-A domain and the mutations K816R, K830R and C839A in the intracellular domain. As another non-limiting example, the LDLR protein has the protein sequence shown SEQ ID NO: 53 comprising the mutation L339D in the EGF-A domain and the mutations K816R, K830R and C839A in the intracellular domain.

LDLR Mutants—EGF-A Domain and PCSK9 Binding

In one embodiment, the polynucleotides described herein encode at least one LDLR protein comprising at least one mutation (e.g., a LDLR cell surface expression-enhancing mutation, a mutation increasing the residence time of LDLR at the cell surface or a mutation resulting in increased levels of LDLR at the cell surface) in the EGF-A domain which causes the LDLR protein to be deficient in proprotein convertase subtilisin/kexin type 9 (PCSK9) binding. The binding site of PCSK-9 has been previously localized to the EGF-A (or EGF-like repeat) domain of LDLR (see e.g., Kwon et al. *Molecular Basis for LDL receptor recognition by PCSK9*. PNAS. 2008 105(6), 1820-1825; the contents of which is herein incorporated by reference in its entirety). Accordingly, a PCSK9 binding deficient LDLR would bring cholesterol into the hepatocyte.

In one embodiment, the polynucleotides described herein encode at least one LDLR protein which is deficient is binding to PCSK9. As a non-limiting example, the LDLR protein may comprise at least one mutation (e.g., a LDLR cell surface expression-enhancing mutation, a mutation increasing the residence time of LDLR at the cell surface or a mutation resulting in increased levels of LDLR at the cell surface) to be PCSK9 binding deficient as described herein.

LDLR Mutants—Intracellular Domain and IDOL

In another embodiment, the polynucleotides described herein encode at least one LDLR protein comprising at least one mutation (e.g., a LDLR cell surface expression-enhancing mutation, a mutation increasing the residence time of LDLR at the cell surface or a mutation resulting in increased levels of LDLR at the cell surface) in the intracellular domain which prevents IDOL (inducible degrader of the LDLR also known as mosin regulatory ligh chain interacting protein (MYLIP)) from degrading the LDLR (See e.g., the intracellular domain mutations described by Zelcer et al. Science 2009 325(5936): 100-104; Sorrentino and Zelcer 2012 23(3):213-219; and Zhang et al. J Lipid Research 2013 54: 1410-1420; the contents of each of which are herein incorporated by reference in their entirety). While not wishing to be bound by theory, IDOL contains a band 4.1 and Ezrin/Radizin/Moeisin homology (FERM) domain that mediates interactions with cytoplasmic domains of transmembrane proteins. IDOL also contains a C-terminal RING domain and has been proposed to act as an E3-ubiquitin ligase.

According to Zelcer, the LDLR intracellular domain contains three highly conserved lysines and one cysteine that could be potential sites for ubiquitination but the single mutation of any of theses residues or the mutation of all three lysines did not prevent degradation of LDLR by IDOL. Zelcer described that that either an intact K20 or an intact C29 of the intracellular domain was important for IDOL-mediated degradation. Zhang states that depending on the usage of the lysine residues on ubiquitation, various linkage-specific ubiquitations can happen with K48 and K68 linkage-specific ubiquitinations being the most predominant forms of polyubiquitination.

LDLR Mutants—DAB2 Binding Deficient

In one embodiment, the polynucleotides described herein may be deficient in binding to disable homolog 2, mitogen-responsive phosphoprotein (DAB2). While not wishing to be bound by theory, the DAB2 binding-deficient LDLR may limit the internalization of LDLR through the DAB2 pathway and thus reducing LDLR uptake.

LDLR Mutants—NPXY Motif

In one embodiment, the NPXY motif of LDLR may be modified in order to alter the signal for rapid endocytosis through coated pits of LDLR. The NPXY motif may comprise at least one mutation, at least two mutations, at least three mutations, at least four mutations or more than four mutations. As a non-limiting example, the NPXY motif may comprise amino acid 822 through amino acid 829 of a LDLR sequence. As another non-limiting example, the NPXY motif may comprise the sequence NFDNPVYQ (SEQ ID NO: 721).

In one embodiment, the LDLR sequence does not comprise a mutation in the NPXY motif. In another embodiment, the LDLR sequence may comprise a mutation but the mutation may not be at position 822, 826, 827 or 828 of LDLR where amino acid 822 through amino acid 829 of LDLR is shown in (SEQ ID NO: 721).

LDLR Mutants—NPXY Motif and SNX17 Binding

In another embodiment, the NPXY motif of LDLR may be modified to reduce the binding of Sorting Nexin 17 (SNX17) to the NPXY motif of LDLR. The reduction of binding of SNX17 to the NPXY motif of LDLR may be used to regulate the endosomal recycling of receptors.

In one embodiment, the PX domain (PI3P binding) of SNX17 may comprise at least one mutation. The at least one mutation may alter the ability of SNX17 to bind to the NPXY motif of LDLR and thus regulate the endosomal recycling of receptors.

In one embodiment, the FERM-like domain of SNX17 may comprise at least one mutation. The at least one mutation may alter the ability of SNX17 to bind to the NPXY motif of LDLR and thus regulate the endosomal recycling of receptors.

In one embodiment, the Ras-association domain of SNX17 may comprise at least one mutation. The at least one mutation may alter the ability of SNX17 to bind to the NPXY motif of LDLR and thus regulate the endosomal recycling of receptors.

LDLR Mutants and Phosphorylation

In one embodiment, a LDLR sequence described herein may comprise at least one amino acid which has been phosphorylated. As a non-limiting example, at least one amino acid in the sequence NQDGYSYPSR (SEQ ID NO: 722) may be phosphorylated. As a non-limiting example, the two tyrosines (Ys) in SEQ ID NO: 722 of LDLR may be phosphorylated. As another non-limiting example, at least one tyrosine (Y) in the LDLR sequence described herein may be phosphorylated. As yet another non-limiting example, tyrosine at position 845 and tyrosine at position 847 of LDLR described herein are phosphorylated.

In one embodiment, a LDLR sequence described herein may comprise at least one amino acid which has been phosphorylated but tyrosine at position 828 is not phosphorylated.

In another embodiment, a LDLR sequences described herein may comprise at least one amino acid which has been phosphorylated, wherein at least one of the amino acids is tyrosine at position 828.

LDLR Mutants—C-Terminal Variant

In one embodiment, the LDLR sequence described herein may comprise at least one amino acid mutation in the C-terminal sequence LEDDVA (SEQ ID NO: 7). As a non-limiting example, SEQ ID NO: 723 may be amino acid 855 through amino acid 860 of the LDLR sequence.

LDLR Mutants—N-Linked Glycosylation Site

In one embodiment, the LDLR sequences may comprise at least one mutation at an N-linked glycosylation site of the LDLR sequence. As a non-limiting example, at least one mutation may be located at amino acid 97, 156, 272, 515 and/or 657.

In another embodiment, the LDLR sequences may comprise at least one mutation at an O-linked glycosylation site of the LDLR sequence. As a non-limiting example, at least one mutation may be located at amino acids 721-768.

In yet another embodiment, the LDLR sequences may comprise at least one mutation at an N-linked glycosylation site ant at least one mutation at an O-linked glycosylation site.

LDLR Mutant—LDLRAP1

In one embodiment, the polynucleotides described herein may be deficient in binding to low density lipoprotein receptor adaptor protein 1 (LDLRAP1). While not wishing to be bound by theory, the LDLRAP1 binding-deficient LDLR may limit the binding and internalization of LDLR and thus reducing LDLR uptake.

LDLR Mutant—Fusions

In one embodiment, the ecto-domains of LDLR sequences and constructs described herein may be fused with cytoplasmic domains. As a non-limiting example, LDLR ecto-domain may be fused with folate receptor TM-cytoplasmic domain. As another non-limiting example, LDLR ecto-domain may be fused with GPI-linked receptor TM-cytoplasmic domain.

LDLR Mutant—Surface-Signalling Enhancing Mutations

In one embodiment, the LDLR protein comprises at least one mutation (e.g., a LDLR cell surface expression-enhancing mutation, a mutation increasing the residence time of LDLR at the cell surface or a mutation resulting in increased levels of LDLR at the cell surface) to enhance the surface expression of LDLR. As a non-limiting example, at least one mutation is located in the EGF-A domain, the intracellular domain, a domain or region of LDLR described herein, or a combination thereof. As a non-limiting example, at least one mutation is located in the EGF-A domain and the intracellular domain in order to enhance the surface expression of LDLR.

Targeting of Pathogenic Organisms or Diseased Cells

Provided herein are methods for targeting pathogenic microorganisms, such as bacteria, yeast, protozoa, helminthes and the like, or diseased cells such as cancer cells using polynucleotides that encode cytostatic or cytotoxic polypeptides. Preferably the mRNA introduced contains modified nucleosides or other nucleic acid sequence modifications that are translated exclusively, or preferentially, in the target pathogenic organism, to reduce possible off-target effects of the therapeutic. Such methods are useful for removing pathogenic organisms or killing diseased cells found in any biological material, including blood, semen, eggs, and transplant materials including embryos, tissues, and organs.

Bioprocessing

The polynucleotides and methods of making the polynucleotides may be useful for enhancing protein product yield in a cell culture process. Bioprocessing methods and uses thereof are described in International Patent Publication No. WO2013151666, the contents of which are herein incorporated by reference in its entirety, such as in paragraphs [000934]-[000945].

Cells

In one embodiment, the cells are selected from the group consisting of mammalian cells, bacterial cells, plant, microbial, algal and fungal cells. In some embodiments, the cells are mammalian cells, such as, but not limited to, human, mouse, rat, goat, horse, rabbit, hamster or cow cells. In a further embodiment, the cells may be from an established cell line, including, but not limited to, HeLa, NSO, SP2/0, KEK 293T, Vero, Caco, Caco-2, MDCK, COS-1, COS-7, K562, Jurkat, CHO-K1, DG44, CHOK1SV, CHO-S, Huvec, CV-1, Huh-7, NIH3T3, HEK293, 293, A549, HepG2, IMR-90, MCF-7, U-20S, Per.C6, SF9, SF21 or Chinese Hamster Ovary (CHO) cells.

In certain embodiments, the cells are fungal cells, such as, but not limited to, *Chrysosporium* cells, *Aspergillus* cells, *Trichoderma* cells, *Dictyostelium* cells, *Candida* cells, *Saccharomyces* cells, *Schizosaccharomyces* cells, and *Penicillium* cells.

In certain embodiments, the cells are bacterial cells such as, but not limited to, *E. coli*, *B. subtilis*, or BL21 cells. Primary and secondary cells to be transfected by the methods of the invention can be obtained from a variety of tissues and include, but are not limited to, all cell types which can be maintained in culture. For examples, primary and secondary cells which can be transfected by the methods of the invention include, but are not limited to, fibroblasts, keratinocytes, epithelial cells (e.g., mammary epithelial cells, intestinal epithelial cells), endothelial cells, glial cells, neural cells, formed elements of the blood (e.g., lymphocytes, bone marrow cells), muscle cells and precursors of these somatic cell types. Primary cells may also be obtained from a donor of the same species or from another species (e.g., mouse, rat, rabbit, cat, dog, pig, cow, bird, sheep, goat, horse).

Purification and Isolation

Those of ordinary skill in the art should be able to make a determination of the methods to use to purify or isolate of a protein of interest from cultured cells. Generally, this is done through a capture method using affinity binding or non-affinity purification. If the protein of interest is not secreted by the cultured cells, then a lysis of the cultured cells should be performed prior to purification or isolation. One may use unclarified cell culture fluid containing the protein of interest along with cell culture media components as well as cell culture additives, such as anti-foam compounds and other nutrients and supplements, cells, cellular debris, host cell proteins, DNA, viruses and the like in the present invention. The process may be conducted in the bioreactor itself. The fluid may either be preconditioned to a desired stimulus such as pH, temperature or other stimulus characteristic or the fluid can be conditioned upon the addition of polymer(s) or the polymer(s) can be added to a carrier liquid that is properly conditioned to the required parameter for the stimulus condition required for that polymer to be solubilized in the fluid. The polymer may be allowed to circulate thoroughly with the fluid and then the stimulus may be applied (change in pH, temperature, salt concentration, etc) and the desired protein and polymer(s) precipitate can out of the solution. The polymer and the desired protein(s) can be separated from the rest of the fluid and optionally washed one or more times to remove any trapped or loosely bound contaminants. The desired protein may then be recovered from the polymer(s) by, for example, elution and the like. Preferably, the elution may be done under a set of conditions such that the polymer remains in its precipitated form and retains any impurities to it during the selected elution of the desired protein. The polymer and protein as well as any impurities may be solubilized in a new fluid such as water or a buffered solution and the protein may be recovered by a means such as affinity, ion exchanged, hydrophobic, or some other type of chromatography that has a preference and selectivity for the protein over that of the polymer or impurities. The eluted protein may then be recovered and may be subjected to additional processing steps, either batch like steps or continuous flow through steps if appropriate.

In another embodiment, it may be useful to optimize the expression of a specific polypeptide in a cell line or collection of cell lines of potential interest, particularly a polypeptide of interest such as a protein variant of a reference protein having a known activity. In one embodiment, provided is a method of optimizing expression of a polypeptide of interest in a target cell, by providing a plurality of target cell types, and independently contacting with each of the plurality of target cell types a modified mRNA encoding a polypeptide. Additionally, culture conditions may be altered to increase protein production efficiency. Subsequently, the presence and/or level of the polypeptide of interest in the plurality of target cell types is detected and/or quantitated, allowing for the optimization of a polypeptide of interest's expression by selection of an efficient target cell and cell culture conditions relating thereto. Such methods may be useful when the polypeptide of interest contains one or more post-translational modifications or has substantial tertiary structure, which often complicate efficient protein production.

Protein Recovery

The protein of interest may be preferably recovered from the culture medium as a secreted polypeptide, or it can be recovered from host cell lysates if expressed without a secretory signal. It may be necessary to purify the protein of interest from other recombinant proteins and host cell proteins in a way that substantially homogenous preparations of the protein of interest are obtained. The cells and/or particulate cell debris may be removed from the culture medium or lysate. The product of interest may then be purified from contaminant soluble proteins, polypeptides and nucleic acids by, for example, fractionation on immunoaffinity or ion-exchange columns, ethanol precipitation, reverse phase HPLC (RP-HPLC), SEPHADEX® chromatography, chromatography on silica or on a cation exchange resin such as DEAE. Methods of purifying a protein heterologous expressed by a host cell are well known in the art.

Methods and compositions described herein may be used to produce proteins which are capable of attenuating or blocking the endogenous agonist biological response and/or antagonizing a receptor or signaling molecule in a mammalian subject. For example, IL-12 and IL-23 receptor signaling may be enhanced in chronic autoimmune disorders such as multiple sclerosis and inflammatory diseases such as rheumatoid arthritis, psoriasis, lupus erythematosus, ankylosing spondylitis and Chron's disease (Kikly K, Liu L, Na S, Sedgwich J D (2006) Cur. Opin. Immunol. 18(6): 670-5). In another embodiment, a nucleic acid encodes an antagonist for chemokine receptors. Chemokine receptors CXCR-4 and CCR-5 are required for HIV enry into host cells (Arenzana-Seisdedos F et al, (1996) Nature. October 3; 383 (6599): 400).

Gene Silencing

The polynucleotides described herein are useful to silence (i.e., prevent or substantially reduce) expression of one or more target genes in a cell population. A polynucleotide encoding a polypeptide of interest capable of directing sequence-specific histone H3 methylation is introduced into the cells in the population under conditions such that the polypeptide is translated and reduces gene transcription of a target gene via histone H3 methylation and subsequent heterochromatin formation. In some embodiments, the silencing mechanism is performed on a cell population present in a mammalian subject. By way of non-limiting example, a useful target gene is a mutated Janus Kinase-2 family member, wherein the mammalian subject expresses the mutant target gene suffers from a myeloproliferative disease resulting from aberrant kinase activity.

Co-administration of polynucleotides and RNAi agents are also provided herein.

Modulation of Biological Pathways

The rapid translation polynucleotides introduced into cells provides a desirable mechanism of modulating target biological pathways. Such modulation includes antagonism or agonism of a given pathway. In one embodiment, a method is provided for antagonizing a biological pathway in a cell by contacting the cell with an effective amount of a composition comprising a polynucleotide encoding a polypeptide of interest, under conditions such that the polynucleotides is localized into the cell and the polypeptide is capable of being translated in the cell from the polynucleotides, wherein the polypeptide inhibits the activity of a polypeptide functional in the biological pathway. Exemplary biological pathways are those defective in an autoimmune or inflammatory disorder such as multiple sclerosis, rheumatoid arthritis, psoriasis, lupus erythematosus, ankylosing spondylitis colitis, or Crohn's disease; in particular, antagonism of the IL-12 and IL-23 signaling pathways are of particular utility. (See Kikly K, Liu L, Na S, Sedgwick J D (2006) Curr. Opin. Immunol. 18 (6): 670-5).

Further, provided are polynucleotides encoding an antagonist for chemokine receptors; chemokine receptors CXCR-4 and CCR-5 are required for, e.g., HIV entry into host cells (Arenzana-Seisdedos F et al, (1996) Nature. October 3; 383(6599):400).

Alternatively, provided are methods of agonizing a biological pathway in a cell by contacting the cell with an effective amount of a polynucleotide encoding a recombinant polypeptide under conditions such that the nucleic acid is localized into the cell and the recombinant polypeptide is capable of being translated in the cell from the nucleic acid, and the recombinant polypeptide induces the activity of a polypeptide functional in the biological pathway. Exemplary agonized biological pathways include pathways that modulate cell fate determination. Such agonization is reversible or, alternatively, irreversible.

Expression of Ligand or Receptor on Cell Surface

In some aspects and embodiments of the aspects described herein, the polynucleotides described herein can be used to express a ligand or ligand receptor on the surface of a cell (e.g., a homing moiety). A ligand or ligand receptor moiety attached to a cell surface can permit the cell to have a desired biological interaction with a tissue or an agent in vivo. A ligand can be an antibody, an antibody fragment, an aptamer, a peptide, a vitamin, a carbohydrate, a protein or polypeptide, a receptor, e.g., cell-surface receptor, an adhesion molecule, a glycoprotein, a sugar residue, a therapeutic agent, a drug, a glycosaminoglycan, or any combination thereof. For example, a ligand can be an antibody that recognizes a cancer-cell specific antigen, rendering the cell capable of preferentially interacting with tumor cells to permit tumor-specific localization of a modified cell. A ligand can confer the ability of a cell composition to accumulate in a tissue to be treated, since a preferred ligand may be capable of interacting with a target molecule on the external face of a tissue to be treated. Ligands having limited cross-reactivity to other tissues are generally preferred.

In some cases, a ligand can act as a homing moiety which permits the cell to target to a specific tissue or interact with a specific ligand. Such homing moieties can include, but are not limited to, any member of a specific binding pair, antibodies, monoclonal antibodies, or derivatives or analogs thereof, including without limitation: Fv fragments, single chain Fv (scFv) fragments, Fab' fragments, F(ab')2 fragments, single domain antibodies, camelized antibodies and antibody fragments, humanized antibodies and antibody fragments, and multivalent versions of the foregoing; multivalent binding reagents including without limitation: monospecific or bispecific antibodies, such as disulfide stabilized Fv fragments, scFv tandems ((SCFV)2 fragments), diabodies, tribodies or tetrabodies, which typically are covalently linked or otherwise stabilized (i.e., leucine zipper or helix stabilized) scFv fragments; and other homing moieties include for example, aptamers, receptors, and fusion proteins.

In some embodiments, the homing moiety may be a surface-bound antibody, which can permit tuning of cell targeting specificity. This is especially useful since highly specific antibodies can be raised against an epitope of interest for the desired targeting site. In one embodiment, multiple antibodies are expressed on the surface of a cell, and each antibody can have a different specificity for a desired target. Such approaches can increase the avidity and specificity of homing interactions.

A skilled artisan can select any homing moiety based on the desired localization or function of the cell, for example an estrogen receptor ligand, such as tamoxifen, can target cells to estrogen-dependent breast cancer cells that have an increased number of estrogen receptors on the cell surface. Other non-limiting examples of ligand/receptor interactions include CCRI (e.g., for treatment of inflamed joint tissues or brain in rheumatoid arthritis, and/or multiple sclerosis), CCR7, CCR8 (e.g., targeting to lymph node tissue), CCR6, CCR9,CCR10 (e.g., to target to intestinal tissue), CCR4, CCR10 (e.g., for targeting to skin), CXCR4 (e.g., for general enhanced transmigration), HCELL (e.g., for treatment of inflammation and inflammatory disorders, bone marrow), Alpha4beta7 (e.g., for intestinal mucosa targeting), VLA-4/VCAM-1 (e.g., targeting to endothelium). In general, any receptor involved in targeting (e.g., cancer metastasis) can be harnessed for use in the methods and compositions described herein.

Modulation of Cell Lineage

Provided are methods of inducing an alteration in cell fate in a target mammalian cell. The target mammalian cell may be a precursor cell and the alteration may involve driving differentiation into a lineage, or blocking such differentiation. Alternatively, the target mammalian cell may be a differentiated cell, and the cell fate alteration includes driving de-differentiation into a pluripotent precursor cell, or blocking such de-differentiation, such as the dedifferentiation of cancer cells into cancer stem cells. In situations where a change in cell fate is desired, effective amounts of mRNAs encoding a cell fate inductive polypeptide is introduced into a target cell under conditions such that an alteration in cell fate is induced. In some embodiments, the modified mRNAs are useful to reprogram a subpopulation of cells from a first phenotype to a second phenotype. Such a reprogramming may be temporary or permanent. Optionally, the reprogramming induces a target cell to adopt an intermediate phenotype.

Additionally, the methods of the present invention are particularly useful to generate induced pluripotent stem cells (iPS cells) because of the high efficiency of transfection, the ability to re-transfect cells, and the tenability of the amount of recombinant polypeptides produced in the target cells. Further, the use of iPS cells generated using the methods described herein is expected to have a reduced incidence of teratoma formation.

Also provided are methods of reducing cellular differentiation in a target cell population. For example, a target cell population containing one or more precursor cell types is contacted with a composition having an effective amount of a polynucleotides encoding a polypeptide, under conditions such that the polypeptide is translated and reduces the differentiation of the precursor cell. In non-limiting embodiments, the target cell population contains injured tissue in a mammalian subject or tissue affected by a surgical procedure. The precursor cell is, e.g., a stromal precursor cell, a neural precursor cell, or a mesenchymal precursor cell.

In a specific embodiment, provided are polynucleotides that encode one or more differentiation factors Gata4, Mef2c and Tbx4. These mRNA-generated factors are introduced into fibroblasts and drive the reprogramming into cardiomyocytes. Such a reprogramming can be performed in vivo, by contacting an mRNA-containing patch or other material to damaged cardiac tissue to facilitate cardiac regeneration. Such a process promotes cardiomyocyte genesis as opposed to fibrosis.

Mediation of Cell Death

In one embodiment, polynucleotides compositions can be used to induce apoptosis in a cell (e.g., a cancer cell) by increasing the expression of a death receptor, a death receptor ligand or a combination thereof. Compositions and methods of use thereof are described in International Patent Publication No. WO2013151666, the contents of which are herein incorporated by reference in its entirety, such as in paragraphs [000966]-[000969].

VI. Kits and Devices

Kits

The invention provides a variety of kits for conveniently and/or effectively carrying out methods of the present invention. Typically kits will comprise sufficient amounts and/or numbers of components to allow a user to perform multiple treatments of a subject(s) and/or to perform multiple experiments.

In one aspect, the present invention provides kits comprising the molecules (polynucleotides) of the invention. In one embodiment, the kit comprises one or more functional antibodies or function fragments thereof.

Said kits can be for protein production, comprising a first polynucleotides comprising a translatable region. The kit may further comprise packaging and instructions and/or a delivery agent to form a formulation composition. The delivery agent may comprise a saline, a buffered solution, a lipidoid or any delivery agent disclosed herein.

In one embodiment, the buffer solution may include sodium chloride, calcium chloride, phosphate and/or EDTA. In another embodiment, the buffer solution may include, but is not limited to, saline, saline with 2 mM calcium, 5% sucrose, 5% sucrose with 2 mM calcium, 5% Mannitol, 5% Mannitol with 2 mM calcium, Ringer's lactate, sodium chloride, sodium chloride with 2 mM calcium and mannose (See e.g., U.S. Pub. No. 20120258046; herein incorporated by reference in its entirety). In a further embodiment, the buffer solutions may be precipitated or it may be lyophilized. The amount of each component may be varied to enable consistent, reproducible higher concentration saline or simple buffer formulations. The components may also be varied in order to increase the stability of modified RNA in the buffer solution over a period of time and/or under a variety of conditions. In one aspect, the present invention provides kits for protein production, comprising: a polynucleotide comprising a translatable region, provided in an amount effective to produce a desired amount of a protein encoded by the translatable region when introduced into a target cell; a second polynucleotide comprising an inhibitory nucleic acid, provided in an amount effective to substantially inhibit the innate immune response of the cell; and packaging and instructions.

In one aspect, the present invention provides kits for protein production, comprising a polynucleotide comprising a translatable region, wherein the polynucleotide exhibits reduced degradation by a cellular nuclease, and packaging and instructions.

In one aspect, the present invention provides kits for protein production, comprising a polynucleotide comprising a translatable region, wherein the polynucleotide exhibits reduced degradation by a cellular nuclease, and a mammalian cell suitable for translation of the translatable region of the first nucleic acid.

Devices

The present invention provides for devices which may incorporate polynucleotides that encode polypeptides of interest. These devices contain in a stable formulation the reagents to synthesize a polynucleotide in a formulation available to be immediately delivered to a subject in need thereof, such as a human patient Devices for administration may be employed to deliver the polynucleotides of the present invention according to single, multi- or split-dosing regimens taught herein. Such devices are taught in, for example, International Application PCT/US2013/30062 filed Mar. 9, 2013, the contents of which are incorporated herein by reference in their entirety.

Method and devices known in the art for multi-administration to cells, organs and tissues are contemplated for use in conjunction with the methods and compositions disclosed herein as embodiments of the present invention. These include, for example, those methods and devices having multiple needles, hybrid devices employing for example multiple lumens or catheters as well as devices utilizing heat, electric current or radiation driven mechanisms.

According to the present invention, these multi-administration devices may be utilized to deliver the single, multi- or split doses contemplated herein. Such devices are taught for example in, International Application PCT/US2013/30062 filed Mar. 9, 2013, the contents of which are incorporated herein by reference in their entirety.

In one embodiment, the polynucleotide is administered subcutaneously or intramuscularly via at least 3 needles to three different, optionally adjacent, sites simultaneously, or within a 60 minutes period (e.g., administration to 4,5, 6, 7, 8, 9, or 10 sites simultaneously or within a 60 minute period).

Methods and Devices Utilizing Catheters and/or Lumens

Methods and devices using catheters and lumens may be employed to administer the polynucleotides of the present invention on a single, multi- or split dosing schedule. Such methods and devices are described in International Application PCT/US2013/30062 filed Mar. 9, 2013, the contents of which are incorporated herein by reference in their entirety.

Methods and Devices Utilizing Electrical Current

Methods and devices utilizing electric current may be employed to deliver the polynucleotides of the present invention according to the single, multi- or split dosing regimens taught herein. Such methods and devices are described in International Application PCT/US2013/30062 filed Mar. 9, 2013, the contents of which are incorporated herein by reference in their entirety.

VII. Definitions

At various places in the present specification, substituents of compounds of the present disclosure are disclosed in groups or in ranges. It is specifically intended that the present disclosure include each and every individual subcombination of the members of such groups and ranges About: As used herein, the term "about" means +/−10% of the recited value.

Administered in combination: As used herein, the term "administered in combination" or "combined administration" means that two or more agents are administered to a subject at the same time or within an interval such that there may be an overlap of an effect of each agent on the patient. In some embodiments, they are administered within about 60, 30, 15, 10, 5, or 1 minute of one another. In some embodiments, the administrations of the agents are spaced sufficiently closely together such that a combinatorial (e.g., a synergistic) effect is achieved.

Adjuvant: As used herein, the term "adjuvant" means a substance that enhances a subject's immune response to an antigen.

Animal: As used herein, the term "animal" refers to any member of the animal kingdom. In some embodiments, "animal" refers to humans at any stage of development. In some embodiments, "animal" refers to non-human animals at any stage of development. In certain embodiments, the non-human animal is a mammal (e.g., a rodent, a mouse, a rat, a rabbit, a monkey, a dog, a cat, a sheep, cattle, a primate, or a pig). In some embodiments, animals include, but are not limited to, mammals, birds, reptiles, amphibians, fish, and worms. In some embodiments, the animal is a transgenic animal, genetically-engineered animal, or a clone.

Antigen: As used herein, the term "antigen" refers to the substance that binds specifically to the respective antibody. An antigen may originate either from the body, such as cancer antigen used herein, or from the external environment, for instance, from infectious agents.

Antigens of interest or desired antigens: As used herein, the terms "antigens of interest" or "desired antigens" include those proteins and other biomolecules provided herein that are immunospecifically bound by the antibodies and fragments, mutants, variants, and alterations thereof described herein. Examples of antigens of interest include, but are not limited to, insulin, insulin-like growth factor, hGH, tPA, cytokines, such as interleukins (IL), e.g., IL-1, IL-2, IL-3, IL-4, IL-5, IL-6, IL-7, IL-8, IL-9, IL-10, IL-11, IL-12, IL-13, IL-14, IL-15, IL-16, IL-17, IL-18, interferon (IFN) alpha, IFN beta, IFN gamma, IFN omega or IFN tau, tumor necrosis factor (TNF), such as TNF alpha and TNF beta, TNF gamma, TRAIL; G-CSF, GM-CSF, M-CSF, MCP-1 and VEGF.

Approximately: As used herein, the term "approximately" or "about," as applied to one or more values of interest, refers to a value that is similar to a stated reference value. In certain embodiments, the term "approximately" or "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

Associated with: As used herein, the terms "associated with," "conjugated," "linked," "attached," and "tethered," when used with respect to two or more moieties, means that the moieties are physically associated or connected with one another, either directly or via one or more additional moieties that serves as a linking agent, to form a structure that is sufficiently stable so that the moieties remain physically associated under the conditions in which the structure is used, e.g., physiological conditions. An "association" need not be strictly through direct covalent chemical bonding. It may also suggest ionic or hydrogen bonding or a hybridization based connectivity sufficiently stable such that the "associated" entities remain physically associated.

Bifunctional: As used herein, the term "bifunctional" refers to any substance, molecule or moiety which is capable of or maintains at least two functions. The functions may effect the same outcome or a different outcome. The structure that produces the function may be the same or different. For example, bifunctional modified RNAs of the present invention may encode a cytotoxic peptide (a first function) while those nucleosides which comprise the encoding RNA are, in and of themselves, cytotoxic (second function). In this example, delivery of the bifunctional modified RNA to a cancer cell would produce not only a peptide or protein molecule which may ameliorate or treat the cancer but would also deliver a cytotoxic payload of nucleosides to the cell should degradation, instead of translation of the modified RNA, occur.

Biocompatible: As used herein, the term "biocompatible" means compatible with living cells, tissues, organs or systems posing little to no risk of injury, toxicity or rejection by the immune system.

Biodegradable: As used herein, the term "biodegradable" means capable of being broken down into innocuous products by the action of living things.

Biologically active: As used herein, the phrase "biologically active" refers to a characteristic of any substance that has activity in a biological system and/or organism.

For instance, a substance that, when administered to an organism, has a biological effect on that organism, is considered to be biologically active. In particular embodiments, a polynucleotide of the present invention may be considered biologically active if even a portion of the polynucleotides is biologically active or mimics an activity considered biologically relevant.

Cancer stem cells: As used herein, "cancer stem cells" are cells that can undergo self-renewal and/or abnormal proliferation and differentiation to form a tumor.

Chimera: As used herein, "chimera" is an entity having two or more incongruous or heterogeneous parts or regions.

Chimeric polynucleotide: As used herein, "chimeric polynucleotides" are those nucleic acid polymers having portions or regions which differ in size and/or chemical modification pattern, chemical modification position, chemical modification percent or chemical modification population and combinations of the foregoing.

Compound: As used herein, the term "compound," is meant to include all stereoisomers, geometric isomers, tautomers, and isotopes of the structures depicted.

The compounds described herein can be asymmetric (e.g., having one or more stereocenters). All stereoisomers, such as enantiomers and diastereomers, are intended unless otherwise indicated. Compounds of the present disclosure that contain asymmetrically substituted carbon atoms can be isolated in optically active or racemic forms. Methods on how to prepare optically active forms from optically active starting materials are known in the art, such as by resolution of racemic mixtures or by stereoselective synthesis. Many geometric isomers of olefins, C=N double bonds, and the like can also be present in the compounds described herein, and all such stable isomers are contemplated in the present disclosure. Cis and trans geometric isomers of the compounds of the present disclosure are described and may be isolated as a mixture of isomers or as separated isomeric forms.

Compounds of the present disclosure also include tautomeric forms. Tautomeric forms result from the swapping of a single bond with an adjacent double bond and the concomitant migration of a proton. Tautomeric forms include prototropic tautomers which are isomeric protonation states having the same empirical formula and total charge. Examples prototropic tautomers include ketone—enol pairs, amide—imidic acid pairs, lactam—lactim pairs, amide—imidic acid pairs, enamine—imine pairs, and annular forms where a proton can occupy two or more positions of a heterocyclic system, such as, 1H- and 3H-imidazole, 1H-, 2H- and 4H-1,2,4-triazole, 1H- and 2H-isoindole, and 1H- and 2H-pyrazole. Tautomeric forms can be in equilibrium or sterically locked into one form by appropriate substitution.

Compounds of the present disclosure also include all of the isotopes of the atoms occurring in the intermediate or final compounds. "Isotopes" refers to atoms having the same atomic number but different mass numbers resulting from a different number of neutrons in the nuclei. For example, isotopes of hydrogen include tritium and deuterium.

The compounds and salts of the present disclosure can be prepared in combination with solvent or water molecules to form solvates and hydrates by routine methods.

Committed: As used herein, the term "committed" means, when referring to a cell, when the cell is far enough into the differentiation pathway where, under normal circumstances, it will continue to differentiate into a specific cell type or subset of cell type instead of into a different cell type or reverting to a lesser differentiated cell type.

Conserved: As used herein, the term "conserved" refers to nucleotides or amino acid residues of a polynucleotide sequence or polypeptide sequence, respectively, that are those that occur unaltered in the same position of two or more sequences being compared. Nucleotides or amino acids that are relatively conserved are those that are conserved amongst more related sequences than nucleotides or amino acids appearing elsewhere in the sequences.

In some embodiments, two or more sequences are said to be "completely conserved" if they are 100% identical to one another. In some embodiments, two or more sequences are said to be "highly conserved" if they are at least 70% identical, at least 80% identical, at least 90% identical, or at least 95% identical to one another. In some embodiments, two or more sequences are said to be "highly conserved" if they are about 70% identical, about 80% identical, about 90% identical, about 95%, about 98%, or about 99% identical to one another. In some embodiments, two or more sequences are said to be "conserved" if they are at least 30% identical, at least 40% identical, at least 50% identical, at least 60% identical, at least 70% identical, at least 80% identical, at least 90% identical, or at least 95% identical to one another. In some embodiments, two or more sequences are said to be "conserved" if they are about 30% identical, about 40% identical, about 50% identical, about 60% identical, about 70% identical, about 80% identical, about 90% identical, about 95% identical, about 98% identical, or about 99% identical to one another. Conservation of sequence may apply to the entire length of an polynucleotide or polypeptide or may apply to a portion, region or feature thereof.

Controlled Release: As used herein, the term "controlled release" refers to a pharmaceutical composition or compound release profile that conforms to a particular pattern of release to effect a therapeutic outcome.

Cyclic or Cyclized: As used herein, the term "cyclic" refers to the presence of a continuous loop. Cyclic molecules need not be circular, only joined to form an unbroken chain of subunits. Cyclic molecules such as the engineered RNA or mRNA of the present invention may be single units or multimers or comprise one or more components of a complex or higher order structure.

Cytostatic: As used herein, "cytostatic" refers to inhibiting, reducing, suppressing the growth, division, or multiplication of a cell (e.g., a mammalian cell (e.g., a human cell)), bacterium, virus, fungus, protozoan, parasite, prion, or a combination thereof.

Cytotoxic: As used herein, "cytotoxic" refers to killing or causing injurious, toxic, or deadly effect on a cell (e.g., a mammalian cell (e.g., a human cell)), bacterium, virus, fungus, protozoan, parasite, prion, or a combination thereof.

Delivery: As used herein, "delivery" refers to the act or manner of delivering a compound, substance, entity, moiety, cargo or payload.

Delivery Agent: As used herein, "delivery agent" refers to any substance which facilitates, at least in part, the in vivo delivery of a polynucleotide to targeted cells.

Destabilized: As used herein, the term "destable," "destabilize," or "destabilizing region" means a region or molecule that is less stable than a starting, wild-type or native form of the same region or molecule.

Detectable label: As used herein, "detectable label" refers to one or more markers, signals, or moieties which are attached, incorporated or associated with another entity that is readily detected by methods known in the art including radiography, fluorescence, chemiluminescence, enzymatic activity, absorbance and the like. Detectable labels include radioisotopes, fluorophores, chromophores, enzymes, dyes, metal ions, ligands such as biotin, avidin, streptavidin and haptens, quantum dots, and the like. Detectable labels may be located at any position in the peptides or proteins disclosed herein. They may be within the amino acids, the peptides, or proteins, or located at the N- or C-termini.

Diastereomer: As used herein, the term "diastereomer," means stereoisomers that are not mirror images of one another and are non-superimposable on one another.

Digest: As used herein, the term "digest" means to break apart into smaller pieces or components. When referring to polypeptides or proteins, digestion results in the production of peptides.

Differentiated cell: As used herein, the term "differentiated cell" refers to any somatic cell that is not, in its native form, pluripotent. Differentiated cell also encompasses cells that are partially differentiated.

Differentiation: As used herein, the term "differentiation factor" refers to a developmental potential altering factor such as a protein, RNA or small molecule that can induce a cell to differentiate to a desired cell-type.

Differentiate: As used herein, "differentiate" refers to the process where an uncommitted or less committed cell acquires the features of a committed cell.

Distal: As used herein, the term "distal" means situated away from the center or away from a point or region of interest.

Dosing regimen: As used herein, a "dosing regimen" is a schedule of administration or physician determined regimen of treatment, prophylaxis, or palliative care.

Dose splitting factor (DSF)-ratio of PUD of dose split treatment divided by PUD of total daily dose or single unit dose. The value is derived from comparison of dosing regimens groups.

Enantiomer: As used herein, the term "enantiomer" means each individual optically active form of a compound of the invention, having an optical purity or enantiomeric excess (as determined by methods standard in the art) of at least 80% (i.e., at least 90% of one enantiomer and at most 10% of the other enantiomer), preferably at least 90% and more preferably at least 98%.

Encapsulate: As used herein, the term "encapsulate" means to enclose, surround or encase.

Encoded protein cleavage signal: As used herein, "encoded protein cleavage signal" refers to the nucleotide sequence which encodes a protein cleavage signal.

Engineered: As used herein, embodiments of the invention are "engineered" when they are designed to have a feature or property, whether structural or chemical, that varies from a starting point, wild type or native molecule.

Effective Amount: As used herein, the term "effective amount" of an agent is that amount sufficient to effect beneficial or desired results, for example, clinical results, and, as such, an "effective amount" depends upon the context in which it is being applied. For example, in the context of administering an agent that treats high cholesterol, an effective amount of an agent is, for example, an amount sufficient to achieve treatment, as defined herein, of high cholesterol, as compared to the response obtained without administration of the agent.

Exosome: As used herein, "exosome" is a vesicle secreted by mammalian cells or a complex involved in RNA degradation.

Expression: As used herein, "expression" of a nucleic acid sequence refers to one or more of the following events: (1) production of an RNA template from a DNA sequence (e.g., by transcription); (2) processing of an RNA transcript (e.g., by splicing, editing, 5' cap formation, and/or 3' end processing); (3) translation of an RNA into a polypeptide or protein; and (4) post-translational modification of a polypeptide or protein.

Feature: As used herein, a "feature" refers to a characteristic, a property, or a distinctive element.

Formulation: As used herein, a "formulation" includes at least a polynucleotide and a delivery agent.

Fragment: A "fragment," as used herein, refers to a portion. For example, fragments of proteins may comprise polypeptides obtained by digesting full-length protein isolated from cultured cells.

Functional: As used herein, a "functional" biological molecule is a biological molecule in a form in which it exhibits a property and/or activity by which it is characterized.

Homology: As used herein, the term "homology" refers to the overall relatedness between polymeric molecules, e.g. between nucleic acid molecules (e.g. DNA molecules and/or RNA molecules) and/or between polypeptide molecules. In some embodiments, polymeric molecules are considered to be "homologous" to one another if their sequences are at least 25%, 30%, 35%, 40%, 45%, 50%, 55%, 60%, 65%, 70%, 75%, 80%, 85%, 90%, 95%, or 99% identical or similar. The term "homologous" necessarily refers to a comparison between at least two sequences (polynucleotide or polypeptide sequences). In accordance with the invention, two polynucleotide sequences are considered to be homologous if the polypeptides they encode are at least about 50%, 60%, 70%, 80%, 90%, 95%, or even 99% for at least one stretch of at least about 20 amino acids. In some embodiments, homologous polynucleotide sequences are characterized by the ability to encode a stretch of at least 4-5 uniquely specified amino acids. For polynucleotide sequences less than 60 nucleotides in length, homology is determined by the ability to encode a stretch of at least 4-5 uniquely specified amino acids. In accordance with the invention, two protein sequences are considered to be homologous if the proteins are at least about 50%, 60%, 70%, 80%, or 90% identical for at least one stretch of at least about 20 amino acids.

Identity: As used herein, the term "identity" refers to the overall relatedness between polymeric molecules, e.g., between polynucleotide molecules (e.g. DNA molecules and/or RNA molecules) and/or between polypeptide molecules. Calculation of the percent identity of two polynucleotide sequences, for example, can be performed by aligning the two sequences for optimal comparison purposes (e.g., gaps can be introduced in one or both of a first and a second nucleic acid sequences for optimal alignment and non-identical sequences can be disregarded for comparison purposes). In certain embodiments, the length of a sequence aligned for comparison purposes is at least 30%, at least 40%, at least 50%, at least 60%, at least 70%, at least 80%, at least 90%, at least 95%, or 100% of the length of the reference sequence. The nucleotides at corresponding nucleotide positions are then compared. When a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which needs to be introduced for optimal alignment of the two sequences. The comparison of sequences and determination of percent identity between two sequences can be accomplished using a mathematical algorithm. For example, the percent identity between two nucleotide sequences can be determined using methods such as those described in Computational Molecular Biology, Lesk, A. M., ed., Oxford University Press, New York, 1988; Biocomputing: Informatics and Genome Projects, Smith, D. W., ed., Academic Press, New York, 1993; Sequence Analysis in Molecular Biology, von Heinje, G., Academic Press, 1987; Computer Analysis of Sequence Data, Part I, Griffin, A. M., and Griffin, H. G., eds., Humana Press, New Jersey, 1994; and Sequence Analysis Primer, Gribskov, M. and Devereux, J., eds., M Stockton Press, New York, 1991; each of which is incorporated herein by reference. For example, the percent identity between two nucleotide sequences can be determined using the algorithm of Meyers and Miller (CABIOS, 1989, 4:11-17), which has been incorporated into the ALIGN program (version 2.0) using a PAM120 weight residue table, a gap length penalty of 12 and a gap penalty of 4. The percent identity between two nucleotide sequences can, alternatively, be determined using the GAP program in the GCG software package using an NWSgapdna.CMP matrix. Methods commonly employed to determine percent identity between sequences include, but are not limited to those disclosed in Carillo, H., and Lipman, D., SIAM J Applied Math., 48:1073 (1988); incorporated herein by reference. Techniques for determining identity are codified in publicly available computer programs. Exemplary computer software to determine homology between two sequences include, but are not limited to, GCG program package, Devereux, J., et al., *Nucleic Acids Research*, 12(1), 387 (1984)), BLASTP, BLASTN, and FASTA Altschul, S. F. et al., *J. Molec. Biol.*, 215, 403 (1990)).

Infectious Agent: As used herein, the phrase "infectious agent" means an agent capable of producing an infection.

Inhibit expression of a gene: As used herein, the phrase "inhibit expression of a gene" means to cause a reduction in the amount of an expression product of the gene. The expression product can be an RNA transcribed from the gene (e.g., an mRNA) or a polypeptide translated from an mRNA transcribed from the gene. Typically a reduction in the level of an mRNA results in a reduction in the level of a polypeptide translated therefrom. The level of expression may be determined using standard techniques for measuring mRNA or protein.

Infectious agent: As used herein, an "infectious agent" refers to any microorganism, virus, infectious substance, or biological product that may be engineered as a result of biotechnology, or any naturally occurring or bioengineered component of any such microorganism, virus, infectious substance, or biological product, can cause emerging and contagious disease, death or other biological malfunction in a human, an animal, a plant or another living organism.

Influenza: As used herein, "influenza" or "flu" is an infectious disease of birds and mammals caused by RNA viruses of the family Orthomyxoviridae, the influenza viruses.

Isomer: As used herein, the term "isomer" means any tautomer, stereoisomer, enantiomer, or diastereomer of any compound of the invention. It is recognized that the compounds of the invention can have one or more chiral centers and/or double bonds and, therefore, exist as stereoisomers, such as double-bond isomers (i.e., geometric E/Z isomers) or diastereomers (e.g., enantiomers (i.e., (+) or (−)) or cis/trans isomers). According to the invention, the chemical structures depicted herein, and therefore the compounds of the invention, encompass all of the corresponding stereoisomers, that is, both the stereomerically pure form (e.g., geometrically pure, enantiomerically pure, or diastereomerically pure) and enantiomeric and stereoisomeric mixtures, e.g., racemates. Enantiomeric and stereoisomeric mixtures of compounds of the invention can typically be resolved into their component enantiomers or stereoisomers by well-known methods, such as chiral-phase gas chromatography, chiral-phase high performance liquid chromatography, crystallizing the compound as a chiral salt complex, or crystallizing the compound in a chiral solvent. Enantiomers and stereoisomers can also be obtained from stereomerically or enantiomerically pure intermediates, reagents, and catalysts by well-known asymmetric synthetic methods.

In vitro: As used herein, the term "in vitro" refers to events that occur in an artificial environment, e.g., in a test tube or reaction vessel, in cell culture, in a Petri dish, etc., rather than within an organism (e.g., animal, plant, or microbe).

In vivo: As used herein, the term "in vivo" refers to events that occur within an organism (e.g., animal, plant, or microbe or cell or tissue thereof).

Isolated: As used herein, the term "isolated" refers to a substance or entity that has been separated from at least some of the components with which it was associated (whether in nature or in an experimental setting). Isolated substances may have varying levels of purity in reference to the substances from which they have been associated. Isolated substances and/or entities may be separated from at least about 10%, about 20%, about 30%, about 40%, about 50%, about 60%, about 70%, about 80%, about 90%, or more of the other components with which they were initially associated. In some embodiments, isolated agents are more than about 80%, about 85%, about 90%, about 91%, about 92%, about 93%, about 94%, about 95%, about 96%, about 97%, about 98%, about 99%, or more than about 99% pure. As used herein, a substance is "pure" if it is substantially free of other components. Substantially isolated: By "substantially isolated" is meant that the compound is substantially separated from the environment in which it was formed or detected. Partial separation can include, for example, a composition enriched in the compound of the present disclosure. Substantial separation can include compositions containing at least about 50%, at least about 60%, at least about 70%, at least about 80%, at least about 90%, at least about 95%, at least about 97%, or at least about 99% by weight of the compound of the present disclosure, or salt thereof. Methods for isolating compounds and their salts are routine in the art.

IVT Polynucleotide: As used herein, an "IVT polynucleotide" is a linear polynucleotide which may be made using only in vitro transcription (IVT) enzymatic synthesis methods.

LDLR Associated Disease: As used herein, an "LDLR Associated Disease" or "LDLR associated disorder" refers to diseases or disorders, respectively, which results from aberrant LDLR activity (e.g., decreases activity or increased activity). As a non-limiting example, hypercholesterolemia is a LDLR associated disease.

Linker: As used herein, a "linker" refers to a group of atoms, e.g., 10-1,000 atoms, and can be comprised of the atoms or groups such as, but not limited to, carbon, amino, alkylamino, oxygen, sulfur, sulfoxide, sulfonyl, carbonyl, and imine. The linker can be attached to a modified nucleoside or nucleotide on the nucleobase or sugar moiety at a first end, and to a payload, e.g., a detectable or therapeutic agent, at a second end. The linker may be of sufficient length as to not interfere with incorporation into a nucleic acid sequence. The linker can be used for any useful purpose, such as to form polynucleotide multimers (e.g., through linkage of two or more chimeric polynucleotides molecules or IVT polynucleoties) or polynucleotides conjugates, as well as to administer a payload, as described herein. Examples of chemical groups that can be incorporated into the linker include, but are not limited to, alkyl, alkenyl, alkynyl, amido, amino, ether, thioether, ester, alkylene, heteroalkylene, aryl, or heterocyclyl, each of which can be optionally substituted, as described herein. Examples of linkers include, but are not limited to, unsaturated alkanes, polyethylene glycols (e.g., ethylene or propylene glycol monomeric units, e.g., diethylene glycol, dipropylene glycol, triethylene glycol, tripropylene glycol, tetraethylene glycol, or tetraethylene glycol), and dextran polymers and derivatives thereof, Other examples include, but are not limited to, cleavable moieties within the linker, such as, for example, a disulfide bond (—S—S—) or an azo bond (—N=N—), which can be cleaved using a reducing agent or photolysis. Non-limiting examples of a selectively cleavable bond include an amido bond can be cleaved for example by the use of tris(2-carboxyethyl)phosphine (TCEP), or other reducing agents, and/or photolysis, as well as an ester bond can be cleaved for example by acidic or basic hydrolysis.

MicroRNA (miRNA) binding site: As used herein, a microRNA (miRNA) binding site represents a nucleotide location or region of a nucleic acid transcript to which at least the "seed" region of a miRNA binds.

Modified: As used herein "modified" refers to a changed state or structure of a molecule of the invention. Molecules may be modified in many ways including chemically, structurally, and functionally. In one embodiment, the mRNA molecules of the present invention are modified by the introduction of non-natural nucleosides and/or nucleotides, e.g., as it relates to the natural ribonucleotides A, U, G, and C. Noncanonical nucleotides such as the cap structures are not considered "modified" although they differ from the chemical structure of the A, C, G, U ribonucleotides.

Mucus: As used herein, "mucus" refers to the natural substance that is viscous and comprises mucin glycoproteins.

Naturally occurring: As used herein, "naturally occurring" means existing in nature without artificial aid.

Neutralizing antibody: As used herein, a "neutralizing antibody" refers to an antibody which binds to its antigen and defends a cell from an antigen or infectious agent by neutralizing or abolishing any biological activity it has.

Non-human vertebrate: As used herein, a "non human vertebrate" includes all vertebrates except *Homo sapiens*, including wild and domesticated species. Examples of non-human vertebrates include, but are not limited to, mammals, such as alpaca, banteng, bison, camel, cat, cattle, deer, dog, donkey, gayal, goat, guinea pig, horse, llama, mule, pig, rabbit, reindeer, sheep water buffalo, and yak.

Off-target: As used herein, "off target" refers to any unintended effect on any one or more target, gene, or cellular transcript.

Open reading frame: As used herein, "open reading frame" or "ORF" refers to a sequence which does not contain a stop codon in a given reading frame.

Operably linked: As used herein, the phrase "operably linked" refers to a functional connection between two or more molecules, constructs, transcripts, entities, moieties or the like.

Optionally substituted: Herein a phrase of the form "optionally substituted X" (e.g., optionally substituted alkyl) is intended to be equivalent to "X, wherein X is optionally substituted" (e.g., "alkyl, wherein said alkyl is optionally substituted"). It is not intended to mean that the feature "X" (e.g. alkyl) per se is optional.

Part: As used herein, a "part" or "region" of a polynucleotide is defined as any portion of the polynucleotide which is less than the entire length of the polynucleotide.

Peptide: As used herein, "peptide" is less than or equal to 50 amino acids long, e.g., about 5, 10, 15, 20, 25, 30, 35, 40, 45, or 50 amino acids long.

Paratope: As used herein, a "paratope" refers to the antigen-binding site of an antibody.

Patient: As used herein, "patient" refers to a subject who may seek or be in need of treatment, requires treatment, is receiving treatment, will receive treatment, or a subject who is under care by a trained professional for a particular disease or condition.

Pharmaceutically acceptable: The phrase "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

Pharmaceutically acceptable excipients: The phrase "pharmaceutically acceptable excipient," as used herein, refers any ingredient other than the compounds described herein (for example, a vehicle capable of suspending or dissolving the active compound) and having the properties of being substantially nontoxic and non-inflammatory in a patient. Excipients may include, for example: antiadherents, antioxidants, binders, coatings, compression aids, disintegrants, dyes (colors), emollients, emulsifiers, fillers (diluents), film formers or coatings, flavors, fragrances, glidants (flow enhancers), lubricants, preservatives, printing inks, sorbents, suspending or dispersing agents, sweeteners, and waters of hydration. Exemplary excipients include, but are not limited to: butylated hydroxytoluene (BHT), calcium carbonate, calcium phosphate (dibasic), calcium stearate, croscarmellose, crosslinked polyvinyl pyrrolidone, citric acid, crospovidone, cysteine, ethylcellulose, gelatin, hydroxypropyl cellulose, hydroxypropyl methylcellulose, lactose, magnesium stearate, maltitol, mannitol, methionine, methylcellulose, methyl paraben, microcrystalline cellulose, polyethylene glycol, polyvinyl pyrrolidone, povidone, pregelatinized starch, propyl paraben, retinyl palmitate, shellac, silicon dioxide, sodium carboxymethyl cellulose, sodium citrate, sodium starch glycolate, sorbitol, starch (corn), stearic acid, sucrose, talc, titanium dioxide, vitamin A, vitamin E, vitamin C, and xylitol.

Pharmaceutically acceptable salts: The present disclosure also includes pharmaceutically acceptable salts of the compounds described herein. As used herein, "pharmaceutically acceptable salts" refers to derivatives of the disclosed compounds wherein the parent compound is modified by converting an existing acid or base moiety to its salt form (e.g., by reacting the free base group with a suitable organic acid). Examples of pharmaceutically acceptable salts include, but are not limited to, mineral or organic acid salts of basic residues such as amines; alkali or organic salts of acidic residues such as carboxylic acids; and the like. Representative acid addition salts include acetate, acetic acid, adipate, alginate, ascorbate, aspartate, benzenesulfonate, benzene sulfonic acid, benzoate, bisulfate, borate, butyrate, camphorate, camphorsulfonate, citrate, cyclopentanepropionate, digluconate, dodecylsulfate, ethanesulfonate, fumarate, glucoheptonate, glycerophosphate, hemisulfate, heptonate, hexanoate, hydrobromide, hydrochloride, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, toluenesulfonate, undecanoate, valerate salts, and the like. Representative alkali or alkaline earth metal salts include sodium, lithium, potassium, calcium, magnesium, and the like, as well as nontoxic ammonium, quaternary ammonium, and amine cations, including, but not limited to ammonium, tetramethylammonium, tetraethylammonium, methylamine, dimethylamine, trimethylamine, triethylamine, ethylamine, and the like. The pharmaceutically acceptable salts of the present disclosure include the conventional non-toxic salts of the parent compound formed, for example, from non-toxic inorganic or organic acids. The pharmaceutically acceptable salts of the present disclosure can be synthesized from the parent compound which contains a basic or acidic moiety by conventional chemical methods. Generally, such salts can be prepared by reacting the free acid or base forms of these compounds with a stoichiometric amount of the appropriate base or acid in water or in an organic solvent, or in a mixture of the two; generally, nonaqueous media like ether, ethyl acetate, ethanol, isopropanol, or acetonitrile are preferred. Lists of suitable salts are found in *Remington's Pharmaceutical Sciences*, 17$^{th}$ ed., Mack Publishing Company, Easton, Pa., 1985, p. 1418, *Pharmaceutical Salts: Properties, Selection, and Use*, P. H. Stahl and C. G. Wermuth (eds.), Wiley-VCH, 2008, and Berge et al., *Journal of Pharmaceutical Science*, 66, 1-19 (1977), each of which is incorporated herein by reference in its entirety.

Pharmaceutically acceptable solvate: The term "pharmaceutically acceptable solvate," as used herein, means a compound of the invention wherein molecules of a suitable solvent are incorporated in the crystal lattice. A suitable solvent is physiologically tolerable at the dosage administered. For example, solvates may be prepared by crystallization, recrystallization, or precipitation from a solution that includes organic solvents, water, or a mixture thereof. Examples of suitable solvents are ethanol, water (for example, mono-, di-, and tri-hydrates), N-methylpyrrolidinone (NMP), dimethyl sulfoxide (DMSO), N,N'-dimethylformamide (DMF), N,N'-dimethylacetamide (DMAC), 1,3-dimethyl-2-imidazolidinone (DMEU), 1,3-dimethyl-3,4,5,6-tetrahydro-2-(1H)-pyrimidinone (DMPU), acetonitrile (ACN), propylene glycol, ethyl acetate, benzyl alcohol, 2-pyrrolidone, benzyl benzoate, and the like. When water is the solvent, the solvate is referred to as a "hydrate."

Pharmacokinetic: As used herein, "pharmacokinetic" refers to any one or more properties of a molecule or compound as it relates to the determination of the fate of substances administered to a living organism. Pharmacokinetics is divided into several areas including the extent and rate of absorption, distribution, metabolism and excretion. This is commonly referred to as ADME where: (A) Absorption is the process of a substance entering the blood circulation; (D) Distribution is the dispersion or dissemination of substances throughout the fluids and tissues of the body; (M)

Metabolism (or Biotransformation) is the irreversible transformation of parent compounds into daughter metabolites; and (E) Excretion (or Elimination) refers to the elimination of the substances from the body. In rare cases, some drugs irreversibly accumulate in body tissue.

Physicochemical: As used herein, "physicochemical" means of or relating to a physical and/or chemical property.

Polypeptide per unit drug (PUD): As used herein, a PUD or product per unit drug, is defined as a subdivided portion of total daily dose, usually 1 mg, pg, kg, etc., of a product (such as a polypeptide) as measured in body fluid or tissue, usually defined in concentration such as pmol/mL, mmol/mL, etc divided by the measure in the body fluid.

Preventing: As used herein, the term "preventing" refers to partially or completely delaying onset of an infection, disease, disorder and/or condition; partially or completely delaying onset of one or more symptoms, features, or clinical manifestations of a particular infection, disease, disorder, and/or condition; partially or completely delaying onset of one or more symptoms, features, or manifestations of a particular infection, disease, disorder, and/or condition; partially or completely delaying progression from an infection, a particular disease, disorder and/or condition; and/or decreasing the risk of developing pathology associated with the infection, the disease, disorder, and/or condition.

Prodrug: The present disclosure also includes prodrugs of the compounds described herein. As used herein, "prodrugs" refer to any substance, molecule or entity which is in a form predicate for that substance, molecule or entity to act as a therapeutic upon chemical or physical alteration. Prodrugs may by covalently bonded or sequestered in some way and which release or are converted into the active drug moiety prior to, upon or after administered to a mammalian subject. Prodrugs can be prepared by modifying functional groups present in the compounds in such a way that the modifications are cleaved, either in routine manipulation or in vivo, to the parent compounds. Prodrugs include compounds wherein hydroxyl, amino, sulfhydryl, or carboxyl groups are bonded to any group that, when administered to a mammalian subject, cleaves to form a free hydroxyl, amino, sulfhydryl, or carboxyl group respectively. Preparation and use of prodrugs is discussed in T. Higuchi and V. Stella, "Prodrugs as Novel Delivery Systems," Vol. 14 of the A.C.S. Symposium Series, and in Bioreversible Carriers in Drug Design, ed. Edward B. Roche, American Pharmaceutical Association and Pergamon Press, 1987, both of which are hereby incorporated by reference in their entirety.

Proliferate: As used herein, the term "proliferate" means to grow, expand or increase or cause to grow, expand or increase rapidly. "Proliferative" means having the ability to proliferate. "Anti-proliferative" means having properties counter to or inapposite to proliferative properties.

Progenitor cell: As used herein, the term "progenitor cell" refers to cells that have greater developmental potential relative to a cell which it can give rise to by differentiation.

Prophylactic: As used herein, "prophylactic" refers to a therapeutic or course of action used to prevent the spread of disease.

Prophylaxis: As used herein, a "prophylaxis" refers to a measure taken to maintain health and prevent the spread of disease. An "immune phrophylaxis" refers to a measure to produce active or passive immunity to prevent the spread of disease.

Protein cleavage site: As used herein, "protein cleavage site" refers to a site where controlled cleavage of the amino acid chain can be accomplished by chemical, enzymatic or photochemical means.

Protein cleavage signal: As used herein "protein cleavage signal" refers to at least one amino acid that flags or marks a polypeptide for cleavage.

Protein of interest: As used herein, the terms "proteins of interest" or "desired proteins" include those provided herein and fragments, mutants, variants, and alterations thereof.

Proximal: As used herein, the term "proximal" means situated nearer to the center or to a point or region of interest.

Pseudouridine: As used herein, pseudouridine refers to the C-glycoside isomer of the nucleoside uridine. A "pseudouridine analog" is any modification, variant, isoform or derivative of pseudouridine. For example, pseudouridine analogs include but are not limited to 1-carboxymethyl-pseudouridine, 1-propynyl-pseudouridine, 1-taurinomethyl-pseudouridine, 1-taurinomethyl-4-thio-pseudouridine, 1-methylpseudouridine ($m^1\psi$), 1-methyl-4-thio-pseudouridine ($m^1s^4\psi$), 4-thio-1-methyl-pseudouridine, 3-methyl-pseudouridine ($m^3\psi$), 2-thio-1-methyl-pseudouridine, 1-methyl-1-deaza-pseudouridine, 2-thio-1-methyl-1-deaza-pseudouridine, dihydropseudouridine, 2-thio-dihydropseudouridine, 2-methoxyuridine, 2-methoxy-4-thio-uridine, 4-methoxy-pseudouridine, 4-methoxy-2-thio-pseudouridine, N1-methyl-pseudouridine, 1-methyl-3-(3-amino-3-carboxypropyl)pseudouridine ($acp^3$ $\psi$), and 2'-O-methyl-pseudouridine ($\psi$m).

Purified: As used herein, "purify," "purified," "purification" means to make substantially pure or clear from unwanted components, material defilement, admixture or imperfection.

Repeated transfection: As used herein, the term "repeated transfection" refers to transfection of the same cell culture with a polynucleotide a plurality of times. The cell culture can be transfected at least twice, at least 3 times, at least 4 times, at least 5 times, at least 6 times, at least 7 times, at least 8 times, at least 9 times, at least 10 times, at least 11 times, at least 12 times, at least 13 times, at least 14 times, at least 15 times, at least 16 times, at least 17 times at least 18 times, at least 19 times, at least 20 times, at least 25 times, at least 30 times, at least 35 times, at least 40 times, at least 45 times, at least 50 times or more.

Sample: As used herein, the term "sample" or "biological sample" refers to a subset of its tissues, cells or component parts (e.g. body fluids, including but not limited to blood, mucus, lymphatic fluid, synovial fluid, cerebrospinal fluid, saliva, amniotic fluid, amniotic cord blood, urine, vaginal fluid and semen). A sample further may include a homogenate, lysate or extract prepared from a whole organism or a subset of its tissues, cells or component parts, or a fraction or portion thereof, including but not limited to, for example, plasma, serum, spinal fluid, lymph fluid, the external sections of the skin, respiratory, intestinal, and genitourinary tracts, tears, saliva, milk, blood cells, tumors, organs. A sample further refers to a medium, such as a nutrient broth or gel, which may contain cellular components, such as proteins or nucleic acid molecule.

Signal Sequences: As used herein, the phrase "signal sequences" refers to a sequence which can direct the transport or localization of a protein.

Single unit dose: As used herein, a "single unit dose" is a dose of any therapeutic administed in one dose/at one time/single route/single point of contact, i.e., single administration event.

Similarity: As used herein, the term "similarity" refers to the overall relatedness between polymeric molecules, e.g. between polynucleotide molecules (e.g. DNA molecules and/or RNA molecules) and/or between polypeptide molecules. Calculation of percent similarity of polymeric molecules to one another can be performed in the same manner as a calculation of percent identity, except that calculation of percent similarity takes into account conservative substitutions as is understood in the art.

Split dose: As used herein, a "split dose" is the division of single unit dose or total daily dose into two or more doses.

Stable: As used herein "stable" refers to a compound that is sufficiently robust to survive isolation to a useful degree of purity from a reaction mixture, and preferably capable of formulation into an efficacious therapeutic agent.

Stabilized: As used herein, the term "stabilize", "stabilized," "stabilized region" means to make or become stable.

Stereoisomer: As used herein, the term "stereoisomer" refers to all possible different isomeric as well as conformational forms which a compound may possess (e.g., a compound of any formula described herein), in particular all possible stereochemically and conformationally isomeric forms, all diastereomers, enantiomers and/or conformers of the basic molecular structure. Some compounds of the present invention may exist in different tautomeric forms, all of the latter being included within the scope of the present invention.

Subject: As used herein, the term "subject" or "patient" refers to any organism to which a composition in accordance with the invention may be administered, e.g., for experimental, diagnostic, prophylactic, and/or therapeutic purposes. Typical subjects include animals (e.g., mammals such as mice, rats, rabbits, non-human primates, and humans) and/or plants.

Substantially: As used herein, the term "substantially" refers to the qualitative condition of exhibiting total or near-total extent or degree of a characteristic or property of interest. One of ordinary skill in the biological arts will understand that biological and chemical phenomena rarely, if ever, go to completion and/or proceed to completeness or achieve or avoid an absolute result. The term "substantially" is therefore used herein to capture the potential lack of completeness inherent in many biological and chemical phenomena.

Substantially equal: As used herein as it relates to time differences between doses, the term means plus/minus 2%.

Substantially simultaneously: As used herein and as it relates to plurality of doses, the term means within 2 seconds.

Suffering from: An individual who is "suffering from" a disease, disorder, and/or condition has been diagnosed with or displays one or more symptoms of a disease, disorder, and/or condition.

Susceptible to: An individual who is "susceptible to" a disease, disorder, and/or condition has not been diagnosed with and/or may not exhibit symptoms of the disease, disorder, and/or condition but harbors a propensity to develop a disease or its symptoms. In some embodiments, an individual who is susceptible to a disease, disorder, and/or condition (for example, cancer) may be characterized by one or more of the following: (1) a genetic mutation associated with development of the disease, disorder, and/or condition; (2) a genetic polymorphism associated with development of the disease, disorder, and/or condition; (3) increased and/or decreased expression and/or activity of a protein and/or nucleic acid associated with the disease, disorder, and/or condition; (4) habits and/or lifestyles associated with development of the disease, disorder, and/or condition; (5) a family history of the disease, disorder, and/or condition; and (6) exposure to and/or infection with a microbe associated with development of the disease, disorder, and/or condition. In some embodiments, an individual who is susceptible to a disease, disorder, and/or condition will develop the disease, disorder, and/or condition. In some embodiments, an individual who is susceptible to a disease, disorder, and/or condition will not develop the disease, disorder, and/or condition.

Sustained release: As used herein, the term "sustained release" refers to a pharmaceutical composition or compound release profile that conforms to a release rate over a specific period of time.

Synthetic: The term "synthetic" means produced, prepared, and/or manufactured by the hand of man. Synthesis of polynucleotides or polypeptides or other molecules of the present invention may be chemical or enzymatic.

Targeted Cells: As used herein, "targeted cells" refers to any one or more cells of interest. The cells may be found in vitro, in vivo, in situ or in the tissue or organ of an organism. The organism may be an animal, preferably a mammal, more preferably a human and most preferably a patient.

Therapeutic Agent: The term "therapeutic agent" refers to any agent that, when administered to a subject, has a therapeutic, diagnostic, and/or prophylactic effect and/or elicits a desired biological and/or pharmacological effect.

Therapeutically effective amount: As used herein, the term "therapeutically effective amount" means an amount of an agent to be delivered (e.g., nucleic acid, drug, therapeutic agent, diagnostic agent, prophylactic agent, etc.) that is sufficient, when administered to a subject suffering from or susceptible to an infection, disease, disorder, and/or condition, to treat, improve symptoms of, diagnose, prevent, and/or delay the onset of the infection, disease, disorder, and/or condition.

Therapeutically effective outcome: As used herein, the term "therapeutically effective outcome" means an outcome that is sufficient in a subject suffering from or susceptible to an infection, disease, disorder, and/or condition, to treat, improve symptoms of, diagnose, prevent, and/or delay the onset of the infection, disease, disorder, and/or condition.

Total daily dose: As used herein, a "total daily dose" is an amount given or prescribed in 24 hr period. It may be administered as a single unit dose.

Totipotency: As used herein, "totipotency" refers to a cell with a developmental potential to make all of the cells found in the adult body as well as the extra-embryonic tissues, including the placenta.

Transcription factor: As used herein, the term "transcription factor" refers to a DNA-binding protein that regulates transcription of DNA into RNA, for example, by activation or repression of transcription. Some transcription factors effect regulation of transcription alone, while others act in concert with other proteins. Some transcription factor can both activate and repress transcription under certain conditions. In general, transcription factors bind a specific target sequence or sequences highly similar to a specific consensus sequence in a regulatory region of a target gene. Transcription factors may regulate transcription of a target gene alone or in a complex with other molecules.

Transcription: As used herein, the term "transcription" refers to methods to introduce exogenous nucleic acids into a cell. Methods of transfection include, but are not limited to, chemical methods, physical treatments and cationic lipids or mixtures.

Transdifferentiation: As used herein, "transdifferentiation" refers to the capacity of differentiated cells of one type to lose identifying characteristics and to change their phenotype to that of other fully differentiated cells.

Treating: As used herein, the term "treating" refers to partially or completely alleviating, ameliorating, improving, relieving, delaying onset of, inhibiting progression of, reducing severity of, and/or reducing incidence of one or more symptoms or features of a particular infection, disease, disorder, and/or condition. For example, "treating" cancer may refer to inhibiting survival, growth, and/or spread of a tumor. Treatment may be administered to a subject who does not exhibit signs of a disease, disorder, and/or condition and/or to a subject who exhibits only early signs of a disease, disorder, and/or condition for the purpose of decreasing the risk of developing pathology associated with the disease, disorder, and/or condition.

Unmodified: As used herein, "unmodified" refers to any substance, compound or molecule prior to being changed in any way. Unmodified may, but does not always, refer to the wild type or native form of a biomolecule. Molecules may undergo a series of modifications whereby each modified molecule may serve as the "unmodified" starting molecule for a subsequent modification.

Unipotent: As used herein, "unipotent" when referring to a cell means to give rise to a single cell lineage.

Vaccine: As used herein, the phrase "vaccine" refers to a biological preparation that improves immunity to a particular disease.

Viral protein: As used herein, the phrase "viral protein" means any protein originating from a virus.

EQUIVALENTS AND SCOPE

Those skilled in the art will recognize, or be able to ascertain using no more than routine experimentation, many equivalents to the specific embodiments in accordance with the invention described herein. The scope of the present invention is not intended to be limited to the above Description, but rather is as set forth in the appended claims.

In the claims, articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or all of the group members are present in, employed in, or otherwise relevant to a given product or process.

It is also noted that the term "comprising" is intended to be open and permits but does not require the inclusion of additional elements or steps. When the term "comprising" is used herein, the term "consisting of" is thus also encompassed and disclosed.

Where ranges are given, endpoints are included. Furthermore, it is to be understood that unless otherwise indicated or otherwise evident from the context and understanding of one of ordinary skill in the art, values that are expressed as ranges can assume any specific value or subrange within the stated ranges in different embodiments of the invention, to the tenth of the unit of the lower limit of the range, unless the context clearly dictates otherwise.

In addition, it is to be understood that any particular embodiment of the present invention that falls within the prior art may be explicitly excluded from any one or more of the claims. Since such embodiments are deemed to be known to one of ordinary skill in the art, they may be excluded even if the exclusion is not set forth explicitly herein. Any particular embodiment of the compositions of the invention (e.g., any nucleic acid or protein encoded thereby; any method of production; any method of use; etc.) can be excluded from any one or more claims, for any reason, whether or not related to the existence of prior art.

All cited sources, for example, references, publications, databases, database entries, and art cited herein, are incorporated into this application by reference, even if not expressly stated in the citation. In case of conflicting statements of a cited source and the instant application, the statement in the instant application shall control.

Section and table headings are not intended to be limiting.

EXAMPLES

Example 1. Manufacture of Polynucleotides

According to the present invention, the manufacture of polynucleotides and or parts or regions thereof may be accomplished utilizing the methods taught in U.S. Ser. No. 61/800,049 filed Mar. 15, 2013 entitled "Manufacturing Methods for Production of RNA Transcripts", the contents of which is incorporated herein by reference in its entirety.

Purification methods may include those taught in U.S. Ser. No. 61/799,872 filed Mar. 15, 2013 entitled "Methods of removing DNA fragments in mRNA production"; U.S. Ser. No. 61/794,842 filed Mar. 15, 2013, entitled "Ribonucleic acid purification", the contents of each of which is incorporated herein by reference in its entirety.

Detection and characterization methods of the polynucleotides may be performed as taught in U.S. Ser. No. 61/798,945 filed Mar. 15, 2013 entitled "Characterization of mRNA Molecules, the contents of which is incorporated herein by reference in its entirety.

Characterization of the polynucleotides of the invention may be accomplished using a procedure selected from the group consisting of polynucleotide mapping, reverse transcriptase sequencing, charge distribution analysis, and detection of RNA impurities, wherein characterizing comprises determining the RNA transcript sequence, determining the purity of the RNA transcript, or determining the charge heterogeneity of the RNA transcript. Such methods are taught in, for example, U.S. Ser. No. 61/799,905 filed Mar. 15, 2013 entitled "Analysis of mRNA Heterogeneity and Stability" and U.S. Ser. No. 61/800,110 filed Mar. 15, 2013 entitled "Ion Exchange Purification of mRNA" the contents of each of which is incorporated herein by reference in its entirety.

Example 2. Chimeric Polynucleotide Synthesis: Triphosphate Route

Introduction

According to the present invention, two regions or parts of a chimeric polynucleotide may be joined or ligated using triphosphate chemistry.

According to this method, a first region or part of 100 nucleotides or less is chemically synthesized with a 5' monophosphate and terminal 3' desOH or blocked OH. If the region is longer than 80 nucleotides, it may be synthesized as two strands for ligation.

If the first region or part is synthesized as a non-positionally modified region or part using in vitro transcription (IVT), conversion the 5'monophosphate with subsequent capping of the 3' terminus may follow.

Monophosphate protecting groups may be selected from any of those known in the art.

The second region or part of the chimeric polynucleotide may be synthesized using either chemical synthesis or IVT methods. IVT methods may include an RNA polymerase that can utilize a primer with a modified cap. Alternatively, a cap of up to 80 nucleotides may be chemically synthesized and coupled to the IVT region or part.

It is noted that for ligation methods, ligation with DNA T4 ligase, followed by treatment with DNAse should readily avoid concatenation.

The entire chimeric polynucleotide need not be manufactured with a phosphate-sugar backbone. If one of the regions or parts encodes a polypeptide, then it is preferable that such region or part comprise a phosphate-sugar backbone.

Ligation is then performed using any known click chemistry, orthoclick chemistry, solulink, or other bioconjugate chemistries known to those in the art.

Synthetic Route

The chimeric polynucleotide is made using a series of starting segments. Such segments include:

(a) Capped and protected 5' segment comprising a normal 3'OH (SEG. 1)

(b) 5' triphosphate segment which may include the coding region of a polypeptide and comprising a normal 3'OH (SEG. 2)

(c) 5' monophosphate segment for the 3' end of the chimeric polynucleotide (e.g., the tail) comprising cordycepin or no 3'OH (SEG. 3)

After synthesis (chemical or IVT), segment 3 (SEG. 3) is treated with cordycepin and then with pyrophosphatase to create the 5'monophosphate.

Segment 2 (SEG. 2) is then ligated to SEG. 3 using RNA ligase. The ligated polynucleotide is then purified and treated with pyrophosphatase to cleave the diphosphate. The treated SEG.2-SEG. 3 construct is then purified and SEG. 1 is ligated to the 5' terminus. A further purification step of the chimeric polynucleotide may be performed.

Where the chimeric polynucleotide encodes a polypeptide, the ligated or joined segments may be represented as: 5'UTR (SEG. 1), open reading frame or ORF (SEG. 2) and 3'UTR+PolyA (SEG. 3).

The yields of each step may be as much as 90-95%.

Example 3: PCR for cDNA Production

PCR procedures for the preparation of cDNA are performed using 2×KAPA HIFI™ HotStart ReadyMix by Kapa Biosystems (Woburn, Mass.). This system includes 2×KAPA ReadyMix12.5 µl; Forward Primer (10 uM) 0.75 µl; Reverse Primer (10 uM) 0.75 µl; Template cDNA-100 ng; and dH$_2$O diluted to 25.0 µl. The reaction conditions are at 95° C. for 5 min. and 25 cycles of 98° C. for 20 sec, then 58° C. for 15 sec, then 72° C. for 45 sec, then 72° C. for 5 min. then 4° C. to termination.

The reverse primer of the instant invention incorporates a poly-T$_{120}$ for a poly-Aim in the mRNA. Other reverse primers with longer or shorter poly(T) tracts can be used to adjust the length of the poly(A) tail in the polynucleotide mRNA.

The reaction is cleaned up using Invitrogen's PURELINK™ PCR Micro Kit (Carlsbad, Calif.) per manufacturer's instructions (up to 5 µg). Larger reactions will require a cleanup using a product with a larger capacity. Following the cleanup, the cDNA is quantified using the NANODROP™ and analyzed by agarose gel electrophoresis to confirm the cDNA is the expected size. The cDNA is then submitted for sequencing analysis before proceeding to the in vitro transcription reaction.

Example 4. In Vitro Transcription (IVT)

The in vitro transcription reaction generates polynucleotides containing uniformly modified polynucleotides. Such uniformly modified polynucleotides may comprise a region or part of the polynucleotides of the invention. The input nucleotide triphosphate (NTP) mix is made in-house using natural and un-natural NTPs.

A typical in vitro transcription reaction includes the following:

| | | |
|---|---|---|
| 1 | Template cDNA | 1.0 µg |
| 2 | 10x transcription buffer (400 mM Tris-HCl pH 8.0, 190 mM MgCl$_2$, 50 mM DTT, 10 mM Spermidine) | 2.0 µl |
| 3 | Custom NTPs (25 mM each) | 7.2 µl |
| 4 | RNase Inhibitor | 20 U |
| 5 | T7 RNA polymerase | 3000 U |
| 6 | dH$_2$0 | Up to 20.0 µl, and |
| 7 | Incubation at 37° C. for 3 hr-5 hrs. | |

The crude IVT mix may be stored at 4° C. overnight for cleanup the next day. 1 U of RNase-free DNase is then used to digest the original template. After 15 minutes of incubation at 37° C., the mRNA is purified using Ambion's MEGACLEAR™ Kit (Austin, Tex.) following the manufacturer's instructions. This kit can purify up to 500 of RNA. Following the cleanup, the RNA is quantified using the NanoDrop and analyzed by agarose gel electrophoresis to confirm the RNA is the proper size and that no degradation of the RNA has occurred.

Example 5. Enzymatic Capping

Capping of a polynucleotide is performed as follows where the mixture includes: IVT RNA 60 µg-180 µg and dH$_2$O up to 72 µl. The mixture is incubated at 65° C. for 5 minutes to denature RNA, and then is transferred immediately to ice.

The protocol then involves the mixing of 10× Capping Buffer (0.5 M Tris-HCl (pH 8.0), 60 mM KCl, 12.5 mM MgCl$_2$) (10.0 µl); 20 mM GTP (5.0 µl); 20 mM S-Adenosyl Methionine (2.5 µl); RNase Inhibitor (100 U); 2'-O-Methyltransferase (400U); Vaccinia capping enzyme (Guanylyl transferase) (40 U); dH$_2$O (Up to 28 µl); and incubation at 37° C. for 30 minutes for 60 µg RNA or up to 2 hours for 180 µg of RNA.

The polynucleotide is then purified using Ambion's MEGACLEAR™ Kit (Austin, Tex.) following the manufacturer's instructions. Following the cleanup, the RNA is quantified using the NANODROP™ (ThermoFisher, Waltham, Mass.) and analyzed by agarose gel electrophoresis to confirm the RNA is the proper size and that no degradation of the RNA has occurred. The RNA product may also be sequenced by running a reverse-transcription-PCR to generate the cDNA for sequencing.

Example 6. PolyA Tailing Reaction

Without a poly-T in the cDNA, a poly-A tailing reaction must be performed before cleaning the final product. This is done by mixing Capped IVT RNA (100 µl); RNase Inhibitor (20 U); 10× Tailing Buffer (0.5 M Tris-HCl (pH 8.0), 2.5 M NaCl, 100 mM MgCl$_2$)(12.0 µl); 20 mM ATP (6.0 µl);

Poly-A Polymerase (20 U); dH$_2$O up to 123.5 µl and incubation at 37° C. for 30 min. If the poly-A tail is already in the transcript, then the tailing reaction may be skipped and proceed directly to cleanup with Ambion's MEGA-CLEAR™ kit (Austin, Tex.) (up to 500 µg). Poly-A Polymerase is preferably a recombinant enzyme expressed in yeast.

It should be understood that the processivity or integrity of the polyA tailing reaction may not always result in an exact size polyA tail. Hence polyA tails of approximately between 40-200 nucleotides, e.g., about 40, 50, 60, 70, 80, 90, 91, 92, 93, 94, 95, 96, 97, 98, 99, 100, 101, 102, 103, 104, 105, 106, 107, 108, 109, 110, 150-165, 155, 156, 157, 158, 159, 160, 161, 162, 163, 164 or 165 are within the scope of the invention.

Example 7. Natural 5' Caps and 5' Cap Analogues

5'-capping of polynucleotides may be completed concomitantly during the in vitro-transcription reaction using the following chemical RNA cap analogs to generate the 5'-guanosine cap structure according to manufacturer protocols: 3"-O-Me-m7G(5)ppp(5') G [the ARCA cap];G(5')ppp(5')A; G(5')ppp(5')G; m7G(5')ppp(5')A; m7G(5')ppp(5')G (New England BioLabs, Ipswich, Mass.). 5'-capping of modified RNA may be completed post-transcriptionally using a Vaccinia Virus Capping Enzyme to generate the "Cap 0" structure: m7G(5')ppp(5')G (New England BioLabs, Ipswich, Mass.). Cap 1 structure may be generated using both Vaccinia Virus Capping Enzyme and a 2'-O methyl-transferase to generate: m7G(5')ppp(5')G-2'-O-methyl. Cap 2 structure may be generated from the Cap 1 structure followed by the 2'-O-methylation of the 5'-antepenultimate nucleotide using a 2'-O methyl-transferase. Cap 3 structure may be generated from the Cap 2 structure followed by the 2'-O-methylation of the 5'-preantepenultimate nucleotide using a 2'-O methyl-transferase. Enzymes are preferably derived from a recombinant source.

When transfected into mammalian cells, the modified mRNAs have a stability of between 12-18 hours or more than 18 hours, e.g., 24, 36, 48, 60, 72 or greater than 72 hours.

Example 8. Capping Assays

A. Protein Expression Assay

Polynucleotides encoding a polypeptide, containing any of the caps taught herein can be transfected into cells at equal concentrations. 6, 12, 24 and 36 hours post-transfection the amount of protein secreted into the culture medium can be assayed by ELISA. Synthetic polynucleotides that secrete higher levels of protein into the medium would correspond to a synthetic polynucleotide with a higher translationally-competent Cap structure.

B. Purity Analysis Synthesis

Polynucleotides encoding a polypeptide, containing any of the caps taught herein can be compared for purity using denaturing Agarose-Urea gel electrophoresis or HPLC analysis. Polynucleotides with a single, consolidated band by electrophoresis correspond to the higher purity product compared to polynucleotides with multiple bands or streaking bands. Synthetic polynucleotides with a single HPLC peak would also correspond to a higher purity product. The capping reaction with a higher efficiency would provide a more pure polynucleotide population.

C. Cytokine Analysis

Polynucleotides encoding a polypeptide, containing any of the caps taught herein can be transfected into cells at multiple concentrations. 6, 12, 24 and 36 hours post-transfection the amount of pro-inflammatory cytokines such as TNF-alpha and IFN-beta secreted into the culture medium can be assayed by ELISA. Polynucleotides resulting in the secretion of higher levels of pro-inflammatory cytokines into the medium would correspond to polynucleotides containing an immune-activating cap structure.

D. Capping Reaction Efficiency

Polynucleotides encoding a polypeptide, containing any of the caps taught herein can be analyzed for capping reaction efficiency by LC-MS after nuclease treatment. Nuclease treatment of capped polynucleotides would yield a mixture of free nucleotides and the capped 5'-5-triphosphate cap structure detectable by LC-MS. The amount of capped product on the LC-MS spectra can be expressed as a percent of total polynucleotide from the reaction and would correspond to capping reaction efficiency. The cap structure with higher capping reaction efficiency would have a higher amount of capped product by LC-MS.

Example 9. Agarose Gel Electrophoresis of Modified RNA or RT PCR Products

Individual polynucleotides (200-400 ng in a 20 µl volume) or reverse transcribed PCR products (200-400 ng) are loaded into a well on a non-denaturing 1.2% Agarose E-Gel (Invitrogen, Carlsbad, Calif.) and run for 12-15 minutes according to the manufacturer protocol.

Example 10. Nanodrop Modified RNA Quantification and UV Spectral Data

Modified polynucleotides in TE buffer (1 µl) are used for Nanodrop UV absorbance readings to quantitate the yield of each polynucleotide from an chemical synthesis or in vitro transcription reaction.

Example 11. Formulation of Modified mRNA Using Lipidoids

Polynucleotides are formulated for in vitro experiments by mixing the polynucleotides with the lipidoid at a set ratio prior to addition to cells. In vivo formulation may require the addition of extra ingredients to facilitate circulation throughout the body. To test the ability of these lipidoids to form particles suitable for in vivo work, a standard formulation process used for siRNA-lipidoid formulations may used as a starting point. After formation of the particle, polynucleotide is added and allowed to integrate with the complex. The encapsulation efficiency is determined using a standard dye exclusion assays.

Example 12. Method of Screening for Protein Expression

A. Electrospray Ionization

A biological sample which may contain proteins encoded by a polynucleotide administered to the subject is prepared and analyzed according to the manufacturer protocol for electrospray ionization (ESI) using 1, 2, 3 or 4 mass analyzers. A biologic sample may also be analyzed using a tandem ESI mass spectrometry system.

Patterns of protein fragments, or whole proteins, are compared to known controls for a given protein and identity is determined by comparison.

B. Matrix-Assisted Laser Desorption/Ionization

A biological sample which may contain proteins encoded by one or more polynucleotides administered to the subject is prepared and analyzed according to the manufacturer protocol for matrix-assisted laser desorption/ionization (MALDI).

Patterns of protein fragments, or whole proteins, are compared to known controls for a given protein and identity is determined by comparison.

C. Liquid Chromatography-Mass spectrometry-Mass spectrometry

A biological sample, which may contain proteins encoded by one or more polynucleotides, may be treated with a trypsin enzyme to digest the proteins contained within. The resulting peptides are analyzed by liquid chromatography-mass spectrometry-mass spectrometry (LC/MS/MS). The peptides are fragmented in the mass spectrometer to yield diagnostic patterns that can be matched to protein sequence databases via computer algorithms. The digested sample may be diluted to achieve 1 ng or less starting material for a given protein. Biological samples containing a simple buffer background (e.g. water or volatile salts) are amenable to direct in-solution digest; more complex backgrounds (e.g. detergent, non-volatile salts, glycerol) require an additional clean-up step to facilitate the sample analysis.

Patterns of protein fragments, or whole proteins, are compared to known controls for a given protein and identity is determined by comparison.

Example 13. Cyclization and/or concatemerization

According to the present invention, a polynucleotide may be cyclized, or concatemerized, to generate a translation competent molecule to assist interactions between poly-A binding proteins and 5'-end binding proteins. The mechanism of cyclization or concatemerization may occur through at least 3 different routes: 1) chemical, 2) enzymatic, and 3) ribozyme catalyzed. The newly formed 5'-/3'-linkage may be intramolecular or intermolecular.

In the first route, the 5'-end and the 3'-end of the nucleic acid contain chemically reactive groups that, when close together, form a new covalent linkage between the 5'-end and the 3'-end of the molecule. The 5'-end may contain an NETS-ester reactive group and the 3'-end may contain a 3'-amino-terminated nucleotide such that in an organic solvent the 3'-amino-terminated nucleotide on the 3'-end of a synthetic mRNA molecule will undergo a nucleophilic attack on the 5'-NHS-ester moiety forming a new 5'-/3'-amide bond.

In the second route, T4 RNA ligase may be used to enzymatically link a 5'-phosphorylated nucleic acid molecule to the 3'-hydroxyl group of a nucleic acid forming a new phosphorodiester linkage. In an example reaction, 1 μg of a nucleic acid molecule is incubated at 37° C. for 1 hour with 1-10 units of T4 RNA ligase (New England Biolabs, Ipswich, Mass.) according to the manufacturer's protocol. The ligation reaction may occur in the presence of a split polynucleotide capable of base-pairing with both the 5'- and 3'-region in juxtaposition to assist the enzymatic ligation reaction.

In the third route, either the 5'- or 3'-end of the cDNA template encodes a ligase ribozyme sequence such that during in vitro transcription, the resultant nucleic acid molecule can contain an active ribozyme sequence capable of ligating the 5'-end of a nucleic acid molecule to the 3'-end of a nucleic acid molecule. The ligase ribozyme may be derived from the Group I Intron, Group I Intron, Hepatitis Delta Virus, Hairpin ribozyme or may be selected by SELEX (systematic evolution of ligands by exponential enrichment). The ribozyme ligase reaction may take 1 to 24 hours at temperatures between 0 and 37° C.

Example 14. In Vitro Expression of LDL Receptors

Human embryonic kidney epithelial (HEK293) cells (LGC standards GmbH, Wesel, Germany) are seeded on 6-well plates (BD Biosciences, San Jose, USA). HEK293 are seeded at a density of about 500,000 cells per well in 3 mL cell culture medium. Formulations containing wild type LDLR mRNA (fully modified with 5-methylcytidine and pseudouridine or fully modified with 1-methylpseudouridine; 5'cap, cap 1; polyA tail of at least 140 nucleotides not shown in sequence), an LDLR EGF-A domain sequence variant mRNA (fully modified with 5-methylcytidine and pseudouridine or fully modified with 1-methylpseudouridine; 5'cap, cap1; polyA tail of at least 140 nucleotides not shown in sequence), an LDLR EGF-A and cytoplasmic domain sequence variant (fully modified with 5-methylcytidine and pseudouridine or fully modified with 1-methylpseudouridine; 5'cap, cap1; polyA tail of at least 140 nucleotides not shown in sequence), or an LDLR cytoplasmic domain sequence variant (fully modified with 5-methylcytidine and pseudouridine or fully modified with 1-methylpseudouridine; 5'cap, cap1; polyA tail of at least 140 nucleotides not shown in sequence) or a control of G-CSF (fully modified with 5-methylcytidine and pseudouridine or fully modified with 1-methylpseudouridine; 5'cap, cap1; polyA tail of at least 140 nucleotides not shown in sequence) are added directly after seeding the cells at quantities of 800 ng per well and incubated. The LDLR mRNA sequence variants prepared and tested will include: a four amino acid substitution variant, N316A, E317A, D331A, and Y336A (#399), or the following single amino acid substitution variants Y336A (#400), E317A (#401), N316A (#402), L339D (#403), D331E (#404). These sequence variants may also contain one or more of several cytoplasmic domain variants including K816R, K830R, or C839A. mRNA transfected cells will be treated with anti-LDLR antibody and one set of LDLR transfected cells will be treated with normal goat IgG as controls. Bound primary antibodies will detected by FACS analysis following treatment with a Phycoerythrin (PE)-labeled secondary antibody. The percent gated live cells will be detected to express LDLR. It is anticipated that no staining will be observed in LDLR mRNA treated cells stained with the control non-immune IgG and no LDLR positive cells will be detected in cells transfected with G-CSF mRNA.

Example 15. In Vitro LDLR Expression

A. Expression

Human embryonic kidney epithelial (HEK293) cells (LGC standards GmbH, Wesel, Germany) are seeded on 6-well plates (BD Biosciences, San Jose, USA). HEK293 are seeded at a density of about 500,000 cells per well in 3 mL cell culture medium. Formulations containing wild type LDLR mRNA (fully modified with 5-methylcytidine and pseudouridine or fully modified with 1-methylpseudouridine; 5'cap, cap 1; polyA tail of at least 140 nucleotides not shown in sequence), an LDLR EGF-A domain sequence variant mRNA (fully modified with 5-methylcytidine and pseudouridine or fully modified with 1-methylpseudouridine; 5'cap, cap1; polyA tail of at least 140 nucleotides not shown in sequence), an LDLR EGF-A and cytoplasmic domain sequence variant (fully modified with 5-methylcytidine and pseudouridine or fully modified with 1-methylpseudouridine; 5'cap, cap1; polyA tail of at least 140 nucleotides not shown in sequence), or an LDLR cytoplasmic domain sequence variant (fully modified with 5-methylcytidine and pseudouridine or fully modified with 1-methylpseudouridine; 5'cap, cap1; polyA tail of at least 140 nucleotides not shown in sequence) or a control of G-CSF (fully modified with 5-methylcytidine and pseudouridine or fully modified with 1-methylpseudouridine; 5'cap, cap1; polyA tail of at least 140 nucleotides not shown in sequence) are added directly after seeding the cells at quantities of 800 ng per well and incubated in the presence and in the absence of exogenous human PCSK9 at 60 µg/mL. The LDLR mRNA sequence variants prepared and tested will include: a four amino acid substitution variant (also referred to herein as a LDLR mutant with 4 mutations), N316A, E317A, D331A, and Y336A (#399), or the following single amino acid substitution variants Y336A (#400), E317A (#401), N316A (#402), L339D (#403), D33 1E (#404). These sequence variants may also contain one or more of several cytoplasmic domain variants including K816R, K830R, or C839A. mRNA transfected cells will be treated with anti-LDLR antibody and one set of LDLR transfected cells will be treated with normal goat IgG as controls. After fifteen hours at 37° C., the transfection media will be removed, the cells washed, and will be treated with anti-LDLR antibody conjugated to Phycoerythrin (PE) as described above. One set of LDLR transfected cells will be treated with normal goat IgG conjugated to PE and another set of untransfected cells will be used as controls. Cells transfected with G-CSF modified mRNA will be used as an additional negative control. Bound primary antibodies will be detected by flow cytometry as described above.

It is anticipated that the FACS analysis will show that cell surface LDLR expression in cells transfected with wild-type LDLR mRNA as a percent of gated live cells. In contrast, it is expected that each of the LDLR mRNA variants with substitutions in the PCSK9 binding domain will show less sensitivity to down-modulation by exogenous PCSK9, with values of percent reduction ranging from −8.1% to 29% (compared to 58% reduction observed with wild-type LDLR). It is also anticipated that LDLR PCSK9 binding variants containing one or more of the mutations in the cytoplasmic domain, including K816R, K830R, or C839A or any combination of these variants, will also be insensitive to exogenous PCSK9. As the latter variants also are expected to be deficient in IDOL-dependent ubiquitination of the LDLR, these variants may be even less sensitive to PCSK9 down modulation due to increased apparent LDLR half-life.

B. Functionality of LDLR

To evaluate whether the expressed LDLR are functional, BODIPY-labeled LDL will be used. HEK293 cells will be transfected overnight with either LDLR or G-CSF mRNAs, the cells will be washed and incubated with increasing amounts of BODIPY-LDL. Following incubation for 1.0-h at 37° C., the cells will be washed and the cell associated BODIPY-LDL will be assessed by flow cytometry. Contour plots of the BODIPY-LDL binding will be obtained. For wild-type, LDLR PCSK9 and/or cytoplasmic domain binding variants, the binding of BODIPY-LDL to LDLR mRNA transfected cells will be evident as a right-ward shift in the gated cell population that increased with BODIPY-LDL concentration. It is expected that a similar rightward shift in the gated cell population will be seen for cells transfected with each of the LDLR mRNA constructs. It is also expected that the half-maximal cell association will be the same for BODIPY-LDL binding to cells transfected with either wild type, the PCSK9 binding-deficient, and/or the cytoplasmic domain variant LDLR mRNAs. For each construct, it is expected that BODIPY-LDL binding will be of high affinity (half-maximal binding between 0.6-0.7 ng/mL) and saturable. It is likely that no BODIPY-LDL binding will be observed for cells transfected with G-CSF mRNA.

C. Effect on Half-Life of Cell Surface LDLR in Cells

To assess whether exogenous PCSK9 can modulate the apparent half-life of cell surface LDL receptors in cells transfected with LDLR mRNA, HEK293 cells will be plated, incubated, and transfected with LDLR mRNA as described above. The cell monolayers will be washed and fresh media with or without PCSK9 (60 µg/mL) will be added. After various times of incubation at 37° C., cell surface LDLR expression will be monitored by flow cytometry using anti-LDLR antibodies as described above. It is anticipated that cell surface LDLR in cells transfected with wild-type LDLR mRNA will decrease in a time-dependent manner. Similarly, addition of PCSK9 to the media of cells transfected with wild-type LDLR mRNA is expected to decrease the apparent half-life of cell surface LDLR. In contrast, addition of PCSK9 to the media of cells transfected with PCSK9 binding-deficient LDLR mRNA or PCSK9 binding-deficient and the cytoplasmic domain mutant LDLR mRNA will produced little or no change in the apparent half-life of cell surface LDLR. It is expected that these data will show that cells transfected with LDLR mRNA encoding LDLR with mutations in the PCSK9 binding site in the presence or absence of cytoplasmic domain mutations will fail to respond to exogenous PCSK9, suggesting that these binding variants may have a longer half-life than wild-type LDLR in vivo and be useful for treating patients with hypercholesterolemia.

D. Ubiquitination of the LDLR

The mutations in the LDLR mRNA encoding the cytoplasmic domain of the LDLR (K816R, K830R, or C839A) either together or singly, or in combination, are expected to prevent the ubiquitination of the LDLR and thus prolong the cellular half-life of the LDLR. To assess this, HEK293 cells or Hep-G2 cells will be transfected with formulations containing wild type LDLR mRNA (fully modified with 5-methylcytidine and pseudouridine or fully modified with 1-methylpseudouridine; 5' cap, cap1; polyA tail of at least 140 nucleotides not shown in sequence), an LDLR EGF-A domain sequence variant mRNA (fully modified with 5-methylcytidine and pseudouridine or fully modified with 1-methylpseudouridine; 5'cap, cap1; polyA tail of at least 140 nucleotides not shown in sequence), an LDLR EGF-A and cytoplasmic domain sequence variant (fully modified with 5-methylcytidine and pseudouridine or fully modified with 1-methylpseudouridine; 5' cap, cap1; polyA tail of at least 140 nucleotides not shown in sequence), or an LDLR cytoplasmic domain sequence variant (fully modified with 5-methylcytidine and pseudouridine or fully modified with 1-methylpseudouridine; 5'cap, cap 1; polyA tail of at least 140 nucleotides not shown in sequence) or a control of G-CSF (fully modified with 5-methylcytidine and pseudouridine or fully modified with 1-methylpseudouridine; 5' cap, cap1; polyA tail of at least 140 nucleotides not shown in sequence) are added directly after seeding the cells at quantities of 800 ng per well and incubated. The LDLR mRNA sequence variants prepared and tested will include: a four amino acid substitution variant, N316A, E317A, D331A, and Y336A (#399), or the following single amino acid substitution variants Y336A (#400), E317A (#401), N316A (#402), L339D (#403), D33 1E (#404). These sequence variants may also contain one or more of several cytoplasmic domain variants including K816R, K830R, or C839A. Cells will be incubated with oxysterol ligands for LXR alpha for up to 24 h at 37° C. to induce the expression of IDOL. The ability of IDOL to ubiquitinate the LDLR will be assessed by Western analysis of cell extracts with ubiquitin and LDLR specific antibodies. It is anticipated that the LDLR variants containing the cytoplasmic domain mutations will show decreased ubiquitination.

Example 16. In Vivo LDLR Expression

To assess the function of the LDLR mRNAs in vivo, LDL receptor-deficient mice will be utilized. Animals will receive various doses of nanoparticle formulations, such as those utilizing C12-200, for example, containing wild type LDLR mRNA (fully modified with 5-methylcytidine and pseudouridine or fully modified with 1-methylpseudouridine; 5'cap, cap1; polyA tail of at least 140 nucleotides not shown in sequence), an LDLR EGF-A domain sequence variant mRNA (fully modified with 5-methylcytidine and pseudouridine or fully modified with 1-methylpseudouridine; 5'cap, cap 1; polyA tail of at least 140 nucleotides not shown in sequence), an LDLR EGF-A and cytoplasmic domain sequence variant (fully modified with 5-methylcytidine and pseudouridine or fully modified with 1-methylpseudouridine; 5'cap, cap1; polyA tail of at least 140 nucleotides not shown in sequence), or an LDLR cytoplasmic domain sequence variant (fully modified with 5-methylcytidine and pseudouridine or fully modified with 1-methylpseudouridine; 5'cap, cap1; polyA tail of at least 140 nucleotides not shown in sequence) or a control of G-CSF (fully modified with 5-methylcytidine and pseudouridine or fully modified with 1-methylpseudouridine; 5'cap, cap1; polyA tail of at least 140 nucleotides not shown in sequence) are added directly after seeding the cells at quantities of 800 ng per well and incubated. The LDLR mRNA sequence variants prepared and tested will include: a four amino acid substitution variant, N316A, E317A, D331A, and Y336A (#399), or the following single amino acid substitution variants Y336A (#400), E317A (#401), N316A (#402), L339D (#403), D331E (#404). These sequence variants may also contain one or more of several cytoplasmic domain variants including K816R, K830R, or C839A. After various periods of time the mice will be sacrificed, serum samples will be obtained, and levels of hepatic LDLR expression will be assessed by Western blotting. It is anticipated that the apparent half-life of LDLR encoded by the PCSK9 binding variants will be increased. It is further anticipated that the half-life of LDLR encoded by PCSK9 binding mutants also harboring mutations in the cytoplasmic domain will be increased. It is expected that the prolonged half-life of the LDLR mutants will be associated with reductions in the level of serum VLDL+IDL+LDL cholesterol. These data will further validate the approach for treating familial hypercholesterolemia with LDLR mRNA.

Example 17. Mouse LDLR Mutant Constructs

According to the present invention, the polynucleotide may comprise at least a first region of linked nucleosides encoding mouse LDLR. The mouse LDLR protein sequences of the present invention are listed in Table 10 below. Shown in Table 10, are the name and description of the gene and the protein sequence identifier. For any particular gene there may exist one or more variants or isoforms. It will be appreciated by those of skill in the art that disclosed in the Table are potential flanking regions. The coding region is definitively and specifically disclosed by teaching the protein sequence. Consequently, the sequences taught flanking that encoding the protein are considered flanking regions. It is also possible to further characterize the 5' and 3' flanking regions by utilizing one or more available databases or algorithms. Databases have annotated the features contained in the flanking regions of the ENST transcripts and these are available in the art.

TABLE 10

| Targets | | | | |
|---|---|---|---|---|
| Target No | Gene | Description | Protein SEQ ID NO | mRNA SEQ ID NO |
| 21 | LDLR_N317A, K832R, C841A | low density lipoprotein receptor/PCSK9/ ubiquitation mutant (*Mus musculus*) | 724 | 732 |
| 22 | LDLR_N317A, K818R, K832R, C841A | low density lipoprotein receptor/PCSK9/ ubiquitation mutant (*Mus musculus*) | 725 | |
| 23 | LDLR_L340D, K832R, C841A | low density lipoprotein receptor/PCSK9/ ubiquitation mutant (*Mus musculus*) | 726 | 733 |
| 24 | LDLR_L340D, K818R, K832R, C841A | low density lipoprotein receptor/PCSK9/ ubiquitation mutant (*Mus musculus*) | 727 | |
| 25 | LDLR_K832R, C841A | low density lipoprotein receptor/PCSK9/ ubiquitation mutant (*Mus musculus*) | 728 | |
| 26 | LDLR_K818R, K832R, C841A | low density lipoprotein receptor/PCSK9/ ubiquitation mutant (*Mus musculus*) | 729 | |

The EGF-A domain for the LDLR mouse protein sequence is KTNECLDNNGGCSHICKDLKIGSECLCPSGFRLVDLHRCE (SEQ ID NO: 730) and the intracellular domain is RNWRLKNINSINFDNPVYQKTTEDELHICRSQDGYTYPSRQMVSLEDDVA (SEQ ID NO: 731).

Any of the polynucleotides described herein may encode the mouse LDLR constructs and may be used in experiments in vivo to evaluate the effect of the mutation on an animal.

Example 17. LDLR Mutant Constructs

According to the present invention, the polynucleotide may comprise at least a first region of linked nucleosides encoding human LDLR. The human LDLR protein sequences of the present invention are listed in Table 11 below. Shown in Table 11, are the name and description of the gene and the protein sequence identifier. For any particular gene there may exist one or more variants or isoforms. It will be appreciated by those of skill in the art that disclosed in the Table are potential flanking regions. The coding region is definitively and specifically disclosed by teaching the protein sequence. Consequently, the sequences taught flanking that encoding the protein are considered flanking regions. It is also possible to further characterize the 5' and 3' flanking regions by utilizing one or more available databases or algorithms. Databases have annotated the features contained in the flanking regions of the ENST transcripts and these are available in the art.

TABLE 11

Targets

| Target No | Gene | Description | Protein SEQ ID NO | mRNA SEQ ID NO |
|---|---|---|---|---|
| 15 | LDLR_N316A, K830R, C839A | low density lipoprotein receptor/PCSK9/ubiquitation mutant (*homo sapiens*) | 50 | 735 |
| 16 | LDLR_N316A, K816R, K830R, C839A | low density lipoprotein receptor/PCSK9/ubiquitation mutant (*homo sapiens*) | 51 | |
| 17 | LDLR_L339D, K830R, C839A | low density lipoprotein receptor/PCSK9/ubiquitation mutant (*homo sapiens*) | 52 | 736 |
| 18 | LDLR_L339D, K816R, K830R, C839A | low density lipoprotein receptor/PCSK9/ubiquitation mutant (*homo sapiens*) | 53 | |
| 19 | LDLR_K830R, C839A | low density lipoprotein receptor/PCSK9/ubiquitation mutant (*homo sapiens*) | 54 | 737 |
| 20 | LDLR_K816R, K830R, C839A | low density lipoprotein receptor/PCSK9/ubiquitation mutant (*homo sapiens*) | 55 | |

Example 18. In Vitro Studies of LDLR-IDOL Mutants

A. In Vitro Expression of LDLR-IDOL Mutants

HEK293 cells are transfected with mRNA encoding human or mouse LDLR mutants and compared to a control of human or mouse LDLR (wild type). The HEK293 cells are transfected for 12-14 hours with the mRNA encoding human or mouse LDLR using lipofectamine 2000 with increasing doses of mRNA (about 4 to 4000 ng of mRNA). Cells are harvested and stained with either a goat anti-hLDLR-PE or goat IgG-PE antibody and analyzed with a flow cytometer. LDLR expression is assessed as a percentage of LDLR positive cells for each dose and construct evaluated.

mRNA encoding human LDLR mutants for this study include the mutations N316A, K830R and C839A (amino acid sequence shown in SEQ ID NO: 50; mRNA sequence shown in SEQ ID NO: 735 where the polyA tail of approximately 140 nucleotides is not shown in the sequence, 5'Cap is Cap and the mRNA is fully modified with 5-methylcytosine and 1-methylpseudouridine), the mutations K830R, C839A and L339D (amino acid sequence shown in SEQ ID NO: 52; mRNA sequence shown in SEQ ID NO: 736 where the polyA tail of approximately 140 nucleotides is not shown in the sequence, 5'Cap is Cap and the mRNA is fully modified with 5-methylcytosine and 1-methylpseudouridine) or the mutations K830R and C839A (amino acid sequence shown in SEQ ID NO: 54; mRNA sequence shown in SEQ ID NO: 737 where the polyA tail of approximately 140 nucleotides is not shown in the sequence, 5'Cap is Cap and the mRNA is fully modified with 5-methylcytosine and 1-methylpseudouridine).

mRNA encoding mouse LDLR mutants for this study include the mutations N317A, K832R and C841A (amino acid sequence shown in SEQ ID NO: 724; mRNA sequence shown in SEQ ID NO: 732 where the polyA tail of approximately 140 nucleotides is not shown in the sequence, 5'Cap is Cap and the mRNA is fully modified with 5-methylcytosine and 1-methylpseudouridine), the mutations L340D, K832R and C841A (amino acid sequence shown in SEQ ID NO: 726; mRNA sequence shown in SEQ ID NO: 733 where the polyA tail of approximately 140 nucleotides is not shown in the sequence, 5'Cap is Cap and the mRNA is fully modified with 5-methylcytosine and 1-methylpseudouridine) or the mutations K832R and C841A (amino acid sequence shown in SEQ ID NO: 728; mRNA sequence shown in SEQ ID NO: 734 where the polyA tail of approximately 140 nucleotides is not shown in the sequence, 5'Cap is Cap and the mRNA is fully modified with 5-methylcytosine and 1-methylpseudouridine).

B. In Vitro LDL Binding to LDLR-IDOL Mutants

Following establishment of expression of LDLR-IDOL mutants, the in vitro bioactivity of these mRNA is assessed and compared to the bioactivity of the wild-type receptor in vitro. mRNA encoding LDLR-IDOL mutants are evaluated for ligand binding using a BODIPY-labelled LDL binding assay. HEK293 cells are transfected with mRNA encoding LDLR-IDOL mutants for 12-14 hours at a dose in the range of about 4 ng to about 4000 ng.

mRNA encoding human LDLR mutants for this study include the mutations N316A, K830R and C839A (amino acid sequence shown in SEQ ID NO: 50; mRNA sequence shown in SEQ ID NO: 735 where the polyA tail of approximately 140 nucleotides is not shown in the sequence, 5'Cap is Cap and the mRNA is fully modified with 5-methylcytosine and 1-methylpseudouridine), the mutations K830R, C839A and L339D (amino acid sequence shown in SEQ ID NO: 52; mRNA sequence shown in SEQ ID NO: 736 where the polyA tail of approximately 140 nucleotides is not shown in the sequence, 5'Cap is Cap and the mRNA is fully modified with 5-methylcytosine and 1-methylpseudouridine) or the mutations K830R and C839A (amino acid sequence shown in SEQ ID NO: 54; mRNA sequence shown in SEQ ID NO: 737 where the polyA tail of approximately 140 nucleotides is not shown in the sequence, 5'Cap is Cap and the mRNA is fully modified with 5-methylcytosine and 1-methylpseudouridine).

mRNA encoding mouse LDLR mutants for this study include the mutations N317A, K832R and C841A (amino acid sequence shown in SEQ ID NO: 724; mRNA sequence shown in SEQ ID NO: 732 where the polyA tail of approximately 140 nucleotides is not shown in the sequence, 5'Cap is Cap and the mRNA is fully modified with 5-methylcytosine and 1-methylpseudouridine), the mutations L340D, K832R and C841A (amino acid sequence shown in SEQ ID NO: 726; mRNA sequence shown in SEQ ID NO: 733 where the polyA tail of approximately 140 nucleotides is not shown in the sequence, 5'Cap is Cap and the mRNA is fully modified with 5-methylcytosine and 1-methylpseudouridine) or the mutations K832R and C841A (amino acid sequence shown in SEQ ID NO: 728; mRNA sequence shown in SEQ ID NO: 734 where the polyA tail of approximately 140 nucleotides is not shown in the sequence, 5'Cap is Cap and the mRNA is fully modified with 5-methylcytosine and 1-methylpseudouridine).

Cells are incubated with increasing concentration of fluorescently labeled LDLR ligand (LDL-BODIPY) (about 0.1 ug/ml to about 50 ug/ml) for one hour at 37 C. Cells are then harvested and analyzed with a flow cytometer.

C. PCSK9 Down-Modulation of LDLR Expression mRNA encoding the LDLR-IDOL mutants are evaluated for resistance to PCSK9 down-modulation.

HEK293 cells are transfected with mRNA encoding LDLR-IDOL mutants using Lipofectamine 2000 for 12-14 hours at a dose in the range of about 4 ng to about 4000 ng.

mRNA encoding human LDLR mutants for this study include the mutations N316A, K830R and C839A (amino acid sequence shown in SEQ ID NO: 50; mRNA sequence shown in SEQ ID NO: 735 where the polyA tail of approximately 140 nucleotides is not shown in the sequence, 5'Cap is Cap and the mRNA is fully modified with 5-methylcytosine and 1-methylpseudouridine), the mutations K830R, C839A and L339D (amino acid sequence shown in SEQ ID NO: 52; mRNA sequence shown in SEQ ID NO: 736 where the polyA tail of approximately 140 nucleotides is not shown in the sequence, 5'Cap is Cap and the mRNA is fully modified with 5-methylcytosine and 1-methylpseudouridine) or the mutations K830R and C839A (amino acid sequence shown in SEQ ID NO: 54; mRNA sequence shown in SEQ ID NO: 737 where the polyA tail of approximately 140 nucleotides is not shown in the sequence, 5'Cap is Cap and the mRNA is fully modified with 5-methylcytosine and 1-methylpseudouridine).

mRNA encoding mouse LDLR mutants for this study include the mutations N317A, K832R and C841A (amino acid sequence shown in SEQ ID NO: 724; mRNA sequence shown in SEQ ID NO: 732 where the polyA tail of approximately 140 nucleotides is not shown in the sequence, 5'Cap is Cap and the mRNA is fully modified with 5-methylcytosine and 1-methylpseudouridine), the mutations L340D, K832R and C841A (amino acid sequence shown in SEQ ID NO: 726; mRNA sequence shown in SEQ ID NO: 733 where the polyA tail of approximately 140 nucleotides is not shown in the sequence, 5'Cap is Cap and the mRNA is fully modified with 5-methylcytosine and 1-methylpseudouridine) or the mutations K832R and C841A (amino acid sequence shown in SEQ ID NO: 728; mRNA sequence shown in SEQ ID NO: 734 where the polyA tail of approximately 140 nucleotides is not shown in the sequence, 5'Cap is Cap and the mRNA is fully modified with 5-methylcytosine and 1-methylpseudouridine).

The cells are incubated with media with or without 75 µg/mL of PCSK9 over an eight hour time course. Cells are harvested and stained with goat anti-hLDLR-PE antibody. Cells are analyzed with a flow cytometer to evaluate PCSK9-mediated down modulation of LDLR.

Example 19. In Vivo Studies of LDLR-IDOL Mutants

The ability of mRNA encoding human or mouse LDLR-IDOL mutants is compared to human or mouse LDLR (wild-type) in vivo.

mRNA encoding LDLR-IDOL mutants is administered intravenously via tail vein injection to knockout (KO) LDLR mice. The mRNA is formulated in lipid nanoparticles and the mRNA is administered in dose range of 0.01 mg/kg to 5 mg/kg.

mRNA encoding human LDLR mutants for this study include the mutations N316A, K830R and C839A (amino acid sequence shown in SEQ ID NO: 50; mRNA sequence shown in SEQ ID NO: 735 where the polyA tail of approximately 140 nucleotides is not shown in the sequence, 5'Cap is Cap and the mRNA is fully modified with 5-methylcytosine and 1-methylpseudouridine), the mutations K830R, C839A and L339D (amino acid sequence shown in SEQ ID NO: 52; mRNA sequence shown in SEQ ID NO: 736 where the polyA tail of approximately 140 nucleotides is not shown in the sequence, 5'Cap is Cap and the mRNA is fully modified with 5-methylcytosine and 1-methylpseudouridine) or the mutations K830R and C839A (amino acid sequence shown in SEQ ID NO: 54; mRNA sequence shown in SEQ ID NO: 737 where the polyA tail of approximately 140 nucleotides is not shown in the sequence, 5'Cap is Cap and the mRNA is fully modified with 5-methylcytosine and 1-methylpseudouridine).

mRNA encoding mouse LDLR mutants for this study include the mutations N317A, K832R and C841A (amino acid sequence shown in SEQ ID NO: 724; mRNA sequence shown in SEQ ID NO: 732 where the polyA tail of approximately 140 nucleotides is not shown in the sequence, 5'Cap is Cap and the mRNA is fully modified with 5-methylcytosine and 1-methylpseudouridine), the mutations L340D, K832R and C841A (amino acid sequence shown in SEQ ID NO: 726; mRNA sequence shown in SEQ ID NO: 733 where the polyA tail of approximately 140 nucleotides is not shown in the sequence, 5'Cap is Cap and the mRNA is fully modified with 5-methylcytosine and 1-methylpseudouridine) or the mutations K832R and C841A (amino acid sequence shown in SEQ ID NO: 728; mRNA sequence shown in SEQ ID NO: 734 where the polyA tail of approximately 140 nucleotides is not shown in the sequence, 5'Cap is Cap and the mRNA is fully modified with 5-methylcytosine and 1-methylpseudouridine).

Mouse livers are harvested between 30 minutes post mRNA administration and 96 hours mRNA post-administration. The livers are processed for mRNA expression (qPCR) and/or and protein expression (western blot).

Example 20. Expression of Wild-Type LDLR and PCSK9 Binding-Deficient Mutants

Human embryonic kidney epithelial (HEK293) cells (LGC standards GmbH, Wesel, Germany) are seeded on 48-well plates (BD Biosciences, San Jose, USA). HEK293 are seeded at a density of about 60,000 cells per well in 0.2 mL cell culture medium. Formulations containing 1 uL lipofectamine and 150 ng of wild type (WT) LDLR mRNA (mRNA sequence shown in SEQ ID NO: 738; polyA tail of approximately 160 nucleotides not shown in sequence; 5'cap, Cap 1; fully modified with 5-methylcytosine and 1-methylpseudouridine) or 150 ng of a mutant LDLR sequence mRNA or a control of G-CSF mRNA (mRNA shown in SEQ ID NO: 739; fully modified with 5-methylcytosine and pseudouridine; 5'cap, cap1; polyA tail of approximately 160 nucleotides not shown in sequence) are added directly after seeding the cells at quantities of 60,000 per well and incubated.

The mutant LDLR mRNA sequences prepared and tested include: a four amino acid substitutional variant (4A: N316A, E317A, D331A, and Y336A) (mRNA sequence shown in SEQ ID NO: 69; polyA tail of approximately 160 nucleotides not shown in sequence; 5'cap, Cap1; fully modified with 5-methylcytosine and 1-methylpseudouridine), or the following single amino acid substitution variants Y336A (mRNA sequence shown in SEQ ID NO: 68; polyA tail of approximately 160 nucleotides not shown in sequence; 5'cap, Cap1; fully modified with 5-methylcytosine and 1-methylpseudouridine), E317A (mRNA sequence shown in SEQ ID NO: 67; polyA tail of approximately 160 nucleotides not shown in sequence; 5'cap, Cap1; fully modified with 5-methylcytosine and 1-methylpseudouridine), N316A (mRNA sequence shown in SEQ ID NO: 66; polyA tail of approximately 160 nucleotides not shown in sequence; 5' cap, Cap1; fully modified with 5-methylcytosine and 1-methylpseudouridine), L339D (mRNA sequence shown in SEQ ID NO: 65; polyA tail of approximately 160 nucleotides not shown in sequence; 5'cap, Cap1; fully modified with 5-methylcytosine and 1-methylpseudouridine), D33 1E (mRNA sequence shown in SEQ ID NO: 64; polyA tail of approximately 160 nucleotides not shown in sequence; 5'cap, Cap1; fully modified with 5-methylcytosine and 1-methylpseudouridine).

As controls G-CSF mRNA transfected cells were treated with anti-LDLR antibody (R&D Systems, Minneapolis, Minn.; Human LDL R Affinity Purified Polyclonal AbAF2148) and one set of LDLR transfected cells were treated with normal goat IgG (R&D Systems, Minneapolis, Minn.; Purified goat IgG R&D Systems catalog number AC-108-C). Bound primary antibodies were detected by FACS analysis following treatment with a Phycoerythrin (PE)-labeled antibody (R&D Systems, Minneapolis, Minn.). Conjugation to PE was completed with the Innova biosciences lightning-link conjugation kit (Lightning-Link R-PE Antibody Labeling Kit Novus Biologicals catalog number: 703-0010).

Figure 16:
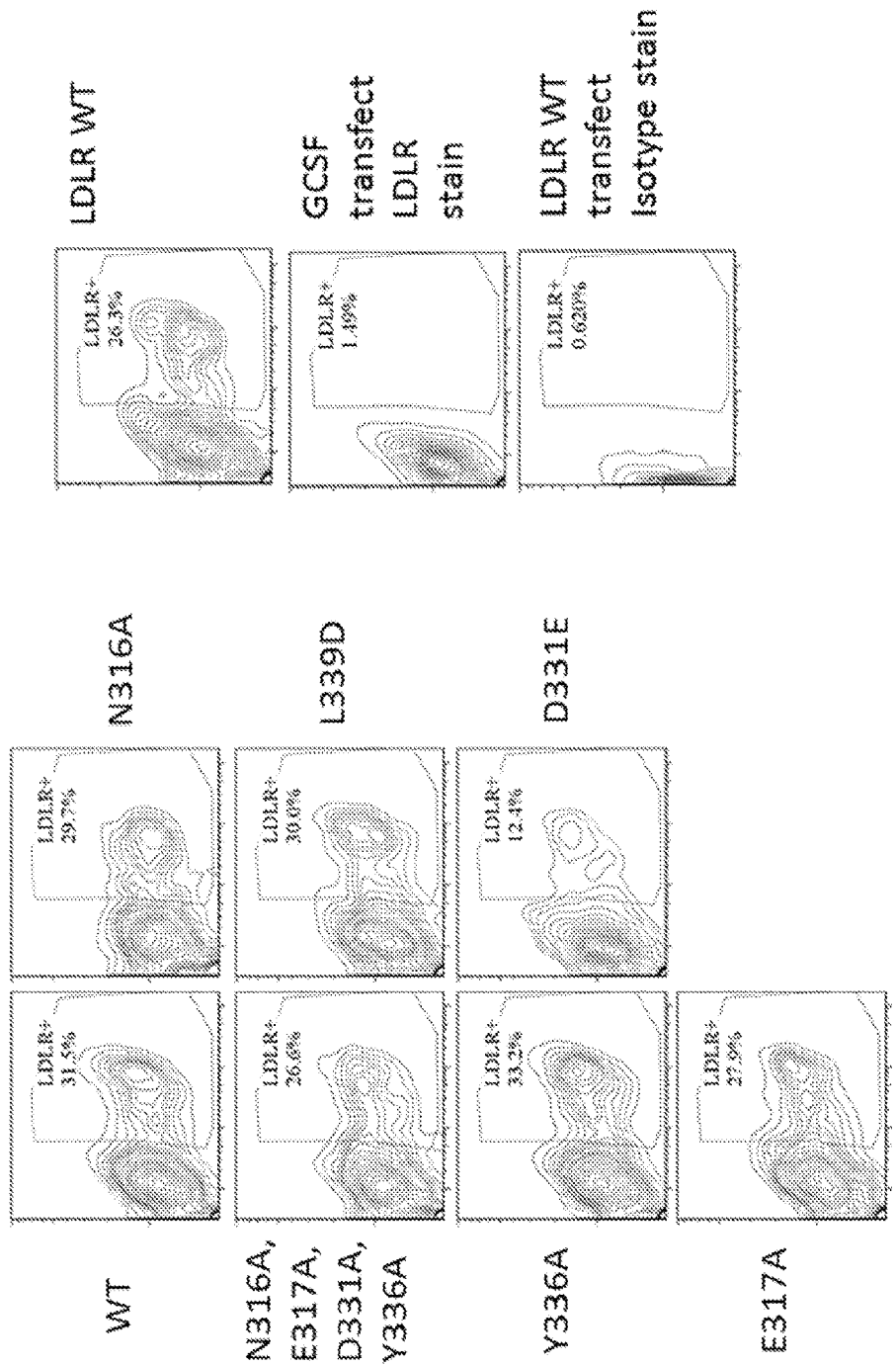
FIG. 16 is a flow cytometry plot of HEK293 cells transfected with various polynucleotides of the invention encoding LDLRs (wild type LDLR or LDLRs having various LDLR cell surface expression-enhancing mutations).

As shown in FIG. 16, the FACS analysis shows 32% of all gated live cells were detected to express LDLR at the 150 ng dose of wild type LDLR mRNA (WT in FIG. 16). Similarly, for cells transfected with the LDLR mRNA mutants, between 12-33% of all gated live cells were detected to express LDLR at the 150 ng dose. No staining was observed in LDLR mRNA treated cells stained with the control non-immune IgG (LDLR WT transfect Isotype stain) and no LDLR positive cells were detected in cells transfected with G-CSF mRNA (GCSF transfect LDLR stain).

Example 21. Down-Modulation of LDLR by Exogenous PCSK9

Human embryonic kidney epithelial (HEK293) cells (LGC standards GmbH, Wesel, Germany) are seeded on 48-well plates (BD Biosciences, San Jose, USA). HEK293 are seeded at a density of about 60,000 cells per well in 0.2 mL cell culture medium. Formulations containing 1 uL of lipofectamine 2000 and 150 ng of wild type (WT) LDLR mRNA (mRNA sequence shown in SEQ ID NO: 738; polyA tail of approximately 160 nucleotides not shown in sequence; 5'cap, Cap1; fully modified with 5-methylcytosine and 1-methylpseudouridine) or 150 ng of an LDLR sequence mutant mRNA or 150 ng of a control of G-CSF mRNA (mRNA shown in SEQ ID NO: 739; fully modified with 5-methylcytosine and pseudouridine; 5'cap, cap1; polyA tail of approximately 160 nucleotides not shown in sequence) are added directly after seeding the cells at quantities of 800 ng per well and incubated in the presence and in the absence of exogenous human PCSK9 at 60 μg/mL.

The LDLR mRNA sequence mutants prepared and tested include: a four amino acid substitution variant (4A: N316A, E317A, D331A, and Y336A) (mRNA sequence shown in SEQ ID NO: 69; polyA tail of approximately 160 nucleotides not shown in sequence; 5'cap, Cap1; fully modified with 5-methylcytosine and 1-methylpseudouridine), or the following single amino acid substitution variants Y336A (mRNA sequence shown in SEQ ID NO: 68; polyA tail of approximately 160 nucleotides not shown in sequence; 5'cap, Cap1; fully modified with 5-methylcytosine and 1-methylpseudouridine), E317A (mRNA sequence shown in SEQ ID NO: 67; polyA tail of approximately 160 nucleotides not shown in sequence; 5'cap, Cap1; fully modified with 5-methylcytosine and 1-methylpseudouridine), N316A (mRNA sequence shown in SEQ ID NO: 66; polyA tail of approximately 160 nucleotides not shown in sequence; 5' cap, Cap1; fully modified with 5-methylcytosine and 1-methylpseudouridine), L339D (mRNA sequence shown in SEQ ID NO: 65; polyA tail of approximately 160 nucleotides not shown in sequence; 5'cap, Cap1; fully modified with 5-methylcytosine and 1-methylpseudouridine), D33 1E (mRNA sequence shown in SEQ ID NO: 64; polyA tail of approximately 160 nucleotides not shown in sequence; 5'cap, Cap1; fully modified with 5-methylcytosine and 1-methylpseudouridine).

After fifteen hours at 37° C., the transfection media were removed, the cells were washed, and were treated with anti-LDLR antibody conjugated to Phycoerythrin (PE) (R&D Systems, Minneapolis, Minn.; Human LDL R Affinity Purified Polyclonal AbAF2148) as described above. One set of LDLR transfected cells were treated with normal goat IgG conjugated to PE (R&D Systems, Minneapolis, Minn.; Purified goat IgG R&D Systems catalog number AC-108-C) and another set of untransfected cells were used as controls. Cells transfected with G-CSF modified mRNA were used as an additional negative control. Conjugation to PE was completed with the Innova biosciences lightning-link conjugation kit (Lightning-Link R-PE Antibody Labeling Kit Novus Biologicals catalog number: 703-0010). Bound primary antibodies were detected by flow cytometry as described above.

Figure 17:
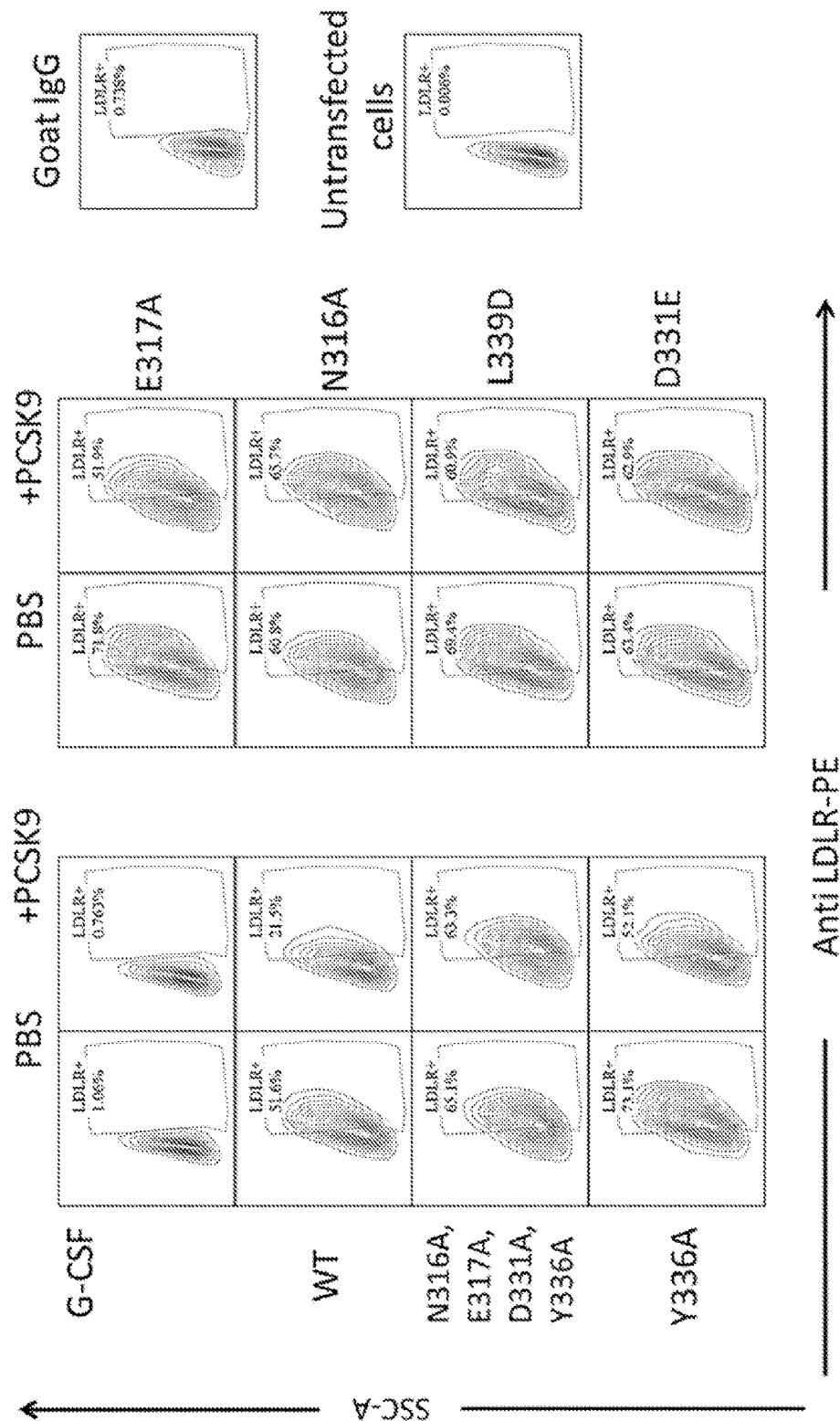
FIG. 17 is a flow cytometry plot HEK293 cells transfected with various polynucleotides of the invention encoding LDLRs (wild type LDLR or LDLRs having various LDLR cell surface expression-enhancing mutations) with or without PCSK9.

As shown in FIG. 17, the FACS analysis showed that cell surface LDLR expression in cells transfected with wild-type LDLR mRNA was 51.6% of gated live cells. This value decreased to 21.5% of gated live cells when exogenous PCSK9 was added to the media during cell transfection. In contrast, each of the LDLR mRNA mutants with substitutions in the PCSK9 binding domain showed less sensitivity to down-modulation by exogenous PCSK9 (Table 12) with values of percent reduction ranging from −8.1% to 29% (compared to 58% reduction observed with wild-type LDLR).

TABLE 12

Down-Modulation of Cell Surface LDLR Expression by Exogenous PCSK9

| | % of Cells LDLR Positive | | Percent Reduction in |
|---|---|---|---|
| LDLR mRNA | PCSK9 Absent | PCSK9 Present | LDLR Expression (%) |
| WT | 51.6 | 21.5 | 58.3 |
| N316A, E317A, D331A, Y336A | 65.1 | 63.3 | 2.8 |
| Y336A | 73.1 | 52.1 | 28.7 |
| E317A | 71.8 | 51.9 | 27.7 |
| N316A | 60.8 | 65.7 | −8.1 |
| L339D | 69.4 | 60.9 | 12.2 |
| D331E | 69.4 | 60.9 | 0.8 |
| G-CSF negative control | 1.06 | 0.76 | NA |

Example 22. Functionality of LDLR Expressed by Mutant LDLR mRNA

To evaluate whether the expressed LDLR were functional, BODIPY-labeled LDL was used. 60,000 HEK293 cells per well were transfected overnight with formulations containing 1 uL lipofectamine 2000 and 150 ng encoding wild type (WT) LDLR mRNA (mRNA sequence shown in SEQ ID NO: 738; polyA tail of approximately 160 nucleotides not shown in sequence; 5' cap, Cap1; fully modified with 5-methylcytosine and 1-methylpseudouridine) or 150 ng of an LDLR mutant mRNA or 150 of a control of G-CSF mRNA (mRNA shown in SEQ ID NO: 739; fully modified with 5-methylcytosine and pseudouridine; 5'cap, cap1; polyA tail of approximately 160 nucleotides not shown in sequence).

The LDLR mutant mRNA sequences prepared and tested include: a four amino acid substitution variant (4A: N316A, E317A, D331A, and Y336A) (mRNA sequence shown in SEQ ID NO: 69; polyA tail of approximately 160 nucleotides not shown in sequence; 5'cap, Cap1; fully modified with 5-methylcytosine and 1-methylpseudouridine), or the following single amino acid substitution variants Y336A (mRNA sequence shown in SEQ ID NO: 68; polyA tail of approximately 160 nucleotides not shown in sequence; 5'cap, Cap1; fully modified with 5-methylcytosine and 1-methylpseudouridine), E317A (mRNA sequence shown in SEQ ID NO: 67; polyA tail of approximately 160 nucleotides not shown in sequence; 5' cap, Cap1; fully modified with 5-methylcytosine and 1-methylpseudouridine), N316A (mRNA sequence shown in SEQ ID NO: 66; polyA tail of approximately 160 nucleotides not shown in sequence; 5'cap, Cap1; fully modified with 5-methylcytosine and 1-methylpseudouridine), L339D (mRNA sequence shown in SEQ ID NO: 65; polyA tail of approximately 160 nucleotides not shown in sequence; 5'cap, Cap1; fully modified with 5-methylcytosine and 1-methylpseudouridine), D33 1E (mRNA sequence shown in SEQ ID NO: 64; polyA tail of approximately 160 nucleotides not shown in sequence; 5'cap, Cap1; fully modified with 5-methylcytosine and 1-methylpseudouridine).

Figure 18A:
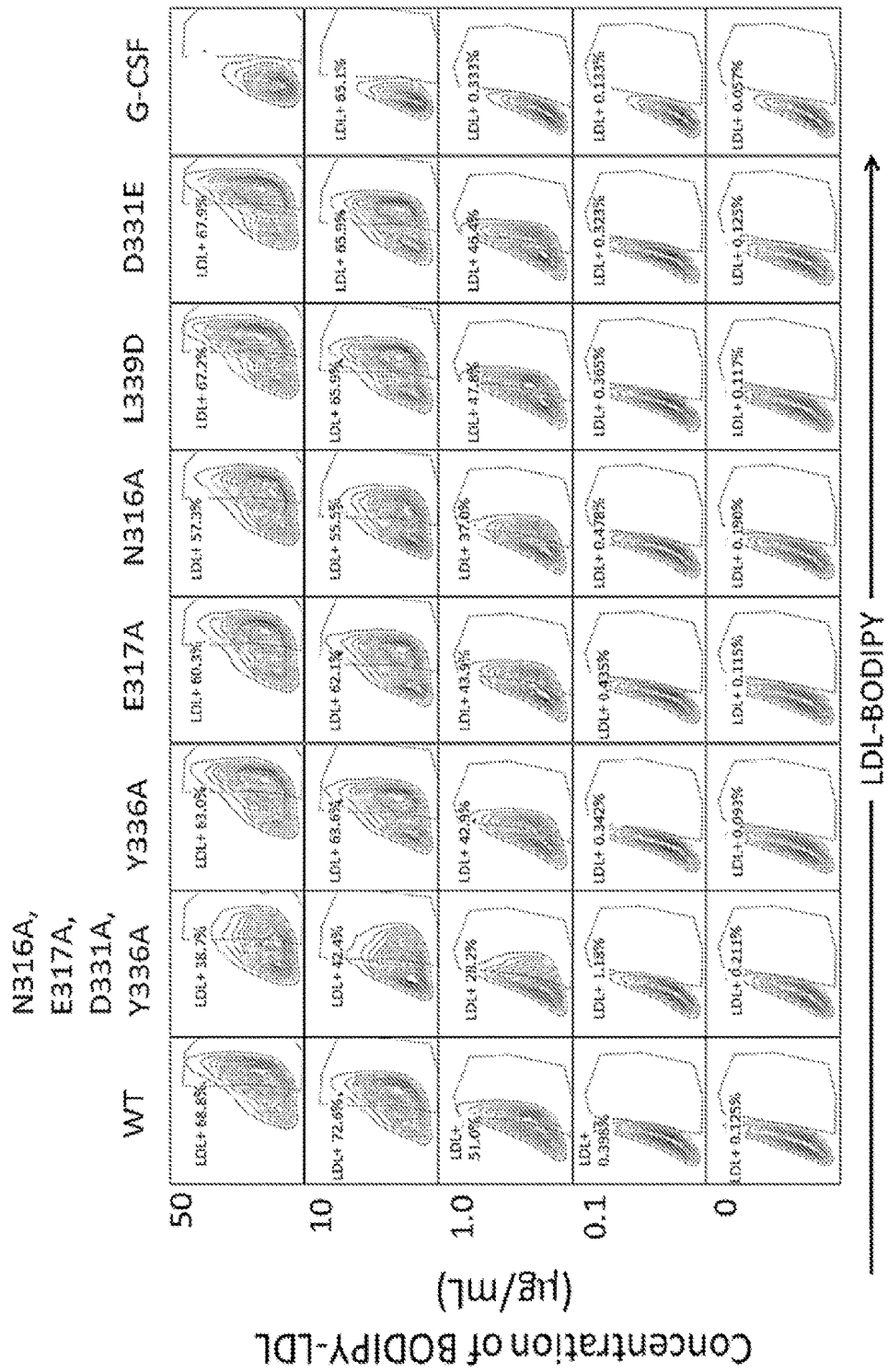
FIGS. 18A-18B are flow cytometry plots of cells transfected with various polynucleotides of the invention encoding LDLR, e.g., modified mRNAs encoding LDLRs having various LDLR cell surface expression-enhancing mutations.
Figure 18B:
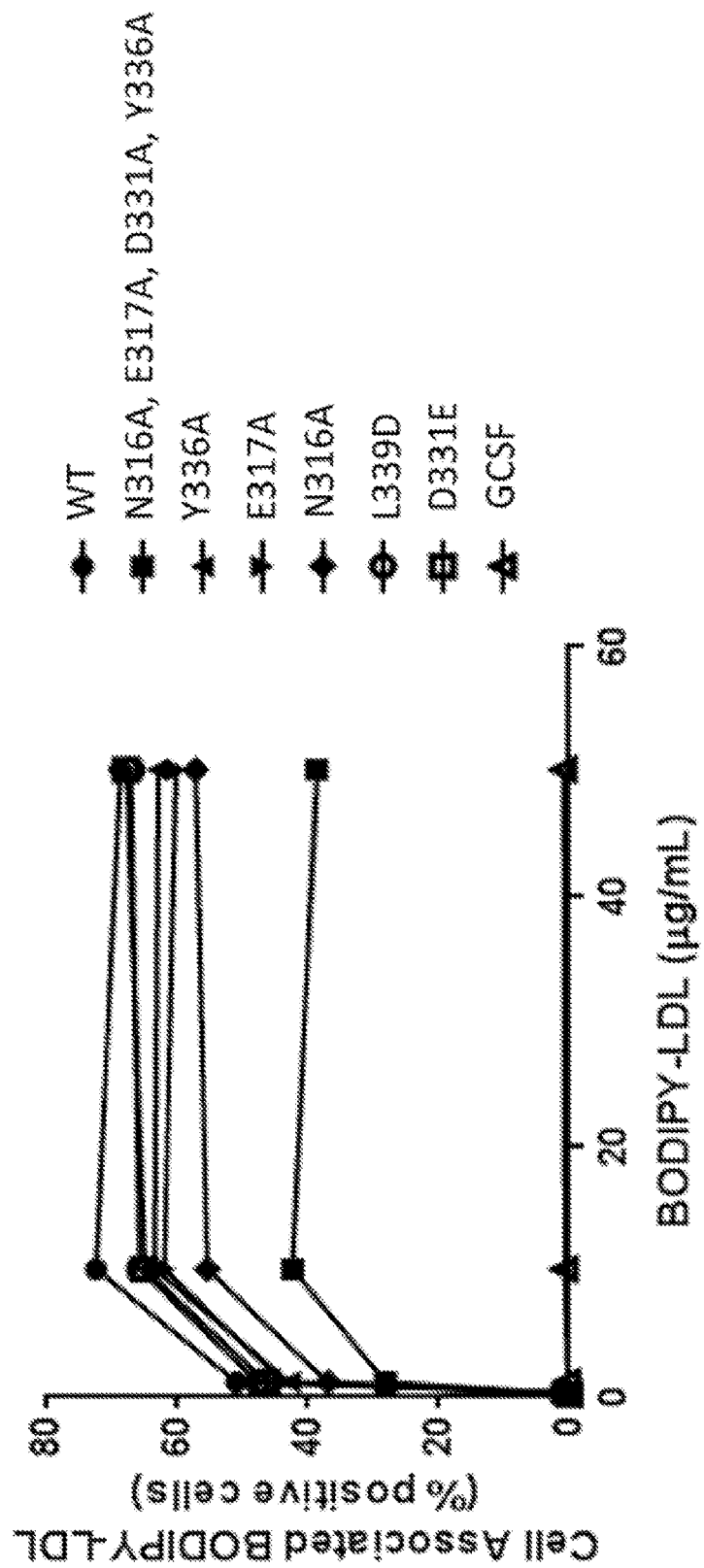

The cells were washed and incubated with increasing amounts (0 ug/ml, 0.1 ug/ml, 1.0 ug/ml, 10 ug/ml or 50 ug/ml) of BODIPY-LDL. Following incubation for 1 hour at 37° C., the cells were washed and the cell associated BODIPY-LDL was assessed by flow cytometry. The contour plots are shown in FIG. 18A. For wild-type (WT) and LDLR PCSK9 binding variants, the binding of BODIPY-LDL to LDLR mRNA transfected cells was evident as a right-ward shift in the gated cell population that increased with BODIPY-LDL concentration. A similar rightward shift in the gated cell population was seen for cells transfected with each of the LDLR mRNA constructs. As is shown in FIG. 18B, half-maximal cell association was the same for BODIPY-LDL binding to cells transfected with either wild type or the PCSK9 binding-deficient LDLR mRNAs. For each construct, BODIPY-LDL binding was of high affinity (half-maximal binding between 0.6-0.7 ng/mL) and saturable. No BODIPY-LDL binding was observed for cells transfected with G-CSF mRNA.

Example 23. Evaluate of Half-Life on Cell Surface LDLR

Figure 19C:
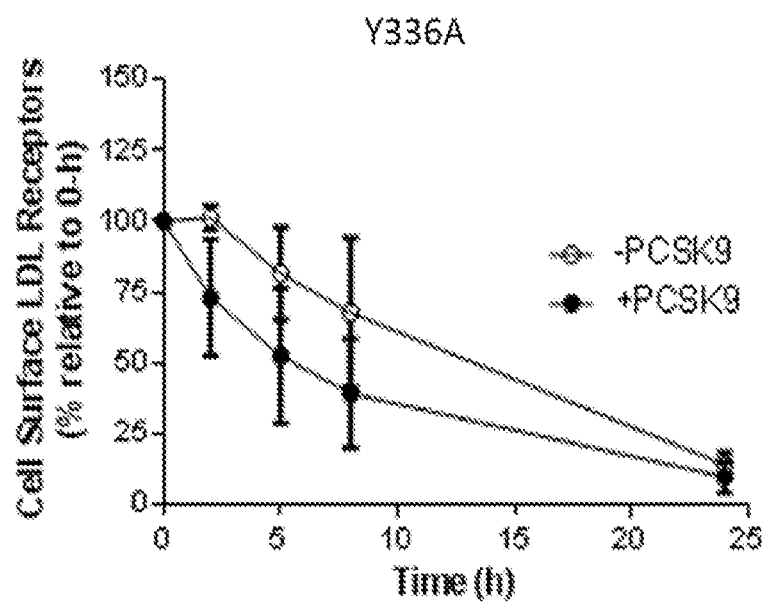
Figure 19D:
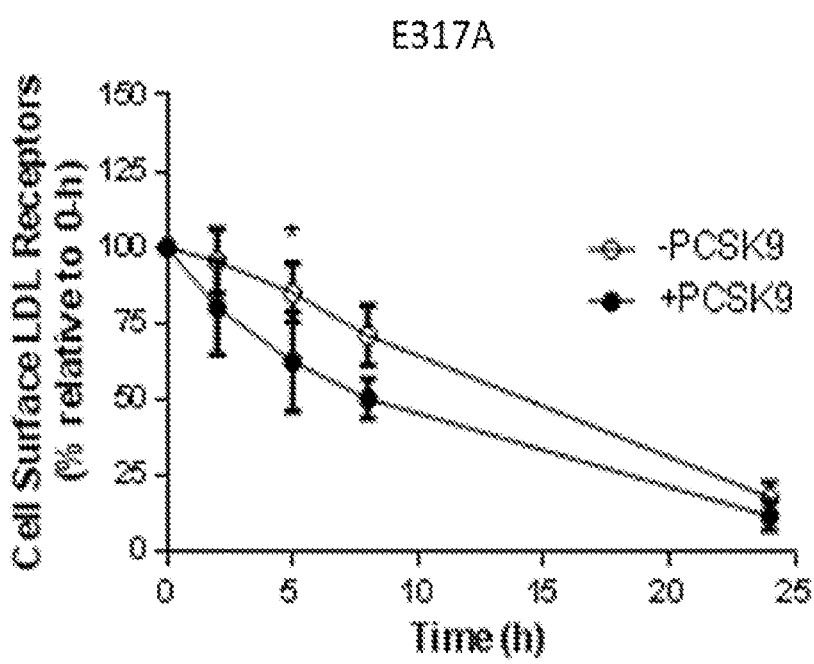
Figure 19E:
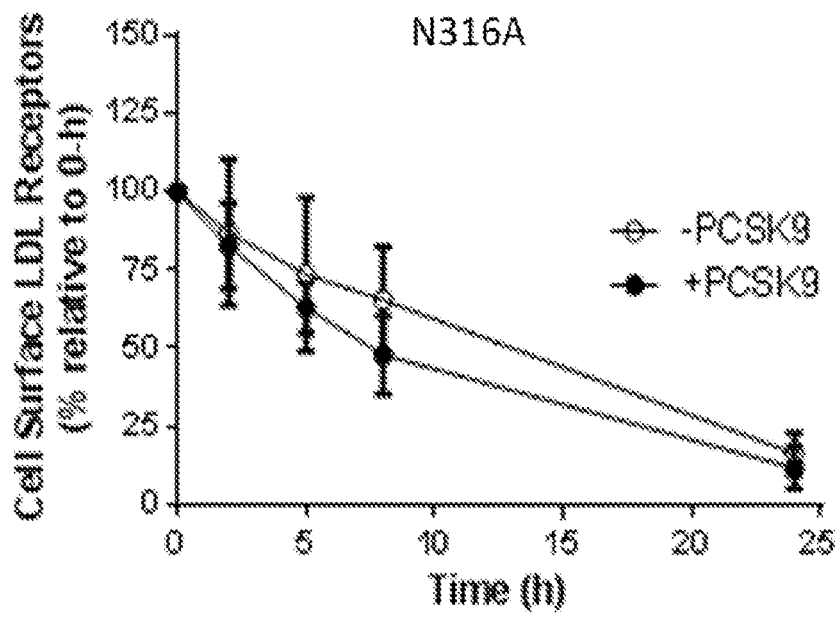
Figure 19F:
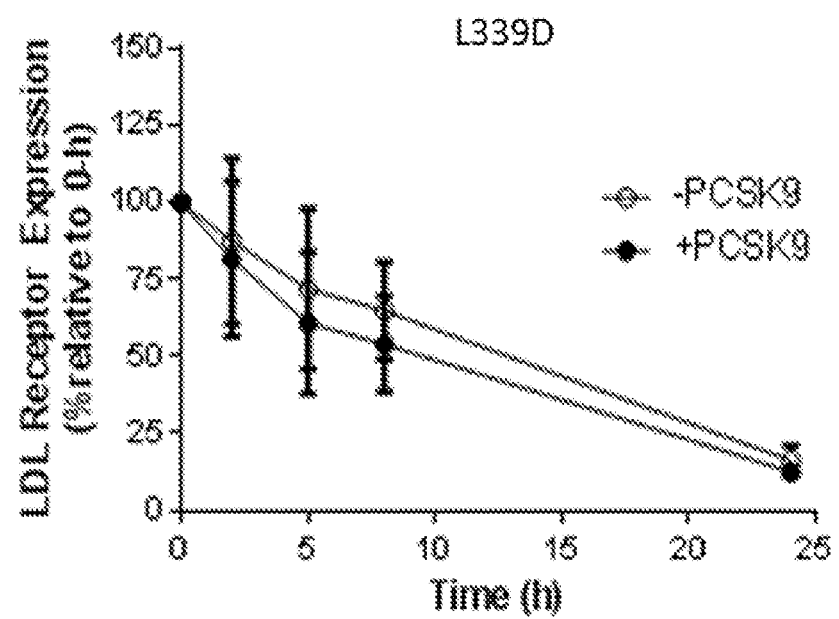
Figure 19G:
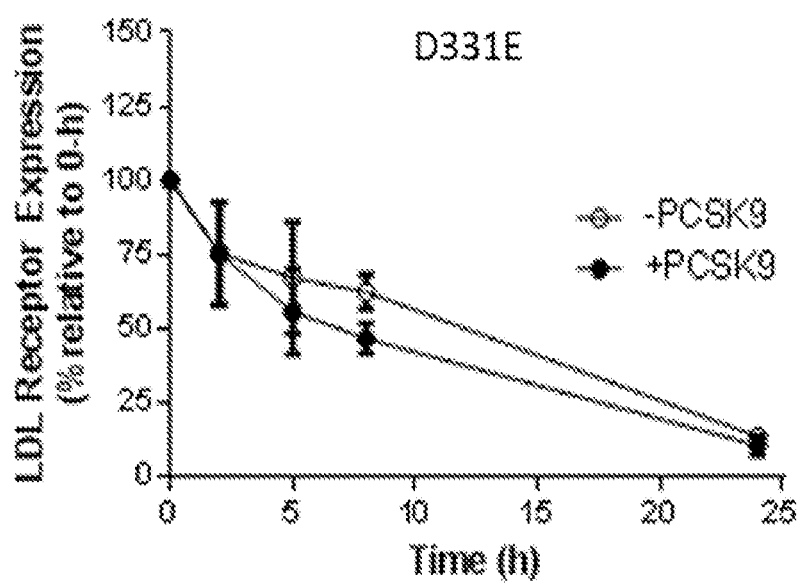

To assess whether exogenous PCSK9 can modulate the apparent half-life of cell surface LDL receptors in cells transfected with LDLR mRNA, HEK293 cells were plated on 24 well plates, 130,000 cells per well, transfected with LDLR mRNA and incubated for 14 hours as described above. The cell monolayers were washed and fresh media with PCSK9 (60 µg/mL) or without PCSK9 was added. After various times of incubation at 37° C., cell surface LDLR expression was monitored by flow cytometry using anti-LDLR antibodies as described above. As is shown in FIG. 19A, cell surface LDLR in cells transfected with 300 ng of wild-type LDLR mRNA (mRNA sequence shown in SEQ ID NO: 738; polyA tail of approximately 160 nucleotides not shown in sequence; 5'cap, Cap1; fully modified with 5-methylcytosine and 1-methylpseudouridine) decreased in a time-dependent manner with an apparent half-life of approximately 13 hours. The addition of PCSK9 to the media of cells transfected with wild-type LDLR mRNA decreased the apparent half-life of cell surface LDLR to about 4 hours. In FIG. 19A, "*" represents a significant difference by statistical test.

In contrast, the addition of PCSK9 to the media of cells transfected with 300 ng of PCSK9 binding-deficient LDLR mRNA produced little or no change in the apparent half-life of cell surface LDLR (FIGS. 19B-19G). The PCSK9 binding-deficient LDLR mRNA sequences (mutant LDLR mRNA) prepared and tested include: a four amino acid substitution variant (4A: N316A, E317A, D331A, and Y336A) (mRNA sequence shown in SEQ ID NO: 69; polyA tail of approximately 160 nucleotides not shown in sequence; 5'cap, Cap1; fully modified with 5-methylcytosine and 1-methylpseudouridine), or the following single amino acid substitution variants Y336A (mRNA sequence shown in SEQ ID NO: 68; polyA tail of approximately 160 nucleotides not shown in sequence; 5'cap, Cap1; fully modified with 5-methylcytosine and 1-methylpseudouridine), E317A (mRNA sequence shown in SEQ ID NO: 67; polyA tail of approximately 160 nucleotides not shown in sequence; 5' cap, Cap1; fully modified with 5-methylcytosine and 1-methylpseudouridine), N316A (mRNA sequence shown in SEQ ID NO: 66; polyA tail of approximately 160 nucleotides not shown in sequence; 5'cap, Cap1; fully modified with 5-methylcytosine and 1-methylpseudouridine), L339D (mRNA sequence shown in SEQ ID NO: 65; polyA tail of approximately 160 nucleotides not shown in sequence; 5'cap, Cap1; fully modified with 5-methylcytosine and 1-methylpseudouridine), D33 1E (mRNA sequence shown in SEQ ID NO: 64; polyA tail of approximately 160 nucleotides not shown in sequence; 5'cap, Cap1; fully modified with 5-methylcytosine and 1-methylpseudouridine).

These data in FIGS. 19B-19G show that cells transfected with LDLR mRNA encoding LDLR with variants in the PCSK9 binding site fail to respond to exogenous PCSK9, suggesting that these binding mutants may have a longer half-life than wild-type LDLR in vivo and be useful for treating patients with hypercholesterolemia.

Example 24. Effect of Increasing PCSK9 Amount on Cell Surface LDLR

To evaluate the down-modulation of cell surface LDLR expression by increasing amounts of PCSK9 added to the complete cell media, MEM (GlutaMAX, Life Science Catalog#41090-036) supplemented with 10% fetal bovine serum. HEK293 cells were plated at 300,000 cells per well, incubated for 6 hours, and transfected for 15 hours with 300 ng of either wild-type LDLR mRNA (mRNA sequence shown in SEQ ID NO: 738; polyA tail of approximately 160 nucleotides not shown in sequence; 5' cap, Cap1; fully modified with 5-methylcytosine and 1-methylpseudouridine) or an LDLR mRNA encoding a PCSK9 binding mutant. The PCSK9 binding mutant mRNA sequences prepared and tested include the single amino acid substitution variants of N316A (mRNA sequence shown in SEQ ID NO: 66; polyA tail of approximately 160 nucleotides not shown in sequence; 5'cap, Cap1; fully modified with 5-methylcytosine and 1-methylpseudouridine), and D33 1E (mRNA sequence shown in SEQ ID NO: 64; polyA tail of approximately 160 nucleotides not shown in sequence; 5' cap, Cap1; fully modified with 5-methylcytosine and 1-methylpseudouridine). A control of mRNA encoding UGT1A1 (mRNA sequence shown in SEQ ID NO: 740; polyA tail of approximately 160 nucleotides not shown in sequence; 5'cap, Cap1; fully modified with 5-methylcyostine and 1-methylpseudouridine) was also used.

Figure 20:
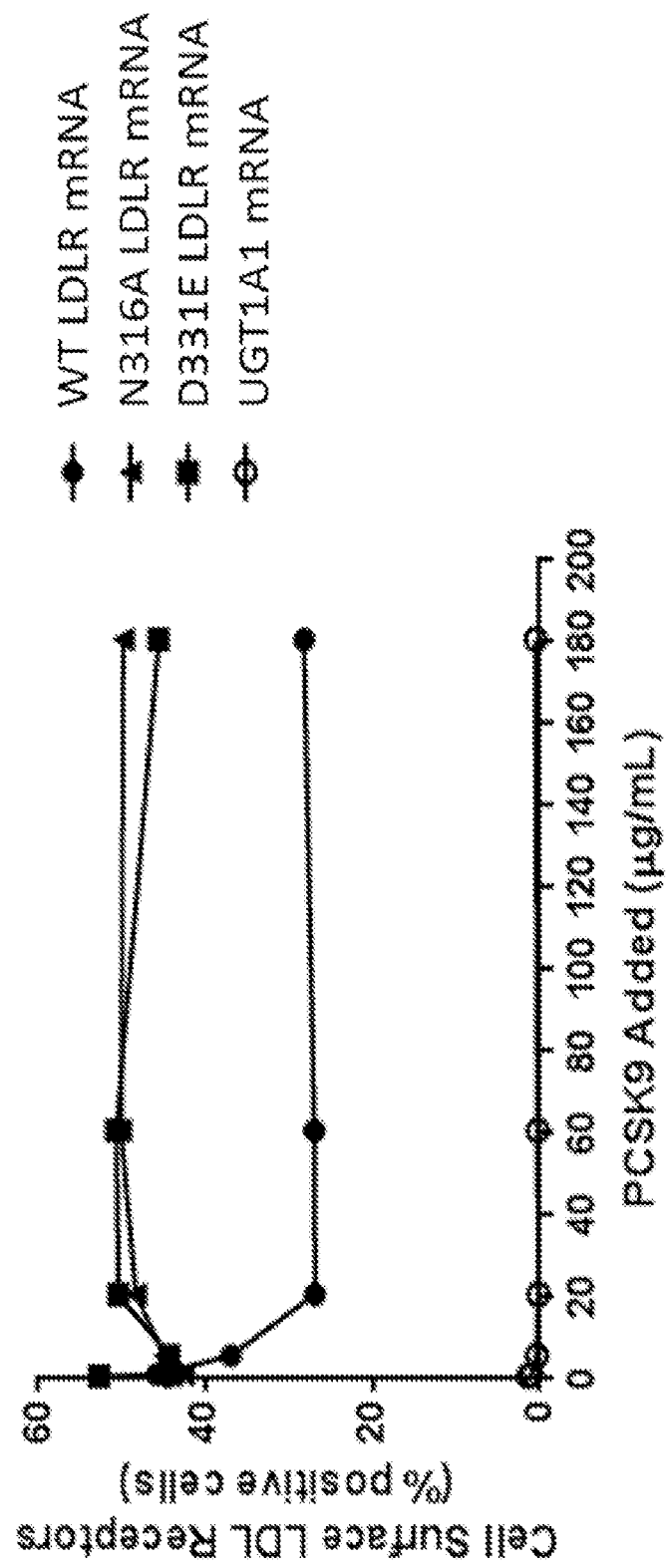
FIG. 20 shows the effect on cell surface LDLR expression when the amount of PCSK9 is varied.

After 15 hours of incubation, the cell monolayers were washed and either buffer alone or buffer containing increasing amounts of PCSK9 were added. Cells were incubated for 5 hours and cell surface LDLR expression was measured by flow cytometry as described above. As is shown in FIG. 20, cell surface LDL receptors in cells transfected with wild-type LDLR mRNA were decreased in a dose-dependent manner by PCSK9. Maximal reduction in LDLR was achieved at 20 µg/mL of exogenous PCSK9. In contrast, PCSK9 had no effect on cell surface LDLR in cells transfected with LDLR mRNA encoding the PCSK9 binding-deficient variants N316A or D331E. No cell surface LDLR was detected in HEK293 cells transfected with mRNA encoding UGT1A1. These data show that LDLR expressed from LDLR mRNAs encoding variants in the binding site for PCSK9 are insensitive to exogenous PCSK9.

Example 25. Liver Cell Transducing Formulations of LDLR

Lipid nanoparticles (LNPs) are formulated using methods known in the art, described herein and/or described in International Patent Publication No. WO2013090648 entitled "Modified Nucleoside, Nucleotide, and Nucleic Acid Composition," herein incorporated by reference in its entirety. The LNPs used herein can comprise the ionizable lipid DLin-KC2-DMA or the cationic lipid C12-200.

Modified mRNA encoding LDLR or LDLR mutants (e.g., SEQ ID NOs: 63-69; polyA tail of at least 140 nucleotides not shown in sequence; 5' cap, Cap1; modified with at least one chemical modification described herein) is formulated in LNPs comprising DLin-KC2-DMA or C12-200. The formulated LDLR or LDLR mutants are administered to wild type mice and LDLR deficient mice. The expression of LDLR in the liver cells of the wild type and LDLR deficient mice is measured, using methods known in the art or described herein, at predetermined intervals after administration of the modified mRNA.

Example 26. Delivery of LNP Formulated Modified mRNA

Luciferase mRNA (mRNA sequence shown in SEQ ID NO: 741; polyA tail of at least 140 nucleotides not shown in sequence; 5'cap, Cap1) is fully modified with either 5-methylcytosine and pseudouridine, fully modified with 5-methylcytosine and 1-methylpseudouridine, fully modified with pseudouridine, fully modified with 1-methylpseudouridine or 25% of the uridine residues are modified with 2-thiouridine and 25% of the cytosine residues are modified with 5-methylcytosine. The luciferase mRNA is then formulated in a lipid nanoparticle comprising the cationic lipid DLin-KC2-DMA (KC2) or C12-200. The formulated LNP in PBS or a control of PBS alone is administered intraveneously to LDLR −/− or normal mice as outlined in Table 13. The mice are imaged at 2 hours, 8 hours, 24 hours and 48 hours after injection. Ten minutes prior to imaging, mice are injected intraperitoneally with a D-luciferin solution at 150 mg/kg. Animals are then anesthetized and images are acquired with an IVIS Lumina II imaging system (Perkin Elmer).

TABLE 13

Dosing Regimen

| Group | Mouse Strain | Cationic Lipid | Dose (mg/kg) | mRNA dose/mouse (mg) | Injection Volume (mL) |
|---|---|---|---|---|---|
| 1 | LDLR−/− | KC2 | 0.5 | 0.01 | 0.1 |
| 2 | LDLR−/− | KC2 | 0.05 | 0.001 | 0.1 |
| 3 | Normal | KC2 | 0.5 | 0.01 | 0.1 |
| 4 | Normal | KC2 | 0.05 | 0.001 | 0.1 |
| 5 | LDLR−/− | C12-200 | 0.5 | 0.01 | 0.1 |
| 6 | LDLR−/− | C12-200 | 0.05 | 0.001 | 0.1 |
| 7 | Normal | C12-200 | 0.5 | 0.01 | 0.1 |
| 8 | Normal | C12-200 | 0.05 | 0.001 | 0.1 |
| 9 | LDLR−/− | none | none | none | 0.1 |

Example 27. Mouse Model for In Vivo Studies of LDLR

A mouse model (LDLR −/− mouse) was developed from a C57BL/6 background strain using a neo cassette inserted into exon 4 of the LDLR receptor gene. The mouse model has an elevated serum cholesterol level of 200-400 mg/dl (80-100 mg/dl is considered a normal level) and rises to greater than 200 mg/dl when fed a high fat diet.

Example 28. In Vivo Studies of LDLR 1.1 mg/kg of human LDLR mRNA (SEQ ID NO: 63; polyA tail of approximately 140 nucleotides not shown in sequence; 5' cap, Cap 1; fully modified with 5-methylcytosine and 1-methylpseudouridine) or luciferase (SEQ ID NO: 741; polyA tail of approximately 140 nucleotides not shown in sequence; 5' cap, Cap1; fully modified with 5-methylcytosine and 1-methylpseudouridine) was formulated in a lipid nanoparticle comprising C12-200 (molar ratio 40%), Cholesterol (molar ratio 25%), PEG lipid (molar ratio 5%) and DSPC (molar ratio 30%). The mean size of the lipid nanoparticle was 105 nm, a PDI of 0.15, zeta at pH 7.4 was 0.7 mV, the encapsulation efficiency (RiboGreen) was 55% and the total lipid to modified mRNA mass ratio was 20:1. The formulated mRNA was administered intravenously in 100 uL. 1.4 ng/ml of recombinant human LDLR was used as a control. Livers were harvested at 6 hours and 24 hours after administration and microsomal preparations were made and analyzed using Licor Western Blot and CE assay. For CE assay the concentrations were normalized to Calnexin loading controls. LDLR expression was seen at 6 hours and 24 hours post-administration.

Example 29. In Vivo Studies of LDLR Variants

A. Mouse LDLR mRNA encoding mouse LDLR double mutant (PCSK9 and IDOL variants), mRNA encoding a mouse LDLR PCSK9 mutant, mRNA encoding a mouse LDLR IDOL mutant and mRNA encoding mouse wild type LDLR are formulated and administered to LDLR −/− mice. Samples are collected 2, 4, 5, 6, 8 and/or 24 hours post-administration and are evaluated using a method known in the art (e.g., CE assay or Western Blot) for expression.

To determine the effects of multiple administrations, the mRNA of the most promising LDLR mutant construct is administered to the mice repeatedly (e.g., 3 consecutive doses). 2, 4, 5, 6, 8 and/or 24 hours post-administration samples are collected and evaluated using a method known in the art (e.g., CE assay or Western Blot) for expression.

To determine the effects of multiple administration and double mutants, mRNA encoding a mouse LDLR double variant (N317A and K832R) is administered to the mice repeatedly (e.g., 3 consecutive doses). 2, 4, 5, 6, 8 and/or 24 hours post-administration samples are collected and evaluated using a method known in the art (e.g., CE assay or Western Blot) for expression.

B. Human LDLR mRNA encoding human LDLR double mutant (PCSK9 and IDOL variants), mRNA encoding a human LDLR PCSK9 mutant, mRNA encoding a human LDLR IDOL mutant and mRNA encoding mouse wild type LDLR are formulated and administered to LDLR –/– mice. Samples are collected 2, 4, 5, 6, 8 and/or 24 hours post-administration and are evaluated using a method known in the art (e.g., CE assay or Western Blot) for expression.

Example 30. In Vivo Studies of PCSK9/IDOL LDLR Variant

Figure 21:
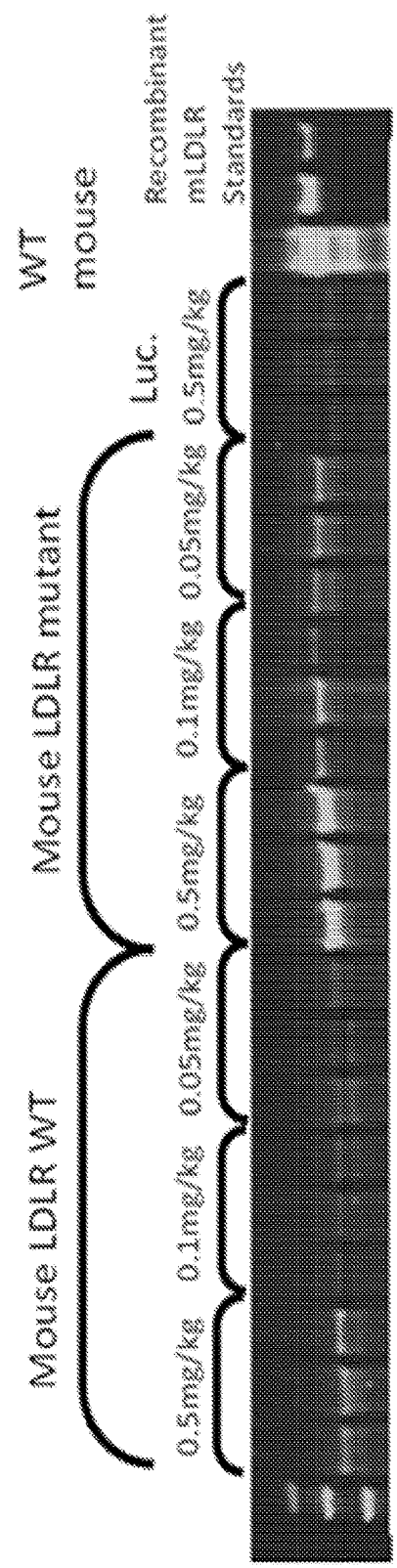
FIG. 21 shows a gel profile of LDLR expression.

LDLR –/– mice were administered intravenously 100 μl of 0.5 mg/kg, 0.1 mg/kg or 0.05 mg/kg mouse LDLR mRNA (SEQ ID NO: 742; polyA tail of approximately 140 nucleotides not shown in sequence; 5' cap, Cap 1; fully modified with 5-methylcytosine and 1-methylpseudouridine), mouse LDLR mutant 1 (comprising the mutations N317A, K832R and C841A as compared to the wild type sequence (SEQ ID NO: 742) mRNA (SEQ ID NO: 724; polyA tail of approximately 140 nucleotides not shown in sequence; 5' cap, Cap1; fully modified with 5-methylcytosine and 1-methylpseudouridine), mouse LDLR mutant 2 (comprising the mutations L340D, K832R and C841A as compared to the wild type sequence (SEQ ID NO: 742) mRNA (SEQ ID NO: 733; polyA tail of approximately 140 nucleotides not shown in sequence; 5' cap, Cap1; fully modified with 5-methylcytosine and 1-methylpseudouridine) or mouse IDOL mutant (comprising the mutations K832R and C841A as compared to the wild type sequence (SEQ ID NO: 742) mRNA (SEQ ID NO: 734; polyA tail of approximately 140 nucleotides not shown in sequence; 5' cap, Cap1; fully modified with 5-methylcytosine and 1-methylpseudouridine) was formulated in a lipid nanoparticle comprising C12-200 (molar ratio 40%), Cholesterol (molar ratio 25%), PEG2000-DOMG lipid (molar ratio 5%) and DSPC (molar ratio 30%). The mean size of the lipid nanoparticle was 105 nm, a PDI of 0.15, zeta at pH 7.4 was 0.7 mV, the encapsulation efficiency (RiboGreen) was 55% and the total lipid to modified mRNA mass ratio was 20:1. A control of 0.5 mg/kg of luciferase (SEQ ID NO: 741; polyA tail of approximately 140 nucleotides not shown in sequence; 5' cap, Cap1; fully modified with 5-methylcytosine and 1-methylpseudouridine) formulated in a C12-200 lipid nanoparticle comprising cholesterol, DSPC and PEG2000-DOMG (40:25:30:5 molar ratio), a wild type mouse and recombinant mouse LDLR standards were used as a control. 24 hours post-administration livers were harvested at 6 hours after administration and microsomal preparations were made using a Licor Western Blot. As shown in FIG. 21 and Table 14, the mouse LDLR variant expressed better that wild-type LDLR at all concentrations evaluated.

TABLE 14

Expression of Mouse LDLR

| | 6 hours (Mm LDLR concentration ng/ml) | 24 hours (Mm LDLR concentration ng/ml) |
|---|---|---|
| Wild type mouse LDLR | 0.23 | 0.19 |
| Mouse LDLR mutant 1 | 0.84 | 1.54 |
| Mouse LDLR mutant 2 | 1.19 | 0.96 |
| Mouse LDLR IDOL mutant | 1.62 | 0.11 |

Example 31. LDLR IDOL Binding Mutant In Vitro Study 100 ng of wild type mouse mRNA encoding LDLR (SEQ ID NO: 742; polyA tail of approximately 140 nucleotides not shown in sequence; 5' cap, Cap1; fully modified with 5-methylcytosine and 1-methylpseudouridine) and mouse LDLR mutant 1 (comprising the mutations N317A, K832R and C841A as compared to the wild type sequence (SEQ ID NO: 742) mRNA (SEQ ID NO: 724; polyA tail of approximately 140 nucleotides not shown in sequence; 5' cap, Cap0; fully modified with 1-methylpseudouridine) was transfected in HeLa and Hepa1-6. The cells were also transfected with 100 ng of luciferase mRNA (SEQ ID NO: 741; polyA tail of approximately 140 nucleotides not shown in sequence; 5' cap, Cap 1; fully modified with 5-methylcytosine and 1-methylpseudouridine) in 100 uL or 1.1 mg/kg IDOL mRNA (SEQ ID NO: 743; polyA tail of approximately 140 nucleotides not shown in sequence; 5' cap, Cap1; fully modified with 1-methylpseudouridine) in 100 uL. LDLR expression was analyzed after 14 hours by flow cytometry.

As shown in Table 15, the mouse LDLR mutant 1 shows resistance to IDOL mediated LDLR downmodulation. In Hepa1-6, mouse LDLR wild type which was co-transfected with mouse IDOL was reduced to 16.7% of the baseline, the mouse LDLR mutant 1 was reduced to 62.9% of the baseline expression and wild-type LDLR expression was reduced to 62.3% of the baseline. In HeLa cells, mouse LDLR wild type which was co-transfected with mouse IDOL was reduced to 50.5% of the baseline, the mouse LDLR mutant 1 was reduced to 84.2% of the baseline expression and there was little to no wild-type LDLR expression expression in HeLa.

TABLE 15

| | LDLR Expression | | | |
|---|---|---|---|---|
| | HeLa Cells | | Hepa1-6 | |
| | Luciferase (Average LDLR MCF) | IDOL (Average LDLR MCF) | Luciferase (Average LDLR MCF) | IDOL (Average LDLR MCF) |
| Wild type mouse LDLR | 5773 | 2917 | 5272 | 881 |
| Mouse LDLR variant 1 | 8369 | 7046 | 14080 | 8861 |
| Luciferase | 222 | 205 | 1100 | 685 |

Other Embodiments

It is to be understood that the words which have been used are words of description rather than limitation, and that changes may be made within the purview of the appended claims without departing from the true scope and spirit of the invention in its broader aspects.

SEQUENCE LISTING (747 sequences)

SEQ ID NO: 1 - protein, 22 aa, Unknown
  Description of Unknown: 2A peptide
GSGATNFSLLKQAGDVEENPGP

SEQ ID NO: 2 - DNA, 66 bp, Unknown
  Description of Unknown: 2A peptide
ggaagcggagctactaacttcagcctgctgaagcaggctggagacgtggaggagaaccctggacct

SEQ ID NO: 3 - DNA, 47 bp, Artificial Sequence
  Description of Artificial Sequence: Untranslated Region
gggaaataagagagaaaagaagagtaagaagaaatataagagccacc

SEQ ID NO: 4 - DNA, 47 bp, Artificial Sequence
  Description of Artificial Sequence: Untranslated Region
gggagatcagagagaaaagaagagtaagaagaaatataagagccacc

SEQ ID NO: 5 - DNA, 145 bp, Artificial Sequence
  Description of Artificial Sequence: Untranslated Region
ggaataaaagtctcaacacaacatatacaaaacaaacgaatctcaagcaatcaagcattctacttctattgcagcaatttaaatcatttcttttaaagcaaaagcaattttctgaaaattttcaccatttacgaacgatagcaac

SEQ ID NO: 6 - RNA, 42 nt, Artificial Sequence
  Description of Artificial Sequence: Untranslated Region
gggagacaagcuuggcauuccgguacuguugguaaagccacc

SEQ ID NO: 7 - DNA, 47 bp, Artificial Sequence; identical to SEQ ID NO: 4
  Description of Artificial Sequence: Untranslated Region

SEQ ID NO: 8 - DNA, 145 bp, Artificial Sequence; identical to SEQ ID NO: 5
  Description of Artificial Sequence: Untranslated Region

SEQ ID NO: 9 - RNA, 42 nt, Artificial Sequence; identical to SEQ ID NO: 6
  Description of Artificial Sequence: Untranslated Region

SEQ ID NO: 10 - DNA, 47 bp, Artificial Sequence
  Description of Artificial Sequence: Untranslated Region
gggaattaacagagaaaagaagagtaagaagaaatataagagccacc

SEQ ID NO: 11 - DNA, 47 bp, Artificial Sequence
  Description of Artificial Sequence: Untranslated Region
gggaaattagacagaaaagaagagtaagaagaaatataagagccacc

SEQ ID NO: 12 - DNA, 47 bp, Artificial Sequence
  Description of Artificial Sequence: Untranslated Region
gggaaataagagagtaaagaacagtaagaagaaatataagagccacc

SEQ ID NO: 13 - DNA, 47 bp, Artificial Sequence
  Description of Artificial Sequence: Untranslated Region
gggaaaaaagagagaaaagaagactaagaagaaatataagagccacc

SEQ ID NO: 14 - DNA, 47 bp, Artificial Sequence
  Description of Artificial Sequence: Untranslated Region
gggaaataagagagaaaagaagagtaagaagatatataagagccacc

SEQ ID NO: 15 - DNA, 47 bp, Artificial Sequence
  Description of Artificial Sequence: Untranslated Region
gggaaataagagacaaaacaagagtaagaagaaatataagagccacc

SEQ ID NO: 16 - DNA, 47 bp, Artificial Sequence
  Description of Artificial Sequence: Untranslated Region
gggaaattagagagtaaagaacagtaagtagaattaaaagagccacc

SEQ ID NO: 17 - DNA, 47 bp, Artificial Sequence
  Description of Artificial Sequence: Untranslated Region
gggaaataagagagaatagaagagtaagaagaaatataagagccacc

SEQ ID NO: 18 - DNA, 47 bp, Artificial Sequence
  Description of Artificial Sequence: Untranslated Region
gggaaataagagagaaaagaagagtaagaagaaaattaagagccacc

SEQ ID NO: 19 - DNA, 47 bp, Artificial Sequence
  Description of Artificial Sequence: Untranslated Region
gggaaataagagagaaaagaagagtaagaagaaatttaagagccacc

SEQ ID NO: 20 - DNA, 371 bp, Unknown
  Description of Unknown: Untranslated Region
gcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccaccccaaccaggagctctagttaatggagagctcccagcacactcggagcttgtgctttgtctccacgcaaagcgataaataaaagcattggtggcctttggtctttgaataaagcctgagtaggaagtctaga

SEQ ID NO: 21 - DNA, 568 bp, Unknown
  Description of Unknown: Untranslated Region
gcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcatggtctttgaataaagcctgagtaggaagtctaga

SEQ ID NO: 22 - DNA, 289 bp, Unknown
  Description of Unknown: Untranslated Region
acacactccacctccagcacgcgacttctcaggacgacgaatcttctcaatgggggggcggctgagctccagccaccccgcagtcactttctttgtaacaacttccgttgctgccatcgtaaactgacacagtgtttataacgtgtacatacattaacttattacctcattttgttatttttcgaaacaaagccctgtggaagaaaatggaaaacttgaagaagcattaaagtcattctgttaagctgcgtaaatggtctttgaataaagcctgagtaggaagtctaga

SEQ ID NO: 23 - DNA, 379 bp, Unknown
  Description of Unknown: Untranslated Region
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaatggtctttgaataaagcctgagtaggaagtctaga

SEQ ID NO: 24 - DNA, 118 bp, Unknown
  Description of Unknown: Untranslated Region
gctgccttctgcggggcttgccttctggccatgcccttcttctctcccttgcacctgtacctcttggtctttgaataaagcctgagtaggaaggcggccgctcgagcatgcatctaga

SEQ ID NO: 25 - DNA, 908 bp, Unknown
  Description of Unknown: Untranslated Region
gccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgcgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccatggtctttgaataaagcctgagtaggaaggcggccgctcgagcatgcatctaga

SEQ ID NO: 26 - DNA, 835 bp, Unknown
  Description of Unknown: Untranslated Region
actcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaagaacatat

SEQ ID NO: 27 - DNA, 297 bp, Unknown
  Description of Unknown: Untranslated Region
cgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccat

SEQ ID NO: 28 - DNA, 602 bp, Unknown
  Description of Unknown: Untranslated Region
ggggctagagccctctccgcacagcgtggagacggggcaaggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaaaataaagcgagatgttgccctcaaa

SEQ ID NO: 29 - DNA, 785 bp, Unknown
  Description of Unknown: Untranslated Region
ggccctgccccgtcggactgcccccagaaagcctcctgccccctgccagtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgt

SEQ ID NO: 30 - DNA, 3001 bp, Unknown
  Description of Unknown: Untranslated Region
atattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggcaagtgatgtggcaattatctctggtgacaaaagagtaaaatcaaatatttctgcctgttacaaatatcaaggaagacctgctactatgaaatagatgacattaatctgtcttcactgtttataatacggatggattttttttcaaatcagtgtgtgttttgaggtcttatgtaattgatgacatttgagagaaatggtggctttttttagctacctctttgttcatttaagcaccagtaaagatcatgtctttttatagaagtgtagattttctttgtgactttgctatcgtgcctaaagctctaaatataggtgaatgtgtgatgaatactcagattatttgtctctctatataattagtttggtactaagtttctcaaaaaattattaacacatgaaagacaatctctaaaccagaaaaagaagtagtacaaattttgttactgtaatgctcgcgtttagtgagtttaaaacacacagtatcttttggttttataatcagtttctattttgctgtgcctgagattaagatctgtgtatgtgtgtgtgtgtgtgtgtgcgtttgtgtgttaaagcagaaaagacttttttaaaagttttaagtgataaatgcaatttgttaattgatcttagatcactagtaaactcagggctgaattataccatgtatattctattagaagaaagtaaacaccatctttattcctgccctttttcttctctcaaagtagttgtagttatatctagaaagaagcaattttgatttcttgaaaaggtagttcctgcactcagtttaaactaaaaataatcatacttggattttatttatttttgtcatagtaaaaattttaatttatatatatttttatttagtattatcttattctttgctatttgccaatcctttgtcatcaattgtgttaaatgaattgaaaattcatgccctgttcattttattttactttattggttaggatatttaaaggatttttgtatatataatttcttaaattaatattccaaaaggttagtggacttagattataaattatggcaaaaatctaaaaacaacaaaaatgatttttatacattctatttcattattcctctttttccaataagtcatacaattggtagatatgacttattttatttttgtattattcactatatctttatgatatttaagtataaataattaaaaaaatttattgtaccttatagtctgtcaccaaaaaaaaaaaattatctgtaggtagtgaaatgctaatgttgatttgtctttaagggcttgttaactatcctttattttctcatttgtcttaaattaggagtttgtgtttaaattactcatctaagcaaaaaatgtatataaatcccattactgggtatatacccaaaggattataaatcatgctgctataaagacacatgcacacgtatgtttattgcagcactattcacaatagcaaagacttggaaccaacccaaatgtccatcaatgatagacttgattaagaaaatgtgcacatatacaccatggaatactatgcagccataaaaaaggatgagttcatgtcctttgtagggacatggataaagctggaaaccatcattctgagcaaactattgcaaggacagaaaaccaaacactgcatgttctcactcataggtgggaattgaacaatgagaacacttggacacaaggtggggaacaccacacaccagggcctgtcatggggtggggggagtggggagggatagcattaggagatatacctaatgtaaatgatgagttaatgggtgcagcacaccaacatggcacatgtatacatatgtagcaaacctgcacgttgtgcacatgtaccctagaacttaaagtataattaaaaaaaaaaagaaaacagaagctatttataaagaagttatttgctgaaataaatgtgatctttcccattaaaaaaataaagaaattttggggtaaaaaaacacaatatattgtattcttgaaaaattctaagagagtggatgtgaagtgttctcaccacaaaagtgataactaattgaggtaatgcacatattaattagaaagattttgtcattccacaatgtatatatacttaaaaatatgttatacacaataaatacatacattaaaaaataagtaaatgta

SEQ ID NO: 31 - DNA, 1037 bp, Unknown
  Description of Unknown: Untranslated Region
cccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctggggctcagccctgagctagtgtcacctgcacagggccctctgaggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcatcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctctc

SEQ ID NO: 32 - DNA, 577 bp, Unknown
  Description of Unknown: Untranslated Region
agaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctcc

SEQ ID NO: 33 - DNA, 2212 bp, Unknown
  Description of Unknown: Untranslated Region
ctccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaaccttaccaaaaaaaaaaaaaaaaaaagaataaataaataactttttaaaaaaggaagcttggtccacttgcttgaagacccatgcgggggtaagtccctttctgcccgttgggcttatgaaaccccaatgctgccctttctgctcctttctccacaccccccttggggcctcccctccactccttcccaaatctgtctccccagaagacacaggaaacaatgtattgtctgcccagcaatcaaaggcaatgctcaaacacccaagtggcccccaccctcagcccgctcctgcccgcccagcacccccaggccctgggggacctggggttctcagactgccaaagaagccttgccatctggcgctcccatggctcttgcaacatctccccttcgtttttgagggggtcatgccgggggagccaccagcccctcactgggttcggaggagagtcaggaagggccacgacaaagcagaaacatcggatttggggaacgcgtgtcaatcccttgtgccgcagggctgggcgggagagactgttctgttccttgtgtaactgtgttgctgaaagactacctcgttcttgtcttgatgtgtcaccggggcaactgcctgggggcggggatgggggcagggtggaagcggctccccattttataccaaaggtgctacatctatgtgatgggtggggtggggagggaatcactggtgctatagaaattgagatgcccccccaggccagcaaatgttcctttttgttcaaagtctatttttattccttgatatttttctttttttttttttttttttgtggatggggacttgtgaatttttctaaaggtgctatttaacatgggaggagagcgtgtgcggctccagcccagcccgctgctcactttccaccctctctccacctgcctctggcttctcaggcctctgctctccgacctctctcctctgaaaccctcctccacagctgcagcccatcctcccggctccctcctagtctgtcctgcgtcctctgtccccgggtttcagagacaacttcccaaagcacaaagcagtttttccccctaggggtgggaggaagcaaaagactctgtacctattttgtatgtgtataataatttgagatgtttttaattattttgattgctggaataaagcatgtggaaatgacccaaacataatccgcagtggcctcctaatttccttctttggagttgggggaggggtagacatggggaaggggctttggggtgatgggcttgccttccattcctgccctttccctccccactattctcttctagatccctccataaccccactcccctttctctcacccttcttataccgcaaacctttctacttcctctttcattttctattcttgcaatttccttgcaccttttccaaatcctcttctcccctgcaataccatacaggcaatccacgtgcacaacacacacacacactcttcacatctggggttgtccaaacctcatacccactccccttcaagcccatccactctccaccccctggatgccctgcacttggtggcggtgggatgctcatggatactgggagggtgaggggagtggaacccgtgaggaggacctgggggcctctccttgaactgacatgaagggtcatctggcctctgctcccttctcacccacgctgacctcctgccgaaggagcaacgcaacaggagaggggtctgctgagcctggcgagggtctgggagggaccaggaggaaggcgtgctccctgctcgctgtcctggccctgggggagtgagggagacagacacctgggagagctgtggggaaggcactcgcaccgtgctcttgggaaggaaggagacctggccctgctcaccacggactgggtgcctcgacctcctgaatccccagaacacaacccccctgggctggggtggtctggggaaccatcgtgcccccgcctcccgcctactcctttttaagctt

SEQ ID NO: 34 - DNA, 729 bp, Unknown
  Description of Unknown: Untranslated Region
ttggccaggcctgaccctcttggacctttcttctttgccgacaaccactgcccagcagcctctgggacctcggggtcccagggaacccagtccagcctcctggctgttgacttcccattgctcttggagccaccaatcaaagagattcaaagagattcctgcaggccagaggcggaacacacctttatggctggggctctccgtggtgttctggacccagcccctggagacaccattcacttttactgctttgtagtgactcgtgctctccaacctgtcttcctgaaaaaccaaggcccccttcccccacctcttccatggggtgagacttgagcagaacaggggcttccccaagttgcccagaaagactgtctgggtgagaagccatggccagagcttctcccaggcacaggtgttgcaccagggacttctgcttcaagttttggggtaaagacacctggatcagactccaagggctgccctgagtctgggacttctgcctccatggctggtcatgagagcaaaccgtagtcccctggagacagcgactccagagaacctcttgggagacagaagaggcatctgtgcacagctcgatcttctacttgcctgtggggaggggagtgacaggtccacacaccacactgggtcaccctgtcctggatgcctctgaagagagggacagaccgtcagaaactggagagtttctattaaaggtcatttaaacca

SEQ ID NO: 35 - DNA, 847 bp, Unknown
  Description of Unknown: Untranslated Region
tcctccgggaccccagccctcaggattcctgatgctccaaggcgactgatgggcgctggatgaagtggcacagtcagcttccctgggggctggtgtcatgttgggctcctggggcgggggcacggcctggcatttcacgcattgctgccaccccaggtccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccgggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 36 - DNA, 110 bp, Unknown
  Description of Unknown: Untranslated Region
gctggagcctcggtggccatgcttcttgccccttgggcctccccccagcccctcctccccttcctgcacccgtacccccgtggtctttgaataaagtctgagtgggcggc

SEQ ID NO: 37 - protein, 692 aa, Homo sapiens
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCLTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 38 - protein, 819 aa, Homo sapiens
MGPWGWKLRWTVALLLAAAGTAVGDRCERNEFQCQDGKCISYKWVCDGSAECQDGSDESQETCSPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 39 - protein, 682 aa, Homo sapiens
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPREAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 40 - protein, 858 aa, Homo sapiens
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSMVSLEDDVA

SEQ ID NO: 41 - protein, 945 aa, Homo sapiens
  misc_feature (1)..(1): Xaa can be any naturally occurring amino acid
XGRPGVPPRFLSQRRRQVPGPRSRLRDIHESPSVILGPPGEVPGFRCALWRHLRPHLVLGGALAPPAPIKFTEGPPATLKASVPYEVETLPQNLPAPPWSAAEIFSHVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 42 - protein, 739 aa, Homo sapiens
MGPWGWKLRWTVALLLAAAGTAVGDRCERNDFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 43 - protein, 860 aa, Homo sapiens [sequence omitted]

SEQ ID NO: 44 - protein, 860 aa, Artificial Sequence
  Description of Artificial Sequence: LDLR protein
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNELKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 45 - protein, 860 aa, Artificial Sequence
  Description of Artificial Sequence: LDLR protein
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECDCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 46 - protein, 860 aa, Artificial Sequence
  Description of Artificial Sequence: LDLR protein
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTAECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 47 - protein, 860 aa, Artificial Sequence
  Description of Artificial Sequence: LDLR protein
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNACLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 48 - protein, 860 aa, Artificial Sequence
  Description of Artificial Sequence: LDLR protein
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGAECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 49 - protein, 860 aa, Artificial Sequence
  Description of Artificial Sequence: LDLR protein
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTAACLDNNGGCSHVCNALKIGAECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 50 - protein, 860 aa, Artificial Sequence
  Description of Artificial Sequence: LDLR protein
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTAECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQRTTEDEVHIAHNQDGYSYPSRQMVSLEDDVA

SEQ ID NO: 51 - protein, 860 aa, Artificial Sequence
  Description of Artificial Sequence: LDLR protein
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTAECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLRNINSINFDNPVYQRTTEDEVHIAHNQDGYSYPSRQMVSLEDDVA

SEQ ID NO: 52 - protein, 860 aa, Artificial Sequence
  Description of Artificial Sequence: LDLR protein
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECDCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQRTTEDEVHIAHNQDGYSYPSRQMVSLEDDVA

SEQ ID NO: 53 - protein, 860 aa, Artificial Sequence
  Description of Artificial Sequence: LDLR protein
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECDCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLRNINSINFDNPVYQRTTEDEVHIAHNQDGYSYPSRQMVSLEDDVA

SEQ ID NO: 54 - protein, 860 aa, Artificial Sequence
  Description of Artificial Sequence: LDLR protein
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQRTTEDEVHIAHNQDGYSYPSRQMVSLEDDVA

SEQ ID NO: 55 - protein, 860 aa, Artificial Sequence
  Description of Artificial Sequence: LDLR protein
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLRNINSINFDNPVYQRTTEDEVHIAHNQDGYSYPSRQMVSLEDDVA

SEQ ID NO: 56 - DNA, 2333 bp, Homo sapiens
gtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtctgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaacgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggttctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccgacctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggctt

SEQ ID NO: 57 - DNA, 2768 bp, Homo sapiens
gtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgctcccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaacgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggttctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccgacctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggccc

SEQ ID NO: 58 - DNA, 2429 bp, Homo sapiens
gtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtcctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaacgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggttctcttccacaacctcacccagccaagagaggctgaggctgcagtggccacccaggagacatccaccgtcaggctaaaggtcagctccacagccgtaaggacacagcacacaaccacccgacctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctc

SEQ ID NO: 59 - DNA, 3144 bp, Homo sapiens
gccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaacgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggttctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccgacctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaaggggaggggatgtcaggcccagagaagcaagtggctttcaacacacaacagcagatggcaccaacgggaccccctggccctgcctcatccaccaatctctaagccaaacccctaaactcaggagtcaacgtgtttacctcttctatgcaagccttgctagacagccaggttagcctttgccctgt

SEQ ID NO: 60 - DNA, 5337 bp, Homo sapiens
aggggaggcctggcgttcctccgcggttcctgtcacaaaggcgacgacaagtcccgggtccccggagccgcctccgcgacatacacgagtcgccctccgttatcctgggccctcctggcgaagtccccggtttccgctgtgctctgtggcgacacctccgtccccaccttgtcctggggggcgccctcgccccaccagccccgatcaagttcacagaggggcccccggccaccctcaaggcctcggttccttacgaggttgaaacgttgcctcagaatctccccgcccctccttggtctgcagccgagatcttcagccacgtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaacgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggttctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccgacctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaaggggaggggatgtcaggcccagagaagcaagtggctttcaacacacaacagcagatggcaccaacgggaccccctggccctgcctcatccaccaatctctaagccaaacccctaaactcaggagtcaacgtgtttacctcttctatgcaagccttgctagacagccaggttagcctttgccctgtcacccccgaatcatgacccacccagtgtctttcgaggtgggtttgtaccttccttaagccaggaaagggattcatggcgtcggaaatgatctggctgaatccgtggtggcaccgagaccaaactcattcaccaaatgatgccacttcccagaggcagagcctgagtcactggtcacccttaatatttattaagtgcctgagacacccggttaccttggccgtgaggacacgtggcctgcacccaggtgtggctgtcaggacaccagcctggtgcccatcctcccgacccctacccacttccattcccgtggtctccttgcactttctcagttcagagttgtacactgtgtacatttggcatttgtgttattattttgcactgttttctgtcgtgtgtgttgggatgggatcccaggccagggaaagcccgtgtcaatgaatgccggggacagagaggggcaggttgaccgggacttcaaagccgtgatcgtgaatatcgagaactgccattgtcgtctttatgtccgcccacctagtgcttccacttctatgcaaatgcctccaagccattcacttccccaatcttgtcgttgatgggtatgtgtttaaaacatgcacggtgaggccgggcgcagtggctcacgcctgtaatcccagcactttgggaggccgaggcgggtggatcatgaggtcaggagatcgagaccatcctggctaacacgtgaaaccccgtctctactaaaaatacaaaaaattagccgggcgtggtggcgggcacctgtagtcccagctactcgggaggctgaggcaggagaatggtgtgaacccgggaagcggagcttgcagtgagccgagattgcgccactgcagtccgcagtctggcctgggcgacagagcgagactccgtctcaaaaaaaaaaaacaaaaaaaaaccatgcatggtgcatcagcagcccatggcctctggccaggcatggcgaggctgaggtgggaggatggtttgagctcaggcatttgaggctgtcgtgagctatgattatgccactgctttccagcctgggcaacatagtaagaccccatctcttaaaaaatgaatttggccagacacaggtgcctcacgcctgtaatcccagcactttgggaggctgagctggatcacttgagttcaggagttggagaccaggcctgagcaacaaagcgagatcccatctctacaaaaaccaaaaagttaaaaatcagctgggtacggtggcacgtgcctgtgatcccagctacttgggaggctgaggcaggaggatcgcctgagcccaggaggtggaggttgcagtgagccatgatcgagccactgcactccagcctgggcaacagatgaagaccctatttcagaaatacaactataaaaaaataaataaatcctccagtctggatcgtttgacgggacttcaggttctttctgaaatcgccgtgttactgttgcactgatgtccggagagacagtgacagcctccgtcagactcccgcgtgaagatgtcacaagggattggcaattgtccccagggacaaaacactgtgtcccccccagtgcagggaaccgtgataagcctttctggtttcggagcacgtaaatgcgtccctgtacagatagtggggattttttgttatgtttgcactttgtatattggttgaaactgttatcacttatatatatatatatacacacatatatataaaatctatttatttttgcaaaccctggttgctgtatttgttcagtgactattctcggggccctgtgtagggggttattgcctctgaaatgcctcttctttatgtacaaagattatttgcacgaactggactgtgtgcaacgctttttgggagaatgatgtccccgttgtatgtatgagtggcttctgggagatgggtgtcactttttaaaccactgtatagaaggtttttgtagcctgaatgtcttactgtgatcaattaaatttcttaaatgaa

SEQ ID NO: 61 - DNA, 2656 bp, Homo sapiens
gtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgacttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaacgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggttctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccgacctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaaggggaggggatgtcaggcccagagaagcaagtggctttc

SEQ ID NO: 62 - DNA, 3617 bp, Homo sapiens
ctcttgcagtgaggtgaagacatttgaaaatcaccccactgcaaactcctccccctgctagaaacctcacattgaaatgctgtaaatgacgtgggccccgagtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaacgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggttctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccgacctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaaggggaggggatgtcaggcccagagaagcaagtggctttcaacacacaacagcagatggcaccaacgggaccccctggccctgcctcatccaccaatctctaagccaaacccctaaactcaggagtcaacgtgtttacctcttctatgcaagccttgctagacagccaggttagcctttgccctgtcacccccgaatcatgacccacccagtgtctttcgaggtgggtttgtaccttccttaagccaggaaagggattcatggcgtcggaaatgatctggctgaatccgtggtggcaccgagaccaaactcattcaccaaatgatgccacttcccagaggcagagcctgagtcactggtcacccttaatatttattaagtgcctgagacacccggttaccttggccgtgaggacacgtggcctgcacccaggtgtggctgtcaggacaccagcctggtgcccatcctcccgacccctacccacttccattcccgtggtctccttgcactttctcagttcagagttgtacactgtgta

SEQ ID NO: 63 - RNA, 2726 nt, Artificial Sequence
  Description of Artificial Sequence: Synthetic Transcript Sequence
gggaaauaagagagaaaagaagaguaagaagaaauauaagagccaccauggguccguggggcuggaagcuuagauggacagucgcgcuccuccuugcagcagcaggaacugcggucggagaucgaugcgagcgcaacgaguuccaaugccaagaugggaaguguauuucguacaagugggucugcgauggaucagcggaaugucaggacggaagcgaugagagccaagaaacaugccucucagugacaugcaagucgggagacuucucgugcggaggacgcguaaacagauguauuccacaguuuuggcgcugcgauggucagguggacugcgacaacgguucagaugaacagggauguccuccgaaaacgugcucacaagacgaguuucgcugccaugauggaaagugcauuucgcggcaguucguaugugauucggaucgggacugucuggacggcucggacgaagcgucaugcccgguacuuacuugcgggccagccucauuccaaugcaacagcucaacgugcauuccccagcugugggccugugacaaugauccugauugugaggacgguagcgacgaguggccgcagagauguagggguuuguacguauuccaaggagacucaagccccuguuccgccuuugaguuucacugccugucgggugaaugcauccacuccagcuggcgaugugauggugggcccgacugcaaagauaagagcgacgaggagaauugcgcggucgcgacgugcagacccgaugaguuccagugcuccgauggaaacugcauccacgggagccggcagugugaucgcgaguacgauuguaaagacaugucagacgaggucggaugcgugaacgucacguugugcgaggguccgaacaaguuuaagugccauucgggcgaauguauuacgcucgauaaagucugcaacauggcgcgagauuguagggauuggucagacgaacccaucaaggagugcggcacuaacgaguguuuggacaauaacggcggguguucgcacgucugcaaugaucucaaaauuggguaugagugucucuguccugacggauuccagcuggucgcgcagcgcagaugcgaggacaucgacgagugccaggaccccgacacauguucgcaguugugugucaaccuugaaggaggguacaagugccagugcgaggagggauuucagcuugacccgcacacgaaagcauguaaagcggugggguccauugcguauuuguuuuucacaaacagacaugaagugcggaagaugacccuugaucgcagcgaauauacgucacugaucccuaaucuuaggaaugucguggcccuugacacggagguagcaucaaauagaaucuacugguccgaccucucacagagaaugaucuguucaacacaguuggaucgggcgcacggggugucgucguacgauacgguaauuagccgcgacauccaggcgccagacggacucgcggucgacuggauccauagcaacaucuacuggacagacuccguguugggaaccguauccguagcugacacaaagggagugaagcggaaaacucuuuuuagagagaacggcagcaaaccgagagcaaucguggucgauccggugcauggauucauguauuggaccgauuggggaacgccagccaaaaucaagaaaggcgguuugaauggggucgacaucuacucgcuggugacugagaauauucaguggccaaacgggaucaccuuggacuuguugucggggagguuguauuggguggacucaaagcuccacucgaucagcucgaucgacgugaacggcggaaauaggaaaacuauucucgaagaugagaaaagacuggcccaccccuucucgcucgcgguguucgaggacaaaguauuuuggacagacaucaucaacgaagcgaucuuuucagccaaccgccugacagggucggaugucaaucucuuggccgaaaaccuucugagcccggaagauauggucuuguuucacaauuugacccaacccagaggugugaauuggugcgaacggacgacauugucgaacggagguugccaguaucucugucucccugcaccccagauuaauccccauucacccaaguucacgugugcgugcccagacggaaugcuucuugcgagggacaugagauccugucucaccgaagcggaagcggcaguggccacacaagagacuucgacuguccgccuuaaaguguccucgacggcgguccgaacucagcauacgaccacacgacccgugcccgauaccucgcgguugcccggagcaacaccgggguugacgacaguagaaaucguaaccaugagccaccaggcacuuggagaugucgcaggcagaggcaaugagaagaaacccagcucggucagagcccucagcaucgugcugccuauugugcugcuuguguuucucuguuuggguguguucuuguuguggaagaacuggcgccuuaagaauaucaacucgauuaacuucgauaauccgguauaccagaaaaccacagaggaugaagugcauauuugucacaaccaagauggcuauucguacccguccaggcaaaugguaucacuugaggacgacguggccugauaagcugccuucugcggggcuugccuucuggccaugcccuucuucucucccuugcaccuguaccucuuggucuuugaauaaagccugaguaggaag

SEQ ID NO: 64 - RNA, 2729 nt, Artificial Sequence
  Description of Artificial Sequence: Synthetic Transcript Sequence
gggaaauaagagagaaaagaagaguaagaagaaauauaagagccaccauggguccguggggcuggaagcuuagauggacagucgcgcuccuccuugcagcagcaggaacugcggucggagaucgaugcgagcgcaacgaguuccaaugccaagaugggaaguguauuucguacaagugggucugcgauggaucagcggaaugucaggacggaagcgaugagagccaagaaacaugccucucagugacaugcaagucgggagacuucucgugcggaggacgcguaaacagauguauuccacaguuuuggcgcugcgauggucagguggacugcgacaacgguucagaugaacagggauguccuccgaaaacgugcucacaagacgaguuucgcugccaugauggaaagugcauuucgcggcaguucguaugugauucggaucgggacugucuggacggcucggacgaagcgucaugcccgguacuuacuugcgggccagccucauuccaaugcaacagcucaacgugcauuccccagcugugggccugugacaaugauccugauugugaggacgguagcgacgaguggccgcagagauguagggguuuguacguauuccaaggagacucaagccccuguuccgccuuugaguuucacugccugucgggugaaugcauccacuccagcuggcgaugugauggugggcccgacugcaaagauaagagcgacgaggagaauugcgcggucgcgacgugcagacccgaugaguuccagugcuccgauggaaacugcauccacgggagccggcagugugaucgcgaguacgauuguaaagacaugucagacgaggucggaugcgugaacgucacguugugcgaggguccgaacaaguuuaagugccauucgggcgaauguauuacgcucgauaaagucugcaacauggcgcgagauuguagggauuggucagacgaacccaucaaggagugcggcacuaacgaguguuuggacaauaacggcggguguucgcacgucugcaaugaacucaaaauuggguaugagugucucuguccugacggauuccagcuggucgcgcagcgcagaugcgaggacaucgacgagugccaggaccccgacacauguucgcaguugugugucaaccuugaaggaggguacaagugccagugcgaggagggauuucagcuugacccgcacacgaaagcauguaaagcggugggguccauugcguauuuguuuuucacaaacagacaugaagugcggaagaugacccuugaucgcagcgaauauacgucacugaucccuaaucuuaggaaugucguggcccuugacacggagguagcaucaaauagaaucuacugguccgaccucucacagagaaugaucuguucaacacaguuggaucgggcgcacggggugucgucguacgauacgguaauuagccgcgacauccaggcgccagacggacucgcggucgacuggauccauagcaacaucuacuggacagacuccguguugggaaccguauccguagcugacacaaagggagugaagcggaaaacucuuuuuagagagaacggcagcaaaccgagagcaaucguggucgauccggugcauggauucauguauuggaccgauuggggaacgccagccaaaaucaagaaaggcgguuugaauggggucgacaucuacucgcuggugacugagaauauucaguggccaaacgggaucaccuuggacuuguugucggggagguuguauuggguggacucaaagcuccacucgaucagcucgaucgacgugaacggcggaaauaggaaaacuauucucgaagaugagaaaagacuggcccaccccuucucgcucgcgguguucgaggacaaaguauuuuggacagacaucaucaacgaagcgaucuuuucagccaaccgccugacagggucggaugucaaucucuuggccgaaaaccuucugagcccggaagauauggucuuguuucacaauuugacccaacccagaggugugaauuggugcgaacggacgacauugucgaacggagguugccaguaucucugucucccugcaccccagauuaauccccauucacccaaguucacgugugcgugcccagacggaaugcuucuugcgagggacaugagauccugucucaccgaagcggaagcggcaguggccacacaagagacuucgacuguccgccuuaaaguguccucgacggcgguccgaacucagcauacgaccacacgacccgugcccgauaccucgcgguugcccggagcaacaccgggguugacgacaguagaaaucguaaccaugagccaccaggcacuuggagaugucgcaggcagaggcaaugagaagaaacccagcucggucagagcccucagcaucgugcugccuauugugcugcuuguguuucucuguuuggguguguucuuguuguggaagaacuggcgccuuaagaauaucaacucgauuaacuucgauaauccgguauaccagaaaaccacagaggaugaagugcauauuugucacaaccaagauggcuauucguacccguccaggcaaaugguaucacuugaggacgacguggccugauaauaggcugccuucugcggggcuugccuucuggccaugcccuucuucucucccuugcaccuguaccucuuggucuuugaauaaagccugaguaggaag

SEQ ID NO: 65 - RNA, 2729 nt, Artificial Sequence
  Description of Artificial Sequence: Synthetic Transcript Sequence
gggaaauaagagagaaaagaagaguaagaagaaauauaagagccaccauggguccguggggcuggaagcuuagauggacagucgcgcuccuccuugcagcagcaggaacugcggucggagaucgaugcgagcgcaacgaguuccaaugccaagaugggaaguguauuucguacaagugggucugcgauggaucagcggaaugucaggacggaagcgaugagagccaagaaacaugccucucagugacaugcaagucgggagacuucucgugcggaggacgcguaaacagauguauuccacaguuuuggcgcugcgauggucagguggacugcgacaacgguucagaugaacagggauguccuccgaaaacgugcucacaagacgaguuucgcugccaugauggaaagugcauuucgcggcaguucguaugugauucggaucgggacugucuggacggcucggacgaagcgucaugcccgguacuuacuugcgggccagccucauuccaaugcaacagcucaacgugcauuccccagcugugggccugugacaaugauccugauugugaggacgguagcgacgaguggccgcagagauguagggguuuguacguauuccaaggagacucaagccccuguuccgccuuugaguuucacugccugucgggugaaugcauccacuccagcuggcgaugugauggugggcccgacugcaaagauaagagcgacgaggagaauugcgcggucgcgacgugcagacccgaugaguuccagugcuccgauggaaacugcauccacgggagccggcagugugaucgcgaguacgauuguaaagacaugucagacgaggucggaugcgugaacgucacguugugcgaggguccgaacaaguuuaagugccauucgggcgaauguauuacgcucgauaaagucugcaacauggcgcgagauuguagggauuggucagacgaacccaucaaggagugcggcacuaacgaguguuuggacaauaacggcggguguucgcacgucugcaaugaucucaaaauuggguaugagugugauuguccugacggauuccagcuggucgcgcagcgcagaugcgaggacaucgacgagugccaggaccccgacacauguucgcaguugugugucaaccuugaaggaggguacaagugccagugcgaggagggauuucagcuugacccgcacacgaaagcauguaaagcggugggguccauugcguauuuguuuuucacaaacagacaugaagugcggaagaugacccuugaucgcagcgaauauacgucacugaucccuaaucuuaggaaugucguggcccuugacacggagguagcaucaaauagaaucuacugguccgaccucucacagagaaugaucuguucaacacaguuggaucgggcgcacggggugucgucguacgauacgguaauuagccgcgacauccaggcgccagacggacucgcggucgacuggauccauagcaacaucuacuggacagacuccguguugggaaccguauccguagcugacacaaagggagugaagcggaaaacucuuuuuagagagaacggcagcaaaccgagagcaaucguggucgauccggugcauggauucauguauuggaccgauuggggaacgccagccaaaaucaagaaaggcgguuugaauggggucgacaucuacucgcuggugacugagaauauucaguggccaaacgggaucaccuuggacuuguugucggggagguuguauuggguggacucaaagcuccacucgaucagcucgaucgacgugaacggcggaaauaggaaaacuauucucgaagaugagaaaagacuggcccaccccuucucgcucgcgguguucgaggacaaaguauuuuggacagacaucaucaacgaagcgaucuuuucagccaaccgccugacagggucggaugucaaucucuuggccgaaaaccuucugagcccggaagauauggucuuguuucacaauuugacccaacccagaggugugaauuggugcgaacggacgacauugucgaacggagguugccaguaucucugucucccugcaccccagauuaauccccauucacccaaguucacgugugcgugcccagacggaaugcuucuugcgagggacaugagauccugucucaccgaagcggaagcggcaguggccacacaagagacuucgacuguccgccuuaaaguguccucgacggcgguccgaacucagcauacgaccacacgacccgugcccgauaccucgcgguugcccggagcaacaccgggguugacgacaguagaaaucguaaccaugagccaccaggcacuuggagaugucgcaggcagaggcaaugagaagaaacccagcucggucagagcccucagcaucgugcugccuauugugcugcuuguguuucucuguuuggguguguucuuguuguggaagaacuggcgccuuaagaauaucaacucgauuaacuucgauaauccgguauaccagaaaaccacagaggaugaagugcauauuugucacaaccaagauggcuauucguacccguccaggcaaaugguaucacuugaggacgacguggccugauaauaggcugccuucugcggggcuugccuucuggccaugcccuucuucucucccuugcaccuguaccucuuggucuuugaauaaagccugaguaggaag

SEQ ID NO: 66 - RNA, 2729 nt, Artificial Sequence
  Description of Artificial Sequence: Synthetic Transcript Sequence
gggaaauaagagagaaaagaagaguaagaagaaauauaagagccaccauggguccguggggcuggaagcuuagauggacagucgcgcuccuccuugcagcagcaggaacugcggucggagaucgaugcgagcgcaacgaguuccaaugccaagaugggaaguguauuucguacaagugggucugcgauggaucagcggaaugucaggacggaagcgaugagagccaagaaacaugccucucagugacaugcaagucgggagacuucucgugcggaggacgcguaaacagauguauuccacaguuuuggcgcugcgauggucagguggacugcgacaacgguucagaugaacagggauguccuccgaaaacgugcucacaagacgaguuucgcugccaugauggaaagugcauuucgcggcaguucguaugugauucggaucgggacugucuggacggcucggacgaagcgucaugcccgguacuuacuugcgggccagccucauuccaaugcaacagcucaacgugcauuccccagcugugggccugugacaaugauccugauugugaggacgguagcgacgaguggccgcagagauguagggguuuguacguauuccaaggagacucaagccccuguuccgccuuugaguuucacugccugucgggugaaugcauccacuccagcuggcgaugugauggugggcccgacugcaaagauaagagcgacgaggagaauugcgcggucgcgacgugcagacccgaugaguuccagugcuccgauggaaacugcauccacgggagccggcagugugaucgcgaguacgauuguaaagacaugucagacgaggucggaugcgugaacgucacguugugcgaggguccgaacaaguuuaagugccauucgggcgaauguauuacgcucgauaaagucugcaacauggcgcgagauuguagggauuggucagacgaacccaucaaggagugcggcacugcagaguguuuggacaauaacggcggguguucgcacgucugcaaugaucucaaaauuggguaugagugucucuguccugacggauuccagcuggucgcgcagcgcagaugcgaggacaucgacgagugccaggaccccgacacauguucgcaguugugugucaaccuugaaggaggguacaagugccagugcgaggagggauuucagcuugacccgcacacgaaagcauguaaagcggugggguccauugcguauuuguuuuucacaaacagacaugaagugcggaagaugacccuugaucgcagcgaauauacgucacugaucccuaaucuuaggaaugucguggcccuugacacggagguagcaucaaauagaaucuacugguccgaccucucacagagaaugaucuguucaacacaguuggaucgggcgcacggggugucgucguacgauacgguaauuagccgcgacauccaggcgccagacggacucgcggucgacuggauccauagcaacaucuacuggacagacuccguguugggaaccguauccguagcugacacaaagggagugaagcggaaaacucuuuuuagagagaacggcagcaaaccgagagcaaucguggucgauccggugcauggauucauguauuggaccgauuggggaacgccagccaaaaucaagaaaggcgguuugaauggggucgacaucuacucgcuggugacugagaauauucaguggccaaacgggaucaccuuggacuuguugucggggagguuguauuggguggacucaaagcuccacucgaucagcucgaucgacgugaacggcggaaauaggaaaacuauucucgaagaugagaaaagacuggcccaccccuucucgcucgcgguguucgaggacaaaguauuuuggacagacaucaucaacgaagcgaucuuuucagccaaccgccugacagggucggaugucaaucucuuggccgaaaaccuucugagcccggaagauauggucuuguuucacaauuugacccaacccagaggugugaauuggugcgaacggacgacauugucgaacggagguugccaguaucucugucucccugcaccccagauuaauccccauucacccaaguucacgugugcgugcccagacggaaugcuucuugcgagggacaugagauccugucucaccgaagcggaagcggcaguggccacacaagagacuucgacuguccgccuuaaaguguccucgacggcgguccgaacucagcauacgaccacacgacccgugcccgauaccucgcgguugcccggagcaacaccgggguugacgacaguagaaaucguaaccaugagccaccaggcacuuggagaugucgcaggcagaggcaaugagaagaaacccagcucggucagagcccucagcaucgugcugccuauugugcugcuuguguuucucuguuuggguguguucuuguuguggaagaacuggcgccuuaagaauaucaacucgauuaacuucgauaauccgguauaccagaaaaccacagaggaugaagugcauauuugucacaaccaagauggcuauucguacccguccaggcaaaugguaucacuugaggacgacguggccugauaauaggcugccuucugcggggcuugccuucuggccaugcccuucuucucucccuugcaccuguaccucuuggucuuugaauaaagccugaguaggaag

SEQ ID NO: 67 - RNA, 2729 nt, Artificial Sequence
  Description of Artificial Sequence: Synthetic Transcript Sequence
gggaaauaagagagaaaagaagaguaagaagaaauauaagagccaccauggguccguggggcuggaagcuuagauggacagucgcgcuccuccuugcagcagcaggaacugcggucggagaucgaugcgagcgcaacgaguuccaaugccaagaugggaaguguauuucguacaagugggucugcgauggaucagcggaaugucaggacggaagcgaugagagccaagaaacaugccucucagugacaugcaagucgggagacuucucgugcggaggacgcguaaacagauguauuccacaguuuuggcgcugcgauggucagguggacugcgacaacgguucagaugaacagggauguccuccgaaaacgugcucacaagacgaguuucgcugccaugauggaaagugcauuucgcggcaguucguaugugauucggaucgggacugucuggacggcucggacgaagcgucaugcccgguacuuacuugcgggccagccucauuccaaugcaacagcucaacgugcauuccccagcugugggccugugacaaugauccugauugugaggacgguagcgacgaguggccgcagagauguagggguuuguacguauuccaaggagacucaagccccuguuccgccuuugaguuucacugccugucgggugaaugcauccacuccagcuggcgaugugauggugggcccgacugcaaagauaagagcgacgaggagaauugcgcggucgcgacgugcagacccgaugaguuccagugcuccgauggaaacugcauccacgggagccggcagugugaucgcgaguacgauuguaaagacaugucagacgaggucggaugcgugaacgucacguugugcgaggguccgaacaaguuuaagugccauucgggcgaauguauuacgcucgauaaagucugcaacauggcgcgagauuguagggauuggucagacgaacccaucaaggagugcggcacuaacgcauguuuggacaauaacggcggguguucgcacgucugcaaugaucucaaaauuggguaugagugucucuguccugacggauuccagcuggucgcgcagcgcagaugcgaggacaucgacgagugccaggaccccgacacauguucgcaguugugugucaaccuugaaggaggguacaagugccagugcgaggagggauuucagcuugacccgcacacgaaagcauguaaagcggugggguccauugcguauuuguuuuucacaaacagacaugaagugcggaagaugacccuugaucgcagcgaauauacgucacugaucccuaaucuuaggaaugucguggcccuugacacggagguagcaucaaauagaaucuacugguccgaccucucacagagaaugaucuguucaacacaguuggaucgggcgcacggggugucgucguacgauacgguaauuagccgcgacauccaggcgccagacggacucgcggucgacuggauccauagcaacaucuacuggacagacuccguguugggaaccguauccguagcugacacaaagggagugaagcggaaaacucuuuuuagagagaacggcagcaaaccgagagcaaucguggucgauccggugcauggauucauguauuggaccgauuggggaacgccagccaaaaucaagaaaggcgguuugaauggggucgacaucuacucgcuggugacugagaauauucaguggccaaacgggaucaccuuggacuuguugucggggagguuguauuggguggacucaaagcuccacucgaucagcucgaucgacgugaacggcggaaauaggaaaacuauucucgaagaugagaaaagacuggcccaccccuucucgcucgcgguguucgaggacaaaguauuuuggacagacaucaucaacgaagcgaucuuuucagccaaccgccugacagggucggaugucaaucucuuggccgaaaaccuucugagcccggaagauauggucuuguuucacaauuugacccaacccagaggugugaauuggugcgaacggacgacauugucgaacggagguugccaguaucucugucucccugcaccccagauuaauccccauucacccaaguucacgugugcgugcccagacggaaugcuucuugcgagggacaugagauccugucucaccgaagcggaagcggcaguggccacacaagagacuucgacuguccgccuuaaaguguccucgacggcgguccgaacucagcauacgaccacacgacccgugcccgauaccucgcgguugcccggagcaacaccgggguugacgacaguagaaaucguaaccaugagccaccaggcacuuggagaugucgcaggcagaggcaaugagaagaaacccagcucggucagagcccucagcaucgugcugccuauugugcugcuuguguuucucuguuuggguguguucuuguuguggaagaacuggcgccuuaagaauaucaacucgauuaacuucgauaauccgguauaccagaaaaccacagaggaugaagugcauauuugucacaaccaagauggcuauucguacccguccaggcaaaugguaucacuugaggacgacguggccugauaauaggcugccuucugcggggcuugccuucuggccaugcccuucuucucucccuugcaccuguaccucuuggucuuugaauaaagccugaguaggaag

SEQ ID NO: 68 - RNA, 2729 nt, Artificial Sequence
  Description of Artificial Sequence: Synthetic Transcript Sequence
gggaaauaagagagaaaagaagaguaagaagaaauauaagagccaccauggguccguggggcuggaagcuuagauggacagucgcgcuccuccuugcagcagcaggaacugcggucggagaucgaugcgagcgcaacgaguuccaaugccaagaugggaaguguauuucguacaagugggucugcgauggaucagcggaaugucaggacggaagcgaugagagccaagaaacaugccucucagugacaugcaagucgggagacuucucgugcggaggacgcguaaacagauguauuccacaguuuuggcgcugcgauggucagguggacugcgacaacgguucagaugaacagggauguccuccgaaaacgugcucacaagacgaguuucgcugccaugauggaaagugcauuucgcggcaguucguaugugauucggaucgggacugucuggacggcucggacgaagcgucaugcccgguacuuacuugcgggccagccucauuccaaugcaacagcucaacgugcauuccccagcugugggccugugacaaugauccugauugugaggacgguagcgacgaguggccgcagagauguagggguuuguacguauuccaaggagacucaagccccuguuccgccuuugaguuucacugccugucgggugaaugcauccacuccagcuggcgaugugauggugggcccgacugcaaagauaagagcgacgaggagaauugcgcggucgcgacgugcagacccgaugaguuccagugcuccgauggaaacugcauccacgggagccggcagugugaucgcgaguacgauuguaaagacaugucagacgaggucggaugcgugaacgucacguugugcgaggguccgaacaaguuuaagugccauucgggcgaauguauuacgcucgauaaagucugcaacauggcgcgagauuguagggauuggucagacgaacccaucaaggagugcggcacuaacgaguguuuggacaauaacggcggguguucgcacgucugcaaugaucucaaaauuggggcagagugucucuguccugacggauuccagcuggucgcgcagcgcagaugcgaggacaucgacgagugccaggaccccgacacauguucgcaguugugugucaaccuugaaggaggguacaagugccagugcgaggagggauuucagcuugacccgcacacgaaagcauguaaagcggugggguccauugcguauuuguuuuucacaaacagacaugaagugcggaagaugacccuugaucgcagcgaauauacgucacugaucccuaaucuuaggaaugucguggcccuugacacggagguagcaucaaauagaaucuacugguccgaccucucacagagaaugaucuguucaacacaguuggaucgggcgcacggggugucgucguacgauacgguaauuagccgcgacauccaggcgccagacggacucgcggucgacuggauccauagcaacaucuacuggacagacuccguguugggaaccguauccguagcugacacaaagggagugaagcggaaaacucuuuuuagagagaacggcagcaaaccgagagcaaucguggucgauccggugcauggauucauguauuggaccgauuggggaacgccagccaaaaucaagaaaggcgguuugaauggggucgacaucuacucgcuggugacugagaauauucaguggccaaacgggaucaccuuggacuuguugucggggagguuguauuggguggacucaaagcuccacucgaucagcucgaucgacgugaacggcggaaauaggaaaacuauucucgaagaugagaaaagacuggcccaccccuucucgcucgcgguguucgaggacaaaguauuuuggacagacaucaucaacgaagcgaucuuuucagccaaccgccugacagggucggaugucaaucucuuggccgaaaaccuucugagcccggaagauauggucuuguuucacaauuugacccaacccagaggugugaauuggugcgaacggacgacauugucgaacggagguugccaguaucucugucucccugcaccccagauuaauccccauucacccaaguucacgugugcgugcccagacggaaugcuucuugcgagggacaugagauccugucucaccgaagcggaagcggcaguggccacacaagagacuucgacuguccgccuuaaaguguccucgacggcgguccgaacucagcauacgaccacacgacccgugcccgauaccucgcgguugcccggagcaacaccgggguugacgacaguagaaaucguaaccaugagccaccaggcacuuggagaugucgcaggcagaggcaaugagaagaaacccagcucggucagagcccucagcaucgugcugccuauugugcugcuuguguuucucuguuuggguguguucuuguuguggaagaacuggcgccuuaagaauaucaacucgauuaacuucgauaauccgguauaccagaaaaccacagaggaugaagugcauauuugucacaaccaagauggcuauucguacccguccaggcaaaugguaucacuugaggacgacguggccugauaauaggcugccuucugcggggcuugccuucuggccaugcccuucuucucucccuugcaccuguaccucuuggucuuugaauaaagccugaguaggaag

SEQ ID NO: 69 - RNA, 2729 nt, Artificial Sequence
  Description of Artificial Sequence: Synthetic Transcript Sequence
gggaaauaagagagaaaagaagaguaagaagaaauauaagagccaccauggguccguggggcuggaagcuuagauggacagucgcgcuccuccuugcagcagcaggaacugcggucggagaucgaugcgagcgcaacgaguuccaaugccaagaugggaaguguauuucguacaagugggucugcgauggaucagcggaaugucaggacggaagcgaugagagccaagaaacaugccucucagugacaugcaagucgggagacuucucgugcggaggacgcguaaacagauguauuccacaguuuuggcgcugcgauggucagguggacugcgacaacgguucagaugaacagggauguccuccgaaaacgugcucacaagacgaguuucgcugccaugauggaaagugcauuucgcggcaguucguaugugauucggaucgggacugucuggacggcucggacgaagcgucaugcccgguacuuacuugcgggccagccucauuccaaugcaacagcucaacgugcauuccccagcugugggccugugacaaugauccugauugugaggacgguagcgacgaguggccgcagagauguagggguuuguacguauuccaaggagacucaagccccuguuccgccuuugaguuucacugccugucgggugaaugcauccacuccagcuggcgaugugauggugggcccgacugcaaagauaagagcgacgaggagaauugcgcggucgcgacgugcagacccgaugaguuccagugcuccgauggaaacugcauccacgggagccggcagugugaucgcgaguacgauuguaaagacaugucagacgaggucggaugcgugaacgucacguugugcgaggguccgaacaaguuuaagugccauucgggcgaauguauuacgcucgauaaagucugcaacauggcgcgagauuguagggauuggucagacgaacccaucaaggagugcggcacugcagcauguuuggacaauaacggcggguguucgcacgucugcaaugcacucaaaauuggggcagagugucucuguccugacggauuccagcuggucgcgcagcgcagaugcgaggacaucgacgagugccaggaccccgacacauguucgcaguugugugucaaccuugaaggaggguacaagugccagugcgaggagggauuucagcuugacccgcacacgaaagcauguaaagcggugggguccauugcguauuuguuuuucacaaacagacaugaagugcggaagaugacccuugaucgcagcgaauauacgucacugaucccuaaucuuaggaaugucguggcccuugacacggagguagcaucaaauagaaucuacugguccgaccucucacagagaaugaucuguucaacacaguuggaucgggcgcacggggugucgucguacgauacgguaauuagccgcgacauccaggcgccagacggacucgcggucgacuggauccauagcaacaucuacuggacagacuccguguugggaaccguauccguagcugacacaaagggagugaagcggaaaacucuuuuuagagagaacggcagcaaaccgagagcaaucguggucgauccggugcauggauucauguauuggaccgauuggggaacgccagccaaaaucaagaaaggcgguuugaauggggucgacaucuacucgcuggugacugagaauauucaguggccaaacgggaucaccuuggacuuguugucggggagguuguauuggguggacucaaagcuccacucgaucagcucgaucgacgugaacggcggaaauaggaaaacuauucucgaagaugagaaaagacuggcccaccccuucucgcucgcgguguucgaggacaaaguauuuuggacagacaucaucaacgaagcgaucuuuucagccaaccgccugacagggucggaugucaaucucuuggccgaaaaccuucugagcccggaagauauggucuuguuucacaauuugacccaacccagaggugugaauuggugcgaacggacgacauugucgaacggagguugccaguaucucugucucccugcaccccagauuaauccccauucacccaaguucacgugugcgugcccagacggaaugcuucuugcgagggacaugagauccugucucaccgaagcggaagcggcaguggccacacaagagacuucgacuguccgccuuaaaguguccucgacggcgguccgaacucagcauacgaccacacgacccgugcccgauaccucgcgguugcccggagcaacaccgggguugacgacaguagaaaucguaaccaugagccaccaggcacuuggagaugucgcaggcagaggcaaugagaagaaacccagcucggucagagcccucagcaucgugcugccuauugugcugcuuguguuucucuguuuggguguguucuuguuguggaagaacuggcgccuuaagaauaucaacucgauuaacuucgauaauccgguauaccagaaaaccacagaggaugaagugcauauuugucacaaccaagauggcuauucguacccguccaggcaaaugguaucacuugaggacgacguggccugauaauaggcugccuucugcggggcuugccuucuggccaugcccuucuucucucccuugcaccuguaccucuuggucuuugaauaaagccugaguaggaag

SEQ ID NO: 70 - DNA, 2076 bp, Artificial Sequence
  Description of Artificial Sequence: Synthetic Transcript Sequence
atgggcccctggggctggaagctgcgctggaccgtggccctgctgctggccgccgccggcaccgccgtgggcgaccgctgcgagcgcaacgagttccagtgccaggacggcaagtgcatcagctacaagtgggtgtgcgacggcagcgccgagtgccaggacggcagcgacgagagccaggagacctgcctgagcgtgacctgcaagagcggcgacttcagctgcggcggccgcgtgaaccgctgcatcccccagttctggcgctgcgacggccaggtggactgcgacaacggcagcgacgagcagggctgcctgaccctgtgcgagggccccaacaagttcaagtgccacagcggcgagtgcatcaccctggacaaggtgtgcaacatggcccgcgactgccgcgactggagcgacgagcccatcaaggagtgcggcaccaacgagtgcctggacaacaacggcggctgcagccacgtgtgcaacgacctgaagatcggctacgagtgcctgtgccccgacggcttccagctggtggcccagcgccgctgcgaggacatcgacgagtgccaggaccccgacacctgcagccagctgtgcgtgaacctggagggcggctacaagtgccagtgcgaggagggcttccagctggacccccacaccaaggcctgcaaggccgtgggcagcatcgcctacctgttcttcaccaaccgccacgaggtgcgcaagatgaccctggaccgcagcgagtacaccagcctgatccccaacctgcgcaacgtggtggccctggacaccgaggtggccagcaaccgcatctactggagcgacctgagccagcgcatgatctgcagcacccagctggaccgcgcccacggcgtgagcagctacgacaccgtgatcagccgcgacatccaggcccccgacggcctggccgtggactggatccacagcaacatctactggaccgacagcgtgctgggcaccgtgagcgtggccgacaccaagggcgtgaagcgcaagaccctgttccgcgagaacggcagcaagccccgcgccatcgtggtggaccccgtgcacggcttcatgtactggaccgactggggcacccccgccaagatcaagaagggcggcctgaacggcgtggacatctacagcctggtgaccgagaacatccagtggcccaacggcatcaccctggacctgctgagcggccgcctgtactgggtggacagcaagctgcacagcatcagcagcatcgacgtgaacggcggcaaccgcaagaccatcctggaggacgagaagcgcctggcccaccccttcagcctggccgtgttcgaggacaaggtgttctggaccgacatcatcaacgaggccatcttcagcgccaaccgcctgaccggcagcgacgtgaacctgctggccgagaacctgctgagccccgaggacatggtgctgttccacaacctgacccagccccgcggcgtgaactggtgcgagcgcaccaccctgagcaacggcggctgccagtacctgtgcctgcccgccccccagatcaacccccacagccccaagttcacctgcgcctgccccgacggcatgctgctggcccgcgacatgcgcagctgcctgaccgaggccgaggccgccgtggccacccaggagaccagcaccgtgcgcctgaaggtgagcagcaccgccgtgcgcacccagcacaccaccacccgccccgtgcccgacaccagccgcctgcccggcgccacccccggcctgaccaccgtggagatcgtgaccatgagccaccaggccctgggcgacgtggccggccgcggcaacgagaagaagcccagcagcgtgcgcgccctgagcatcgtgctgcccatcgtgctgctggtgttcctgtgcctgggcgtgttcctgctgtggaagaactggcgcctgaagaacatcaacagcatcaacttcgacaaccccgtgtaccagaagaccaccgaggacgaggtgcacatctgccacaaccaggacggctacagctaccccagccgccagatggtgagcctggaggacgacgtggcc

SEQ ID NO: 71 - DNA, 2457 bp, Artificial Sequence
  Description of Artificial Sequence: Synthetic Transcript Sequence
atgggcccctggggctggaagctgcgctggaccgtggccctgctgctggccgccgccggcaccgccgtgggcgaccgctgcgagcgcaacgagttccagtgccaggacggcaagtgcatcagctacaagtgggtgtgcgacggcagcgccgagtgccaggacggcagcgacgagagccaggagacctgcagccccaagacctgcagccaggacgagttccgctgccacgacggcaagtgcatcagccgccagttcgtgtgcgacagcgaccgcgactgcctggacggcagcgacgaggccagctgccccgtgctgacctgcggccccgccagcttccagtgcaacagcagcacctgcatcccccagctgtgggcctgcgacaacgaccccgactgcgaggacggcagcgacgagtggccccagcgctgccgcggcctgtacgtgttccagggcgacagcagcccctgcagcgccttcgagttccactgcctgagcggcgagtgcatccacagcagctggcgctgcgacggcggccccgactgcaaggacaagagcgacgaggagaactgcgccgtggccacctgccgccccgacgagttccagtgcagcgacggcaactgcatccacggcagccgccagtgcgaccgcgagtacgactgcaaggacatgagcgacgaggtgggctgcgtgaacgtgaccctgtgcgagggccccaacaagttcaagtgccacagcggcgagtgcatcaccctggacaaggtgtgcaacatggcccgcgactgccgcgactggagcgacgagcccatcaaggagtgcggcaccaacgagtgcctggacaacaacggcggctgcagccacgtgtgcaacgacctgaagatcggctacgagtgcctgtgccccgacggcttccagctggtggcccagcgccgctgcgaggacatcgacgagtgccaggaccccgacacctgcagccagctgtgcgtgaacctggagggcggctacaagtgccagtgcgaggagggcttccagctggacccccacaccaaggcctgcaaggccgtgggcagcatcgcctacctgttcttcaccaaccgccacgaggtgcgcaagatgaccctggaccgcagcgagtacaccagcctgatccccaacctgcgcaacgtggtggccctggacaccgaggtggccagcaaccgcatctactggagcgacctgagccagcgcatgatctgcagcacccagctggaccgcgcccacggcgtgagcagctacgacaccgtgatcagccgcgacatccaggcccccgacggcctggccgtggactggatccacagcaacatctactggaccgacagcgtgctgggcaccgtgagcgtggccgacaccaagggcgtgaagcgcaagaccctgttccgcgagaacggcagcaagccccgcgccatcgtggtggaccccgtgcacggcttcatgtactggaccgactggggcacccccgccaagatcaagaagggcggcctgaacggcgtggacatctacagcctggtgaccgagaacatccagtggcccaacggcatcaccctggacctgctgagcggccgcctgtactgggtggacagcaagctgcacagcatcagcagcatcgacgtgaacggcggcaaccgcaagaccatcctggaggacgagaagcgcctggcccaccccttcagcctggccgtgttcgaggacaaggtgttctggaccgacatcatcaacgaggccatcttcagcgccaaccgcctgaccggcagcgacgtgaacctgctggccgagaacctgctgagccccgaggacatggtgctgttccacaacctgacccagccccgcggcgtgaactggtgcgagcgcaccaccctgagcaacggcggctgccagtacctgtgcctgcccgccccccagatcaacccccacagccccaagttcacctgcgcctgccccgacggcatgctgctggcccgcgacatgcgcagctgcctgaccgaggccgaggccgccgtggccacccaggagaccagcaccgtgcgcctgaaggtgagcagcaccgccgtgcgcacccagcacaccaccacccgccccgtgcccgacaccagccgcctgcccggcgccacccccggcctgaccaccgtggagatcgtgaccatgagccaccaggccctgggcgacgtggccggccgcggcaacgagaagaagcccagcagcgtgcgcgccctgagcatcgtgctgcccatcgtgctgctggtgttcctgtgcctgggcgtgttcctgctgtggaagaactggcgcctgaagaacatcaacagcatcaacttcgacaaccccgtgtaccagaagaccaccgaggacgaggtgcacatctgccacaaccaggacggctacagctaccccagccgccagatggtgagcctggaggacgacgtggcc

SEQ ID NO: 72 - DNA, 2046 bp, Artificial Sequence
  Description of Artificial Sequence: Synthetic Transcript Sequence
atgggcccctggggctggaagctgcgctggaccgtggccctgctgctggccgccgccggcaccgccgtgggcgaccgctgcgagcgcaacgagttccagtgccaggacggcaagtgcatcagctacaagtgggtgtgcgacggcagcgccgagtgccaggacggcagcgacgagagccaggagacctgcctgagcgtgacctgcaagagcggcgacttcagctgcggcggccgcgtgaaccgctgcatcccccagttctggcgctgcgacggccaggtggactgcgacaacggcagcgacgagcagggctgccccgtggccacctgccgccccgacgagttccagtgcagcgacggcaactgcatccacggcagccgccagtgcgaccgcgagtacgactgcaaggacatgagcgacgaggtgggctgcgtgaacgtgaccctgtgcgagggccccaacaagttcaagtgccacagcggcgagtgcatcaccctggacaaggtgtgcaacatggcccgcgactgccgcgactggagcgacgagcccatcaaggagtgcggcaccaacgagtgcctggacaacaacggcggctgcagccacgtgtgcaacgacctgaagatcggctacgagtgcctgtgccccgacggcttccagctggtggcccagcgccgctgcgaggacatcgacgagtgccaggaccccgacacctgcagccagctgtgcgtgaacctggagggcggctacaagtgccagtgcgaggagggcttccagctggacccccacaccaaggcctgcaaggccgtgggcagcatcgcctacctgttcttcaccaaccgccacgaggtgcgcaagatgaccctggaccgcagcgagtacaccagcctgatccccaacctgcgcaacgtggtggccctggacaccgaggtggccagcaaccgcatctactggagcgacctgagccagcgcatgatctgcagcacccagctggaccgcgcccacggcgtgagcagctacgacaccgtgatcagccgcgacatccaggcccccgacggcctggccgtggactggatccacagcaacatctactggaccgacagcgtgctgggcaccgtgagcgtggccgacaccaagggcgtgaagcgcaagaccctgttccgcgagaacggcagcaagccccgcgccatcgtggtggaccccgtgcacggcttcatgtactggaccgactggggcacccccgccaagatcaagaagggcggcctgaacggcgtggacatctacagcctggtgaccgagaacatccagtggcccaacggcatcaccctggacctgctgagcggccgcctgtactgggtggacagcaagctgcacagcatcagcagcatcgacgtgaacggcggcaaccgcaagaccatcctggaggacgagaagcgcctggcccaccccttcagcctggccgtgttcgaggacaaggtgttctggaccgacatcatcaacgaggccatcttcagcgccaaccgcctgaccggcagcgacgtgaacctgctggccgagaacctgctgagccccgaggacatggtgctgttccacaacctgacccagccccgcgaggccgaggccgccgtggccacccaggagaccagcaccgtgcgcctgaaggtgagcagcaccgccgtgcgcacccagcacaccaccacccgccccgtgcccgacaccagccgcctgcccggcgccacccccggcctgaccaccgtggagatcgtgaccatgagccaccaggccctgggcgacgtggccggccgcggcaacgagaagaagcccagcagcgtgcgcgccctgagcatcgtgctgcccatcgtgctgctggtgttcctgtgcctgggcgtgttcctgctgtggaagaactggcgcctgaagaacatcaacagcatcaacttcgacaaccccgtgtaccagaagaccaccgaggacgaggtgcacatctgccacaaccaggacggctacagctaccccagccgccagatggtgagcctggaggacgacgtggcc

SEQ ID NO: 73 - DNA, 2574 bp, Artificial Sequence
  Description of Artificial Sequence: Synthetic Transcript Sequence
atgggcccctggggctggaagctgcgctggaccgtggccctgctgctggccgccgccggcaccgccgtgggcgaccgctgcgagcgcaacgagttccagtgccaggacggcaagtgcatcagctacaagtgggtgtgcgacggcagcgccgagtgccaggacggcagcgacgagagccaggagacctgcctgagcgtgacctgcaagagcggcgacttcagctgcggcggccgcgtgaaccgctgcatcccccagttctggcgctgcgacggccaggtggactgcgacaacggcagcgacgagcagggctgcccccccaagacctgcagccaggacgagttccgctgccacgacggcaagtgcatcagccgccagttcgtgtgcgacagcgaccgcgactgcctggacggcagcgacgaggccagctgccccgtgctgacctgcggccccgccagcttccagtgcaacagcagcacctgcatcccccagctgtgggcctgcgacaacgaccccgactgcgaggacggcagcgacgagtggccccagcgctgccgcggcctgtacgtgttccagggcgacagcagcccctgcagcgccttcgagttccactgcctgagcggcgagtgcatccacagcagctggcgctgcgacggcggccccgactgcaaggacaagagcgacgaggagaactgcgccgtggccacctgccgccccgacgagttccagtgcagcgacggcaactgcatccacggcagccgccagtgcgaccgcgagtacgactgcaaggacatgagcgacgaggtgggctgcgtgaacgtgaccctgtgcgagggccccaacaagttcaagtgccacagcggcgagtgcatcaccctggacaaggtgtgcaacatggcccgcgactgccgcgactggagcgacgagcccatcaaggagtgcggcaccaacgagtgcctggacaacaacggcggctgcagccacgtgtgcaacgacctgaagatcggctacgagtgcctgtgccccgacggcttccagctggtggcccagcgccgctgcgaggacatcgacgagtgccaggaccccgacacctgcagccagctgtgcgtgaacctggagggcggctacaagtgccagtgcgaggagggcttccagctggacccccacaccaaggcctgcaaggccgtgggcagcatcgcctacctgttcttcaccaaccgccacgaggtgcgcaagatgaccctggaccgcagcgagtacaccagcctgatccccaacctgcgcaacgtggtggccctggacaccgaggtggccagcaaccgcatctactggagcgacctgagccagcgcatgatctgcagcacccagctggaccgcgcccacggcgtgagcagctacgacaccgtgatcagccgcgacatccaggcccccgacggcctggccgtggactggatccacagcaacatctactggaccgacagcgtgctgggcaccgtgagcgtggccgacaccaagggcgtgaagcgcaagaccctgttccgcgagaacggcagcaagccccgcgccatcgtggtggaccccgtgcacggcttcatgtactggaccgactggggcacccccgccaagatcaagaagggcggcctgaacggcgtggacatctacagcctggtgaccgagaacatccagtggcccaacggcatcaccctggacctgctgagcggccgcctgtactgggtggacagcaagctgcacagcatcagcagcatcgacgtgaacggcggcaaccgcaagaccatcctggaggacgagaagcgcctggcccaccccttcagcctggccgtgttcgaggacaaggtgttctggaccgacatcatcaacgaggccatcttcagcgccaaccgcctgaccggcagcgacgtgaacctgctggccgagaacctgctgagccccgaggacatggtgctgttccacaacctgacccagccccgcggcgtgaactggtgcgagcgcaccaccctgagcaacggcggctgccagtacctgtgcctgcccgccccccagatcaacccccacagccccaagttcacctgcgcctgccccgacggcatgctgctggcccgcgacatgcgcagctgcctgaccgaggccgaggccgccgtggccacccaggagaccagcaccgtgcgcctgaaggtgagcagcaccgccgtgcgcacccagcacaccaccacccgccccgtgcccgacaccagccgcctgcccggcgccacccccggcctgaccaccgtggagatcgtgaccatgagccaccaggccctgggcgacgtggccggccgcggcaacgagaagaagcccagcagcgtgcgcgccctgagcatcgtgctgcccatcgtgctgctggtgttcctgtgcctgggcgtgttcctgctgtggaagaactggcgcctgaagaacatcaacagcatcaacttcgacaaccccgtgtaccagaagaccaccgaggacgaggtgcacatctgccacaaccaggacggctacagctaccccagcatggtgagcctggaggacgacgtggcc

SEQ ID NO: 74 - DNA, 2580 bp, Artificial Sequence
  Description of Artificial Sequence: Synthetic Transcript Sequence
atgggcccctggggctggaagctgcgctggaccgtggccctgctgctggccgccgccggcaccgccgtgggcgaccgctgcgagcgcaacgagttccagtgccaggacggcaagtgcatcagctacaagtgggtgtgcgacggcagcgccgagtgccaggacggcagcgacgagagccaggagacctgcctgagcgtgacctgcaagagcggcgacttcagctgcggcggccgcgtgaaccgctgcatcccccagttctggcgctgcgacggccaggtggactgcgacaacggcagcgacgagcagggctgcccccccaagacctgcagccaggacgagttccgctgccacgacggcaagtgcatcagccgccagttcgtgtgcgacagcgaccgcgactgcctggacggcagcgacgaggccagctgccccgtgctgacctgcggccccgccagcttccagtgcaacagcagcacctgcatcccccagctgtgggcctgcgacaacgaccccgactgcgaggacggcagcgacgagtggccccagcgctgccgcggcctgtacgtgttccagggcgacagcagcccctgcagcgccttcgagttccactgcctgagcggcgagtgcatccacagcagctggcgctgcgacggcggccccgactgcaaggacaagagcgacgaggagaactgcgccgtggccacctgccgccccgacgagttccagtgcagcgacggcaactgcatccacggcagccgccagtgcgaccgcgagtacgactgcaaggacatgagcgacgaggtgggctgcgtgaacgtgaccctgtgcgagggccccaacaagttcaagtgccacagcggcgagtgcatcaccctggacaaggtgtgcaacatggcccgcgactgccgcgactggagcgacgagcccatcaaggagtgcggcaccaacgagtgcctggacaacaacggcggctgcagccacgtgtgcaacgacctgaagatcggctacgagtgcctgtgccccgacggcttccagctggtggcccagcgccgctgcgaggacatcgacgagtgccaggaccccgacacctgcagccagctgtgcgtgaacctggagggcggctacaagtgccagtgcgaggagggcttccagctggacccccacaccaaggcctgcaaggccgtgggcagcatcgcctacctgttcttcaccaaccgccacgaggtgcgcaagatgaccctggaccgcagcgagtacaccagcctgatccccaacctgcgcaacgtggtggccctggacaccgaggtggccagcaaccgcatctactggagcgacctgagccagcgcatgatctgcagcacccagctggaccgcgcccacggcgtgagcagctacgacaccgtgatcagccgcgacatccaggcccccgacggcctggccgtggactggatccacagcaacatctactggaccgacagcgtgctgggcaccgtgagcgtggccgacaccaagggcgtgaagcgcaagaccctgttccgcgagaacggcagcaagccccgcgccatcgtggtggaccccgtgcacggcttcatgtactggaccgactggggcacccccgccaagatcaagaagggcggcctgaacggcgtggacatctacagcctggtgaccgagaacatccagtggcccaacggcatcaccctggacctgctgagcggccgcctgtactgggtggacagcaagctgcacagcatcagcagcatcgacgtgaacggcggcaaccgcaagaccatcctggaggacgagaagcgcctggcccaccccttcagcctggccgtgttcgaggacaaggtgttctggaccgacatcatcaacgaggccatcttcagcgccaaccgcctgaccggcagcgacgtgaacctgctggccgagaacctgctgagccccgaggacatggtgctgttccacaacctgacccagccccgcggcgtgaactggtgcgagcgcaccaccctgagcaacggcggctgccagtacctgtgcctgcccgccccccagatcaacccccacagccccaagttcacctgcgcctgccccgacggcatgctgctggcccgcgacatgcgcagctgcctgaccgaggccgaggccgccgtggccacccaggagaccagcaccgtgcgcctgaaggtgagcagcaccgccgtgcgcacccagcacaccaccacccgccccgtgcccgacaccagccgcctgcccggcgccacccccggcctgaccaccgtggagatcgtgaccatgagccaccaggccctgggcgacgtggccggccgcggcaacgagaagaagcccagcagcgtgcgcgccctgagcatcgtgctgcccatcgtgctgctggtgttcctgtgcctgggcgtgttcctgctgtggaagaactggcgcctgaagaacatcaacagcatcaacttcgacaaccccgtgtaccagaagaccaccgaggacgaggtgcacatctgccacaaccaggacggctacagctaccccagccgccagatggtgagcctggaggacgacgtggcc

SEQ ID NO: 75 - DNA, 2079 bp, Artificial Sequence
  Description of Artificial Sequence: Synthetic Transcript Sequence
atgggcccctggggctggaagctgagatggaccgtggccctgctgctggccgccgccggcaccgccgtgggcgacagatgcgagagaaacgagttccagtgccaggacggcaagtgcatcagctacaagtgggtgtgcgacggcagcgccgagtgccaggacggcagcgacgagagccaggagacctgcctgagcgtgacctgcaagagcggcgacttcagctgcggcggcagagtgaacagatgcatcccccagttctggagatgcgacggccaggtggactgcgacaacggcagcgacgagcagggctgcctgaccctgtgcgagggccccaacaagttcaagtgccacagcggcgagtgcatcaccctggacaaggtgtgcaacatggccagagactgcagagactggagcgacgagcccatcaaggagtgcggcaccaacgagtgcctggacaacaacggcggctgcagccacgtgtgcaacgacctgaagatcggctacgagtgcctgtgccccgacggcttccagctggtggcccagagaagatgcgaggacatcgacgagtgccaggaccccgacacctgcagccagctgtgcgtgaacctggagggcggctacaagtgccagtgcgaggagggcttccagctggacccccacaccaaggcctgcaaggccgtgggcagcatcgcctacctgttcttcaccaacagacacgaggtgagaaagatgaccctggacagaagcgagtacaccagcctgatccccaacctgagaaacgtggtggccctggacaccgaggtggccagcaacagaatctactggagcgacctgagccagagaatgatctgcagcacccagctggacagagcccacggcgtgagcagctacgacaccgtgatcagcagagacatccaggcccccgacggcctggccgtggactggatccacagcaacatctactggaccgacagcgtgctgggcaccgtgagcgtggccgacaccaagggcgtgaagagaaagaccctgttcagagagaacggcagcaagcccagagccatcgtggtggaccccgtgcacggcttcatgtactggaccgactggggcacccccgccaagatcaagaagggcggcctgaacggcgtggacatctacagcctggtgaccgagaacatccagtggcccaacggcatcaccctggacctgctgagcggcagactgtactgggtggacagcaagctgcacagcatcagcagcatcgacgtgaacggcggcaacagaaagaccatcctggaggacgagaagagactggcccaccccttcagcctggccgtgttcgaggacaaggtgttctggaccgacatcatcaacgaggccatcttcagcgccaacagactgaccggcagcgacgtgaacctgctggccgagaacctgctgagccccgaggacatggtgctgttccacaacctgacccagcccagaggcgtgaactggtgcgagagaaccaccctgagcaacggcggctgccagtacctgtgcctgcccgccccccagatcaacccccacagccccaagttcacctgcgcctgccccgacggcatgctgctggccagagacatgagaagctgcctgaccgaggccgaggccgccgtggccacccaggagaccagcaccgtgagactgaaggtgagcagcaccgccgtgagaacccagcacaccaccaccagacccgtgcccgacaccagcagactgcccggcgccacccccggcctgaccaccgtggagatcgtgaccatgagccaccaggccctgggcgacgtggccggcagaggcaacgagaagaagcccagcagcgtgagagccctgagcatcgtgctgcccatcgtgctgctggtgttcctgtgcctgggcgtgttcctgctgtggaagaactggagactgaagaacatcaacagcatcaacttcgacaaccccgtgtaccagaagaccaccgaggacgaggtgcacatctgccacaaccaggacggctacagctaccccagcagacagatggtgagcctggaggacgacgtggcctag

SEQ ID NO: 76 - DNA, 2460 bp, Artificial Sequence
  Description of Artificial Sequence: Synthetic Transcript Sequence
atgggcccctggggctggaagctgagatggaccgtggccctgctgctggccgccgccggcaccgccgtgggcgacagatgcgagagaaacgagttccagtgccaggacggcaagtgcatcagctacaagtgggtgtgcgacggcagcgccgagtgccaggacggcagcgacgagagccaggagacctgcagccccaagacctgcagccaggacgagttcagatgccacgacggcaagtgcatcagcagacagttcgtgtgcgacagcgacagagactgcctggacggcagcgacgaggccagctgccccgtgctgacctgcggccccgccagcttccagtgcaacagcagcacctgcatcccccagctgtgggcctgcgacaacgaccccgactgcgaggacggcagcgacgagtggccccagagatgcagaggcctgtacgtgttccagggcgacagcagcccctgcagcgccttcgagttccactgcctgagcggcgagtgcatccacagcagctggagatgcgacggcggccccgactgcaaggacaagagcgacgaggagaactgcgccgtggccacctgcagacccgacgagttccagtgcagcgacggcaactgcatccacggcagcagacagtgcgacagagagtacgactgcaaggacatgagcgacgaggtgggctgcgtgaacgtgaccctgtgcgagggccccaacaagttcaagtgccacagcggcgagtgcatcaccctggacaaggtgtgcaacatggccagagactgcagagactggagcgacgagcccatcaaggagtgcggcaccaacgagtgcctggacaacaacggcggctgcagccacgtgtgcaacgacctgaagatcggctacgagtgcctgtgccccgacggcttccagctggtggcccagagaagatgcgaggacatcgacgagtgccaggaccccgacacctgcagccagctgtgcgtgaacctggagggcggctacaagtgccagtgcgaggagggcttccagctggacccccacaccaaggcctgcaaggccgtgggcagcatcgcctacctgttcttcaccaacagacacgaggtgagaaagatgaccctggacagaagcgagtacaccagcctgatccccaacctgagaaacgtggtggccctggacaccgaggtggccagcaacagaatctactggagcgacctgagccagagaatgatctgcagcacccagctggacagagcccacggcgtgagcagctacgacaccgtgatcagcagagacatccaggcccccgacggcctggccgtggactggatccacagcaacatctactggaccgacagcgtgctgggcaccgtgagcgtggccgacaccaagggcgtgaagagaaagaccctgttcagagagaacggcagcaagcccagagccatcgtggtggaccccgtgcacggcttcatgtactggaccgactggggcacccccgccaagatcaagaagggcggcctgaacggcgtggacatctacagcctggtgaccgagaacatccagtggcccaacggcatcaccctggacctgctgagcggcagactgtactgggtggacagcaagctgcacagcatcagcagcatcgacgtgaacggcggcaacagaaagaccatcctggaggacgagaagagactggcccaccccttcagcctggccgtgttcgaggacaaggtgttctggaccgacatcatcaacgaggccatcttcagcgccaacagactgaccggcagcgacgtgaacctgctggccgagaacctgctgagccccgaggacatggtgctgttccacaacctgacccagcccagaggcgtgaactggtgcgagagaaccaccctgagcaacggcggctgccagtacctgtgcctgcccgccccccagatcaacccccacagccccaagttcacctgcgcctgccccgacggcatgctgctggccagagacatgagaagctgcctgaccgaggccgaggccgccgtggccacccaggagaccagcaccgtgagactgaaggtgagcagcaccgccgtgagaacccagcacaccaccaccagacccgtgcccgacaccagcagactgcccggcgccacccccggcctgaccaccgtggagatcgtgaccatgagccaccaggccctgggcgacgtggccggcagaggcaacgagaagaagcccagcagcgtgagagccctgagcatcgtgctgcccatcgtgctgctggtgttcctgtgcctgggcgtgttcctgctgtggaagaactggagactgaagaacatcaacagcatcaacttcgacaaccccgtgtaccagaagaccaccgaggacgaggtgcacatctgccacaaccaggacggctacagctaccccagcagacagatggtgagcctggaggacgacgtggcctag

SEQ ID NO: 77 - DNA, 2049 bp, Artificial Sequence
  Description of Artificial Sequence: Synthetic Transcript Sequence
atgggcccctggggctggaagctgagatggaccgtggccctgctgctggccgccgccggcaccgccgtgggcgacagatgcgagagaaacgagttccagtgccaggacggcaagtgcatcagctacaagtgggtgtgcgacggcagcgccgagtgccaggacggcagcgacgagagccaggagacctgcctgagcgtgacctgcaagagcggcgacttcagctgcggcggcagagtgaacagatgcatcccccagttctggagatgcgacggccaggtggactgcgacaacggcagcgacgagcagggctgccccgtggccacctgcagacccgacgagttccagtgcagcgacggcaactgcatccacggcagcagacagtgcgacagagagtacgactgcaaggacatgagcgacgaggtgggctgcgtgaacgtgaccctgtgcgagggccccaacaagttcaagtgccacagcggcgagtgcatcaccctggacaaggtgtgcaacatggccagagactgcagagactggagcgacgagcccatcaaggagtgcggcaccaacgagtgcctggacaacaacggcggctgcagccacgtgtgcaacgacctgaagatcggctacgagtgcctgtgccccgacggcttccagctggtggcccagagaagatgcgaggacatcgacgagtgccaggaccccgacacctgcagccagctgtgcgtgaacctggagggcggctacaagtgccagtgcgaggagggcttccagctggacccccacaccaaggcctgcaaggccgtgggcagcatcgcctacctgttcttcaccaacagacacgaggtgagaaagatgaccctggacagaagcgagtacaccagcctgatccccaacctgagaaacgtggtggccctggacaccgaggtggccagcaacagaatctactggagcgacctgagccagagaatgatctgcagcacccagctggacagagcccacggcgtgagcagctacgacaccgtgatcagcagagacatccaggcccccgacggcctggccgtggactggatccacagcaacatctactggaccgacagcgtgctgggcaccgtgagcgtggccgacaccaagggcgtgaagagaaagaccctgttcagagagaacggcagcaagcccagagccatcgtggtggaccccgtgcacggcttcatgtactggaccgactggggcacccccgccaagatcaagaagggcggcctgaacggcgtggacatctacagcctggtgaccgagaacatccagtggcccaacggcatcaccctggacctgctgagcggcagactgtactgggtggacagcaagctgcacagcatcagcagcatcgacgtgaacggcggcaacagaaagaccatcctggaggacgagaagagactggcccaccccttcagcctggccgtgttcgaggacaaggtgttctggaccgacatcatcaacgaggccatcttcagcgccaacagactgaccggcagcgacgtgaacctgctggccgagaacctgctgagccccgaggacatggtgctgttccacaacctgacccagcccagagaggccgaggccgccgtggccacccaggagaccagcaccgtgagactgaaggtgagcagcaccgccgtgagaacccagcacaccaccaccagacccgtgcccgacaccagcagactgcccggcgccacccccggcctgaccaccgtggagatcgtgaccatgagccaccaggccctgggcgacgtggccggcagaggcaacgagaagaagcccagcagcgtgagagccctgagcatcgtgctgcccatcgtgctgctggtgttcctgtgcctgggcgtgttcctgctgtggaagaactggagactgaagaacatcaacagcatcaacttcgacaaccccgtgtaccagaagaccaccgaggacgaggtgcacatctgccacaaccaggacggctacagctaccccagcagacagatggtgagcctggaggacgacgtggcctag

SEQ ID NO: 78 - DNA, 2577 bp, Artificial Sequence
  Description of Artificial Sequence: Synthetic Transcript Sequence
atgggcccctggggctggaagctgagatggaccgtggccctgctgctggccgccgccggcaccgccgtgggcgacagatgcgagagaaacgagttccagtgccaggacggcaagtgcatcagctacaagtgggtgtgcgacggcagcgccgagtgccaggacggcagcgacgagagccaggagacctgcctgagcgtgacctgcaagagcggcgacttcagctgcggcggcagagtgaacagatgcatcccccagttctggagatgcgacggccaggtggactgcgacaacggcagcgacgagcagggctgcccccccaagacctgcagccaggacgagttcagatgccacgacggcaagtgcatcagcagacagttcgtgtgcgacagcgacagagactgcctggacggcagcgacgaggccagctgccccgtgctgacctgcggccccgccagcttccagtgcaacagcagcacctgcatcccccagctgtgggcctgcgacaacgaccccgactgcgaggacggcagcgacgagtggccccagagatgcagaggcctgtacgtgttccagggcgacagcagcccctgcagcgccttcgagttccactgcctgagcggcgagtgcatccacagcagctggagatgcgacggcggccccgactgcaaggacaagagcgacgaggagaactgcgccgtggccacctgcagacccgacgagttccagtgcagcgacggcaactgcatccacggcagcagacagtgcgacagagagtacgactgcaaggacatgagcgacgaggtgggctgcgtgaacgtgaccctgtgcgagggccccaacaagttcaagtgccacagcggcgagtgcatcaccctggacaaggtgtgcaacatggccagagactgcagagactggagcgacgagcccatcaaggagtgcggcaccaacgagtgcctggacaacaacggcggctgcagccacgtgtgcaacgacctgaagatcggctacgagtgcctgtgccccgacggcttccagctggtggcccagagaagatgcgaggacatcgacgagtgccaggaccccgacacctgcagccagctgtgcgtgaacctggagggcggctacaagtgccagtgcgaggagggcttccagctggacccccacaccaaggcctgcaaggccgtgggcagcatcgcctacctgttcttcaccaacagacacgaggtgagaaagatgaccctggacagaagcgagtacaccagcctgatccccaacctgagaaacgtggtggccctggacaccgaggtggccagcaacagaatctactggagcgacctgagccagagaatgatctgcagcacccagctggacagagcccacggcgtgagcagctacgacaccgtgatcagcagagacatccaggcccccgacggcctggccgtggactggatccacagcaacatctactggaccgacagcgtgctgggcaccgtgagcgtggccgacaccaagggcgtgaagagaaagaccctgttcagagagaacggcagcaagcccagagccatcgtggtggaccccgtgcacggcttcatgtactggaccgactggggcacccccgccaagatcaagaagggcggcctgaacggcgtggacatctacagcctggtgaccgagaacatccagtggcccaacggcatcaccctggacctgctgagcggcagactgtactgggtggacagcaagctgcacagcatcagcagcatcgacgtgaacggcggcaacagaaagaccatcctggaggacgagaagagactggcccaccccttcagcctggccgtgttcgaggacaaggtgttctggaccgacatcatcaacgaggccatcttcagcgccaacagactgaccggcagcgacgtgaacctgctggccgagaacctgctgagccccgaggacatggtgctgttccacaacctgacccagcccagaggcgtgaactggtgcgagagaaccaccctgagcaacggcggctgccagtacctgtgcctgcccgccccccagatcaacccccacagccccaagttcacctgcgcctgccccgacggcatgctgctggccagagacatgagaagctgcctgaccgaggccgaggccgccgtggccacccaggagaccagcaccgtgagactgaaggtgagcagcaccgccgtgagaacccagcacaccaccaccagacccgtgcccgacaccagcagactgcccggcgccacccccggcctgaccaccgtggagatcgtgaccatgagccaccaggccctgggcgacgtggccggcagaggcaacgagaagaagcccagcagcgtgagagccctgagcatcgtgctgcccatcgtgctgctggtgttcctgtgcctgggcgtgttcctgctgtggaagaactggagactgaagaacatcaacagcatcaacttcgacaaccccgtgtaccagaagaccaccgaggacgaggtgcacatctgccacaaccaggacggctacagctaccccagcatggtgagcctggaggacgacgtggcctag

SEQ ID NO: 79 - DNA, 2838 bp, Artificial Sequence
  Description of Artificial Sequence: Synthetic Transcript Sequence
tgaggcagacccggcgtgccccccagattcctgagccagagaagaagacaggtgcccggccccagaagcagactgagagacatccacgagagccccagcgtgatcctgggcccccccggcgaggtgcccggcttcagatgcgccctgtggagacacctgagaccccacctggtgctgggcggcgccctggccccccccgcccccatcaagttcaccgagggcccccccgccaccctgaaggccagcgtgccctacgaggtggagaccctgccccagaacctgcccgcccccccctggagcgccgccgagatcttcagccacgtgggcgacagatgcgagagaaacgagttccagtgccaggacggcaagtgcatcagctacaagtgggtgtgcgacggcagcgccgagtgccaggacggcagcgacgagagccaggagacctgcctgagcgtgacctgcaagagcggcgacttcagctgcggcggcagagtgaacagatgcatcccccagttctggagatgcgacggccaggtggactgcgacaacggcagcgacgagcagggctgcccccccaagacctgcagccaggacgagttcagatgccacgacggcaagtgcatcagcagacagttcgtgtgcgacagcgacagagactgcctggacggcagcgacgaggccagctgccccgtgctgacctgcggccccgccagcttccagtgcaacagcagcacctgcatcccccagctgtgggcctgcgacaacgaccccgactgcgaggacggcagcgacgagtggccccagagatgcagaggcctgtacgtgttccagggcgacagcagcccctgcagcgccttcgagttccactgcctgagcggcgagtgcatccacagcagctggagatgcgacggcggccccgactgcaaggacaagagcgacgaggagaactgcgccgtggccacctgcagacccgacgagttccagtgcagcgacggcaactgcatccacggcagcagacagtgcgacagagagtacgactgcaaggacatgagcgacgaggtgggctgcgtgaacgtgaccctgtgcgagggccccaacaagttcaagtgccacagcggcgagtgcatcaccctggacaaggtgtgcaacatggccagagactgcagagactggagcgacgagcccatcaaggagtgcggcaccaacgagtgcctggacaacaacggcggctgcagccacgtgtgcaacgacctgaagatcggctacgagtgcctgtgccccgacggcttccagctggtggcccagagaagatgcgaggacatcgacgagtgccaggaccccgacacctgcagccagctgtgcgtgaacctggagggcggctacaagtgccagtgcgaggagggcttccagctggacccccacaccaaggcctgcaaggccgtgggcagcatcgcctacctgttcttcaccaacagacacgaggtgagaaagatgaccctggacagaagcgagtacaccagcctgatccccaacctgagaaacgtggtggccctggacaccgaggtggccagcaacagaatctactggagcgacctgagccagagaatgatctgcagcacccagctggacagagcccacggcgtgagcagctacgacaccgtgatcagcagagacatccaggcccccgacggcctggccgtggactggatccacagcaacatctactggaccgacagcgtgctgggcaccgtgagcgtggccgacaccaagggcgtgaagagaaagaccctgttcagagagaacggcagcaagcccagagccatcgtggtggaccccgtgcacggcttcatgtactggaccgactggggcacccccgccaagatcaagaagggcggcctgaacggcgtggacatctacagcctggtgaccgagaacatccagtggcccaacggcatcaccctggacctgctgagcggcagactgtactgggtggacagcaagctgcacagcatcagcagcatcgacgtgaacggcggcaacagaaagaccatcctggaggacgagaagagactggcccaccccttcagcctggccgtgttcgaggacaaggtgttctggaccgacatcatcaacgaggccatcttcagcgccaacagactgaccggcagcgacgtgaacctgctggccgagaacctgctgagccccgaggacatggtgctgttccacaacctgacccagcccagaggcgtgaactggtgcgagagaaccaccctgagcaacggcggctgccagtacctgtgcctgcccgccccccagatcaacccccacagccccaagttcacctgcgcctgccccgacggcatgctgctggccagagacatgagaagctgcctgaccgaggccgaggccgccgtggccacccaggagaccagcaccgtgagactgaaggtgagcagcaccgccgtgagaacccagcacaccaccaccagacccgtgcccgacaccagcagactgcccggcgccacccccggcctgaccaccgtggagatcgtgaccatgagccaccaggccctgggcgacgtggccggcagaggcaacgagaagaagcccagcagcgtgagagccctgagcatcgtgctgcccatcgtgctgctggtgttcctgtgcctgggcgtgttcctgctgtggaagaactggagactgaagaacatcaacagcatcaacttcgacaaccccgtgtaccagaagaccaccgaggacgaggtgcacatctgccacaaccaggacggctacagctaccccagcagacagatggtgagcctggaggacgacgtggcctag

SEQ ID NO: 80 - DNA, 2220 bp, Artificial Sequence
  Description of Artificial Sequence: Synthetic Transcript Sequence
atgggcccctggggctggaagctgagatggaccgtggccctgctgctggccgccgccggcaccgccgtgggcgacagatgcgagagaaacgacttccagtgcaacagcagcacctgcatcccccagctgtgggcctgcgacaacgaccccgactgcgaggacggcagcgacgagtggccccagagatgcagaggcctgtacgtgttccagggcgacagcagcccctgcagcgccttcgagttccactgcctgagcggcgagtgcatccacagcagctggagatgcgacggcggccccgactgcaaggacaagagcgacgaggagaactgcgccgtggccacctgcagacccgacgagttccagtgcagcgacggcaactgcatccacggcagcagacagtgcgacagagagtacgactgcaaggacatgagcgacgaggtgggctgcgtgaacgtgaccctgtgcgagggccccaacaagttcaagtgccacagcggcgagtgcatcaccctggacaaggtgtgcaacatggccagagactgcagagactggagcgacgagcccatcaaggagtgcggcaccaacgagtgcctggacaacaacggcggctgcagccacgtgtgcaacgacctgaagatcggctacgagtgcctgtgccccgacggcttccagctggtggcccagagaagatgcgaggacatcgacgagtgccaggaccccgacacctgcagccagctgtgcgtgaacctggagggcggctacaagtgccagtgcgaggagggcttccagctggacccccacaccaaggcctgcaaggccgtgggcagcatcgcctacctgttcttcaccaacagacacgaggtgagaaagatgaccctggacagaagcgagtacaccagcctgatccccaacctgagaaacgtggtggccctggacaccgaggtggccagcaacagaatctactggagcgacctgagccagagaatgatctgcagcacccagctggacagagcccacggcgtgagcagctacgacaccgtgatcagcagagacatccaggcccccgacggcctggccgtggactggatccacagcaacatctactggaccgacagcgtgctgggcaccgtgagcgtggccgacaccaagggcgtgaagagaaagaccctgttcagagagaacggcagcaagcccagagccatcgtggtggaccccgtgcacggcttcatgtactggaccgactggggcacccccgccaagatcaagaagggcggcctgaacggcgtggacatctacagcctggtgaccgagaacatccagtggcccaacggcatcaccctggacctgctgagcggcagactgtactgggtggacagcaagctgcacagcatcagcagcatcgacgtgaacggcggcaacagaaagaccatcctggaggacgagaagagactggcccaccccttcagcctggccgtgttcgaggacaaggtgttctggaccgacatcatcaacgaggccatcttcagcgccaacagactgaccggcagcgacgtgaacctgctggccgagaacctgctgagccccgaggacatggtgctgttccacaacctgacccagcccagaggcgtgaactggtgcgagagaaccaccctgagcaacggcggctgccagtacctgtgcctgcccgccccccagatcaacccccacagccccaagttcacctgcgcctgccccgacggcatgctgctggccagagacatgagaagctgcctgaccgaggccgaggccgccgtggccacccaggagaccagcaccgtgagactgaaggtgagcagcaccgccgtgagaacccagcacaccaccaccagacccgtgcccgacaccagcagactgcccggcgccacccccggcctgaccaccgtggagatcgtgaccatgagccaccaggccctgggcgacgtggccggcagaggcaacgagaagaagcccagcagcgtgagagccctgagcatcgtgctgcccatcgtgctgctggtgttcctgtgcctgggcgtgttcctgctgtggaagaactggagactgaagaacatcaacagcatcaacttcgacaaccccgtgtaccagaagaccaccgaggacgaggtgcacatctgccacaaccaggacggctacagctaccccagcagacagatggtgagcctggaggacgacgtggcctag

SEQ ID NO: 81 - DNA, 2583 bp, Artificial Sequence
  Description of Artificial Sequence: Synthetic Transcript Sequence
atgggcccctggggctggaagctgagatggaccgtggccctgctgctggccgccgccggcaccgccgtgggcgacagatgcgagagaaacgagttccagtgccaggacggcaagtgcatcagctacaagtgggtgtgcgacggcagcgccgagtgccaggacggcagcgacgagagccaggagacctgcctgagcgtgacctgcaagagcggcgacttcagctgcggcggcagagtgaacagatgcatcccccagttctggagatgcgacggccaggtggactgcgacaacggcagcgacgagcagggctgcccccccaagacctgcagccaggacgagttcagatgccacgacggcaagtgcatcagcagacagttcgtgtgcgacagcgacagagactgcctggacggcagcgacgaggccagctgccccgtgctgacctgcggccccgccagcttccagtgcaacagcagcacctgcatcccccagctgtgggcctgcgacaacgaccccgactgcgaggacggcagcgacgagtggccccagagatgcagaggcctgtacgtgttccagggcgacagcagcccctgcagcgccttcgagttccactgcctgagcggcgagtgcatccacagcagctggagatgcgacggcggccccgactgcaaggacaagagcgacgaggagaactgcgccgtggccacctgcagacccgacgagttccagtgcagcgacggcaactgcatccacggcagcagacagtgcgacagagagtacgactgcaaggacatgagcgacgaggtgggctgcgtgaacgtgaccctgtgcgagggccccaacaagttcaagtgccacagcggcgagtgcatcaccctggacaaggtgtgcaacatggccagagactgcagagactggagcgacgagcccatcaaggagtgcggcaccaacgagtgcctggacaacaacggcggctgcagccacgtgtgcaacgacctgaagatcggctacgagtgcctgtgccccgacggcttccagctggtggcccagagaagatgcgaggacatcgacgagtgccaggaccccgacacctgcagccagctgtgcgtgaacctggagggcggctacaagtgccagtgcgaggagggcttccagctggacccccacaccaaggcctgcaaggccgtgggcagcatcgcctacctgttcttcaccaacagacacgaggtgagaaagatgaccctggacagaagcgagtacaccagcctgatccccaacctgagaaacgtggtggccctggacaccgaggtggccagcaacagaatctactggagcgacctgagccagagaatgatctgcagcacccagctggacagagcccacggcgtgagcagctacgacaccgtgatcagcagagacatccaggcccccgacggcctggccgtggactggatccacagcaacatctactggaccgacagcgtgctgggcaccgtgagcgtggccgacaccaagggcgtgaagagaaagaccctgttcagagagaacggcagcaagcccagagccatcgtggtggaccccgtgcacggcttcatgtactggaccgactggggcacccccgccaagatcaagaagggcggcctgaacggcgtggacatctacagcctggtgaccgagaacatccagtggcccaacggcatcaccctggacctgctgagcggcagactgtactgggtggacagcaagctgcacagcatcagcagcatcgacgtgaacggcggcaacagaaagaccatcctggaggacgagaagagactggcccaccccttcagcctggccgtgttcgaggacaaggtgttctggaccgacatcatcaacgaggccatcttcagcgccaacagactgaccggcagcgacgtgaacctgctggccgagaacctgctgagccccgaggacatggtgctgttccacaacctgacccagcccagaggcgtgaactggtgcgagagaaccaccctgagcaacggcggctgccagtacctgtgcctgcccgccccccagatcaacccccacagccccaagttcacctgcgcctgccccgacggcatgctgctggccagagacatgagaagctgcctgaccgaggccgaggccgccgtggccacccaggagaccagcaccgtgagactgaaggtgagcagcaccgccgtgagaacccagcacaccaccaccagacccgtgcccgacaccagcagactgcccggcgccacccccggcctgaccaccgtggagatcgtgaccatgagccaccaggccctgggcgacgtggccggcagaggcaacgagaagaagcccagcagcgtgagagccctgagcatcgtgctgcccatcgtgctgctggtgttcctgtgcctgggcgtgttcctgctgtggaagaactggagactgaagaacatcaacagcatcaacttcgacaaccccgtgtaccagaagaccaccgaggacgaggtgcacatctgccacaaccaggacggctacagctaccccagcagacagatggtgagcctggaggacgacgtggcctag

SEQ ID NO: 82 - DNA, 2079 bp, Artificial Sequence
  Description of Artificial Sequence: Synthetic Transcript Sequence
atggggccatggggctggaagctgcgatggaccgtagccttgctactggctgcggccggcaccgccgtgggcgatcgctgtgagcgcaatgaattccagtgtcaggacggtaaatgcattagctacaaatgggtatgcgacgggagtgccgagtgtcaagatggatcagatgaaagccaggagacgtgcctgagcgtgacgtgtaaatcaggcgacttctcttgcggcggcagagttaatcgctgtatcccacagttttggcggtgcgacggtcaggtggattgcgataacggatccgatgagcagggctgtctgactttatgcgaaggacctaacaaatttaaatgtcattccggcgagtgcattaccctagacaaggtgtgtaatatggccagagattgcagggattggtctgacgaaccaataaaggagtgtggcaccaacgaatgtctggacaataatgggggttgttcacacgtgtgcaatgatctgaaaataggatacgagtgcctctgcccggatggcttccagctcgtggcacagaggagatgtgaggatatagatgagtgtcaggacccggatacctgttcccagctttgtgtcaacctggagggagggtacaagtgccagtgcgaggaggggtttcagctggacccccacacaaaagcgtgcaaagctgttggcagcatagcataccttttctttacaaacaggcacgaggtgagaaagatgacattagaccgcagcgaatacacctcacttatacccaatctaaggaacgtcgtcgccctggacacagaggtggctagtaacagaatttattggtcggatctgtctcaacgcatgatctgttcgacacagctggaccgcgctcatggcgttagctcatacgatactgtgatctcgcgggacattcaggcacctgatggcctcgccgtagactggatccatagtaatatttactggactgattctgtgttaggcaccgtttctgtggctgacaccaagggcgtcaagaggaagactctgtttagggagaatgggagcaaacccagagctattgtggtagatcccgttcatggattcatgtattggactgattgggggacgcccgcaaaaatcaagaagggcggactgaatggagtggatatttacagcctggtgactgagaatatccaatggccaaacggaatcaccctggaccttttgtccgggcgactttactgggtagacagtaaactccacagcatctcttctatcgatgtaaacggagggaatcgtaaaacgattctggaagacgagaagcgattggctcaccccttttcactggcagtcttcgaggacaaggtgttttggacggacatcatcaatgaggctattttcagcgccaatcgccttaccggttccgatgtaaatcttctagccgagaatcttttgtcaccagaagatatggtgctcttccataatttaactcagccaaggggcgtgaactggtgtgagaggaccaccctgtcaaacggcggatgccagtacctgtgcctcccagcccctcagatcaaccctcatagccccaagtttacttgtgcctgtcccgacggaatgctcttagctcgggacatgaggagttgcttgaccgaggcggaggcagccgttgccacccaggaaacttcgaccgtacgtcttaaagtcagttctaccgccgtccggacacagcacacaaccacccggcccgtacccgatactagtcggttgcccggggctacgcctggacttactaccgtggagattgtgaccatgtctcaccaggcgctgggcgacgtggccgggcggggaaatgaaaagaaaccatccagtgtcagggcactgtctatcgtgttaccaatagtgctgttggttttcttgtgtttgggagtgttcttgctttggaagaattggagactcaagaatataaattctataaatttcgataaccccgtctatcagaaaaccaccgaagacgaggtgcatatttgccacaaccaagacggctatagctacccaagccgccagatggtaagcctggaagacgatgtagcttag

SEQ ID NO: 83 - DNA, 2460 bp, Artificial Sequence
  Description of Artificial Sequence: Synthetic Transcript Sequence
atggggccctggggttggaagctgcgttggactgtggctttgctgctagctgctgccggaacagccgttggggatcggtgcgagcgcaacgaattccagtgtcaggacgggaaatgtatcagctacaaatgggtctgtgatggctccgctgagtgtcaggatggcagtgatgagtcacaagaaacctgctcaccgaagacgtgttctcaggatgaattcaggtgccacgacggcaagtgtatctcccgccagttcgtgtgcgatagtgaccgggactgcctagacggatccgacgaggcatcctgtccagtccttacttgcggcccagcgtcattccagtgtaactctagcacctgcattcctcagctgtgggcatgtgataatgaccccgactgcgaggatggttctgacgagtggcctcagcggtgcagaggactctatgtgttccagggagattcctctccgtgctctgcctttgaattccactgcctgagtggggaatgtatccactcttcatggcgttgtgacggaggacctgattgcaaggataagtcggacgaggaaaattgtgcggtggctacctgtcgcccagacgagtttcagtgcagtgatggcaactgtatccacgggagcagacagtgtgacagggaatacgattgtaaggacatgtctgatgaggtggggtgcgtcaatgtgaccctgtgtgagggtcccaataaatttaaatgccacagtggtgagtgcatcacgctggacaaggtgtgcaatatggccagggattgtcgggattggtccgatgagccgattaaggaatgtggaaccaatgagtgtctcgataacaacggaggatgcagccatgtgtgcaacgacctgaaaattggatatgaatgcctgtgtcccgacggatttcagctggtagcccagcggaggtgcgaggatattgacgagtgtcaggatccagatacctgcagccagctttgtgtgaatcttgagggcggttataagtgccagtgtgaagaagggttccagcttgacccacacacaaaagcttgcaaggcggttggcagcatcgcgtatctgtttttcacaaacaggcatgaggtgcggaaaatgactctggataggagtgaatacactagccttattcccaacctcagaaacgtggtagcactggataccgaggtggcgtctaaccgaatttactggagcgacttgagccagcggatgatctgcagtactcagcttgatagggcccatggtgttagctcttacgacacagtgatatccagggatatccaagctccagatggcctggcagtggactggattcactctaacatctactggacagatagcgtgctcggaacggtctcagtggctgacaccaaaggtgttaagcgcaagaccctatttagggaaaacggaagcaaaccaagggccatagtcgtggatcccgtccacgggttcatgtactggaccgactggggaactcctgccaaaatcaagaagggcgggctcaacggggttgatatttattctctcgttacagagaatatacaatggcccaatggaatcacccttgacctcctttctgggcgactgtactgggtggactccaagctccacagtatttcgtccatagacgttaatggggggaatcgaaaaacgatcctggaggacgagaagcgactggctcacccgttcagcctagccgtgtttgaggacaaggtgttttggacagacataattaacgaggcaatcttcagtgctaatcgcttaaccggatcagatgtaaatctgctcgccgagaacctcttgtcccctgaggacatggtactcttccacaatctgacgcaaccacgcggtgtgaactggtgcgaacgcaccacgttgagcaatggggggtgccagtacctgtgtctccccgccccccagattaacccgcattccccgaaatttacttgcgcctgcccagacggaatgcttcttgcccgggacatgcgctcttgcctcaccgaagccgaggctgccgtcgctactcaagagacctcgactgtgcgtctcaaggtgtcgtcaaccgccgtccgaactcagcacactacgacccgccctgttcccgataccagtcgtctgccaggggctacgcctgggctgactacggtggagattgtgacaatgagccatcaggctctaggagatgttgccggcaggggaaacgaaaagaagccatcatcagttcgcgcactttcaatcgtattgccaatagtcttgctggtgtttctttgcctcggagtgttcttgctctggaagaattggagattaaagaacataaacagcattaattttgataatccagtctatcagaagacaaccgaggatgaggtgcatatatgccataatcaggacggctattcatacccatcacgtcagatggtgagcctcgaggatgacgtggcgtag

SEQ ID NO: 84 - DNA, 2049 bp, Artificial Sequence
  Description of Artificial Sequence: Synthetic Transcript Sequence
atgggaccgtggggatggaagcttcggtggactgtcgctctactgctggccgccgctggcactgccgtcggtgatagatgtgagaggaatgaattccaatgtcaggatggtaagtgcattagttataagtgggtctgtgatggcagtgcggagtgtcaggatggctctgacgagagccaggaaacttgtctcagcgttacctgcaagagcggcgacttctcgtgcggcggtcgagttaaccgctgcatcccccagttctggcgttgcgatggacaggtcgattgtgacaacgggagcgatgagcagggctgccctgtggcgacgtgtcgacctgacgaattccaatgcagcgacggaaactgtatccatggaagcaggcagtgcgatcgcgagtacgactgtaaagacatgagtgacgaagtgggctgcgtcaacgtgacactttgtgaaggcccaaacaagttcaaatgccactctggcgagtgtataactttggataaagtctgtaacatggcccgcgactgcagagattggtctgatgagcctattaaagaatgcgggaccaacgagtgcttggataataatgggggatgtagccatgtgtgcaatgacttgaaaatcggttacgagtgtctctgccctgacgggttccagctggtggcacaacgacggtgcgaagatatcgatgagtgtcaggacccagacacatgtagccagctttgtgtcaatctggaaggtggttacaagtgtcagtgcgaagagggctttcaactcgaccctcacaccaaggcttgcaaggctgtcggctcaatcgcctaccttttttttactaatcggcacgaggttcgtaagatgactttggaccgctctgaatacacgagcctgatccctaatttaagaaatgtggttgcactggatacagaggttgcttcaaacaggatatactggtcagatctgagccagaggatgatctgctcaactcagcttgatagagcccacggagtctcatcttacgatacagtaattagcagagacatccaagcccctgatggcctcgccgtggactggatccactcaaatatatactggaccgactctgtgctggggaccgtgagcgtggcagacacgaaaggtgtgaaacgtaagacgctctttagggagaatgggtcgaagccccgcgcaattgtcgtggaccccgtccatggtttcatgtactggaccgattggggaacacccgcaaaaataaagaaggggggccttaacggggtagatatttatagcctcgttacagagaacattcagtggccaaatgggattaccctcgatttacttagcggccgcctctactgggtggacagcaaactccacagcatttcgtccatcgacgtgaacgggggcaaccgcaagacaatactcgaggatgaaaagagactggcccatccattctccctggccgtgtttgaagataaggtgttctggactgacattatcaacgaggcgattttcagtgcaaacaggctgaccggatccgatgtgaacctgctggctgagaatttgctatctccagaggatatggtgctgtttcacaacctgacccagccaagagaggctgaggccgcagttgccacacaggaaacctctaccgttaggctgaaagtcagctccactgcagtgagaacacagcacacaacgacaagaccagtacccgatacatcacgcctgcccggggctacacctggactcaccactgtcgaaatcgtgaccatgtctcaccaggcgttaggtgacgtagctgggagaggcaacgaaaagaagccaagttctgtgcgcgctctgtccatcgtactccctattgtcctgttggtgtttttgtgtcttggcgtgtttttgttgtggaagaactggcgacttaaaaatattaattccataaactttgacaaccccgtgtatcagaagaccactgaggatgaagtgcatatctgtcataatcaagacggctacagttaccccagcaggcaaatggtgtctctggaggatgacgtagcatag

SEQ ID NO: 85 - DNA, 2577 bp, Artificial Sequence
  Description of Artificial Sequence: Synthetic Transcript Sequence
atgggcccctgggggtggaagctgcggtggaccgtggcattgctgctggctgccgcggggactgccgtgggagatagatgcgaaagaaatgaatttcaatgccaggatggaaagtgtattagctataagtgggtctgtgacggctctgccgaatgtcaggacgggagtgatgagagtcaggagacatgcctgtcagtcacctgcaaaagtggtgacttctcatgcggtggcagggtgaaccgatgtattccacagttctggcggtgcgatggtcaagtggactgcgataacgggtctgacgaacagggctgtccgccgaagacatgtagccaagatgagttcagatgtcatgacgggaagtgcatttcaaggcagttcgtgtgtgattctgatcgggattgtctagacggaagtgacgaagcctcatgcccagtcctgacatgcggccctgcttcctttcagtgcaatagctcaacctgcatacctcagctgtgggcttgcgacaatgatcccgattgtgaggatggaagtgatgaatggccccagcgctgtaggggcctgtatgtgtttcagggcgatagttccccctgctctgccttcgaattccattgcttatcaggggaatgcattcatagcagctggagatgtgacggcggtccagattgcaaagataaatccgatgaagagaactgtgccgtggcaacttgcaggcctgacgagttccagtgctcagacgggaattgtattcacgggtcccgccagtgcgatcgggagtacgattgcaaggacatgtcagacgaagtcggttgtgttaatgtgaccctctgtgaaggaccgaataaatttaagtgccattctggtgagtgtataaccctcgacaaagtctgcaatatggcccgggactgtcgggactggagcgacgagccaatcaaggagtgcggaacaaacgagtgcctcgataacaacggaggctgctcccacgtgtgcaatgacctgaagatagggtacgaatgcttatgcccggacgggttccagctcgtggctcaacgccggtgtgaagatatcgacgaatgccaggatcccgatacatgtagccagctgtgtgtgaaccttgagggcggttataagtgtcagtgtgaagagggattccagttagatccccatactaaggcgtgcaaggctgtaggaagcatcgcgtacctctttttcaccaaccgtcacgaggttaggaagatgacactggatcgaagcgagtatacctctctgatccctaacctgaggaatgttgtcgctctagacactgaggtggcttcgaaccgaatctattggtccgacctctcccaacgcatgatctgttctacccagctggacagagcacatggtgtctcgtcatacgacacggtgatttcgagagatatccaggctcctgatggactggccgtagattggatccactccaacatctattggacggactccgtgctgggaactgtctcagtggcagacactaagggagtcaagcgcaagactcttttcagagagaatggttctaaaccccgggccatcgtggttgaccccgtgcacggtttcatgtactggactgattggggcacacctgccaagataaaaaaaggcggccttaacggggttgacatttatagccttgtgacggaaaacattcaatggcccaacgggatcacactcgaccttctgtccggtcggctgtattgggttgatagtaaacttcactccattagcagcatcgacgttaatgggggaaacagaaagaccatactggaagatgagaagcggctcgctcacccattcagcctggcagtattcgaggacaaagtgttctggaccgatataataaatgaggccatcttctctgccaatcgccttaccgggtcagatgtgaatttgctggcggaaaacctactcagccccgaggacatggttctgttccacaacctgactcagcctaggggcgtgaactggtgcgaaagaaccacactcagcaatggggggtgccagtacttatgtcttcccgcaccgcagataaacccccatagcccaaagttcacctgtgcctgcccggatgggatgctactggctcgagacatgagaagttgtctcacggaagccgaggccgccgttgccactcaggaaacttctacagtccgactgaaagtgtcgtctacagcagtgcgtactcagcatactaccacaaggcctgtgcctgatacatctcggctccctggggctacccccggtctgacaactgtggaaattgtgactatgtcacatcaggctctcggtgatgttgccgggagaggcaatgaaaagaagcctagcagtgtgcgggcgttatccattgtactcccgattgtcctgttggttttcctctgtctgggagtgttcctgctgtggaaaaactggaggctcaagaacattaatagcatcaactttgacaaccccgtttaccagaaaaccacagaggacgaagtacacatctgtcacaaccaggatggctattcttatccctcaatggtgtccttggaggacgatgtggcgtag

SEQ ID NO: 86 - DNA, 2838 bp, Artificial Sequence
  Description of Artificial Sequence: Synthetic Transcript Sequence
tagggcaggccaggcgttcccccgcgcttcctgtcccagcgtaggcgacaagtccctgggccccgtagcagattacgagacatccacgaatctcctagcgtgatcctgggacctccaggtgaggtgccaggctttagatgtgctctctggcgccatctcagaccccatttagtacttgggggcgcgctggctcccccagcccccattaaattcaccgagggtcctcctgctaccttaaaggcttccgtcccctacgaagtggaaacactgccccaaaacctgcccgcgcctccatggtctgctgccgagattttctcacacgtgggcgaccgatgtgagcgtaatgagttccaatgtcaagatgggaaatgtatttcttacaagtgggtgtgtgatggtagcgccgagtgccaagatggatcagacgaatctcaagagacttgtctgtcagtaacatgtaaatccggggacttctcttgcggaggacgcgtaaaccgttgcattccacaattttggcggtgtgatggtcaggtagattgtgacaacggatctgatgaacagggctgcccaccaaaaacttgttcccaagacgaattcagatgccatgacggcaagtgcatcagtagacagttcgtgtgcgattcggatagagattgcctagacggcagtgacgaagcctcatgcccagtgctgacttgtgggcctgcctcctttcaatgcaactcctccacctgcattccccagctctgggcctgtgacaatgatccagactgcgaggacggcagcgacgagtggccccaacggtgtaggggcctgtatgtctttcaaggcgattcctctccatgctcagcctttgagtttcactgcctgagtggagaatgtatacacagctcgtggagatgtgacggtggtccagactgtaaggataaatctgatgaggaaaattgcgcagtggctacgtgtcggccagacgagtttcagtgcagcgatggtaactgtatacacggctcacgccagtgcgacagggaatacgattgtaaggatatgtccgacgaagtgggctgcgtcaatgttacgctgtgcgagggaccgaacaaatttaagtgccatagcggtgaatgcattacacttgacaaagtgtgtaacatggcccgcgactgccgggactggagcgatgagcccattaaagaatgcgggacgaacgagtgtctagacaataacggaggatgttctcatgtctgtaacgatctgaagatcgggtatgagtgtctttgccctgacggctttcaattggttgctcagaggcgctgtgaggatatcgacgagtgccaagatcctgatacatgttcacagttatgcgtcaacctcgagggggggtataagtgtcagtgcgaggaagggtttcagttggacccacacaccaaggcctgcaaggccgtggggtcgattgcctacctgttttttaccaaccgtcatgaggttcgcaagatgacattggataggtcagaatatacgagcctcatcccaaacctacgtaatgtcgtagctctggacacggaggttgcctccaatagaatctactggtcagatctttcacaaagaatgatatgttcaacacagttggaccgcgcccatggcgtgtctagctacgacacggtaatttcccgagacattcaggctcctgatggccttgccgttgactggatccattcaaatatctattggactgacagtgtgctgggaacggtttctgtagctgatactaagggagtgaagaggaagacactcttcagggaaaacggatctaagccccgtgcaatagttgtggatccagtgcatgggttcatgtactggactgactggggcacccccgcaaaaatcaagaaaggaggcctcaatggcgttgacatatactcactggtgacggagaatatccaatggcccaacggaattactctggatctgctaagtggtcgcctgtattgggtggactcgaagctgcacagcatttcctccattgatgtgaacgggggaaatcgaaaaacaatcctagaagacgagaagcgactcgcccatccatttagcttggcagttttcgaggacaaggtcttctggaccgatataattaacgaggcgatcttcagtgccaataggctgaccggctctgacgttaatctcttggccgagaatctgcttagcccagaggacatggtgttgtttcacaacctgacccagccccgaggcgtcaattggtgcgaacgaactacactgtccaacggcggatgtcagtatttatgtttgcccgccccacagatcaatccccatagtcccaaattcacttgtgcctgtccagacgggatgttgcttgctcgagatatgcgttcctgtctgacggaagctgaagccgcagtggcaacccaagaaacctcaactgtgaggcttaaggtctccagcaccgccgtgcgtacccagcacacaaccaccagacccgtgcccgatacctccaggctcccgggcgcaacacctggcttaaccaccgtagaaatcgtgacaatgtctcaccaggctttgggcgatgttgccgggcgggggaatgagaagaaaccctcatcagttagagcactctctatagttcttcctatcgtgctactcgtgtttctctgcctcggcgtgtttctcctatggaagaactggagattaaagaatataaacagcatcaattttgataatcccgtgtatcagaagacaaccgaggacgaagtgcacatctgtcacaaccaagacggctattcctatccatctagacaaatggtgagtctcgaggacgacgtggcgtag

SEQ ID NO: 87 - DNA, 2220 bp, Artificial Sequence
  Description of Artificial Sequence: Synthetic Transcript Sequence
atgggcccttggggctggaaactgcggtggactgtagctctgctgctcgctgccgccggtactgcagtgggagacaggtgtgagcggaacgatttccaatgcaactcctccacatgcatcccacagctctgggcctgtgacaacgaccccgattgcgaagacggtagcgacgaatggccccagcggtgtagggggctgtacgtgtttcaaggtgatagttcaccgtgttccgcctttgaattccactgcctctctggagagtgcattcattcttcttggaggtgcgatggcggccctgattgtaaggataaaagcgatgaagaaaactgtgccgttgctacatgcaggcccgatgaattccaatgcagcgatggcaactgtattcacggctcaaggcagtgcgaccgggagtatgactgcaaggacatgtcagacgaggttgggtgcgtgaacgtaacactttgcgaaggcccgaacaagttcaagtgccactcaggggagtgtattactctggataaggtgtgtaacatggctcgagattgccgggattggtcagacgagcccatcaaggagtgcgggacaaacgaatgcctagacaacaatgggggttgttcccacgtgtgtaacgatttaaagattggctacgagtgcctctgccccgatgggtttcaactcgtcgcacagcgccggtgcgaggacattgatgaatgtcaggacccggacacatgctcacagttatgtgtaaatctggaagggggctacaagtgccagtgtgaggagggcttccagttggaccctcacacaaaggcctgcaaagcggtcgggtccatcgcttatttgtttttcacaaaccgacacgaagtacgaaaaatgaccctcgacagatcggagtacacgagcttgatacctaacctcaggaacgtggtagcactggatacagaagtcgcttccaataggatttattggagcgacctatctcagaggatgatatgctcaacccagttggatcgtgcccacggagtgagttcttatgatacagtgatctcacgggatatccaggcccctgatggcctggccgtcgattggatccacagcaatatttactggacagactcggttctcggaaccgtttcagtggccgacaccaaaggcgtaaaaaggaagacactgttccgtgagaatggctctaaaccaagagcgattgtggtggaccccgtacatggatttatgtactggaccgactggggcactcccgctaaaatcaaaaaggggggactgaacggagtagatatatacagcctggtgacagagaacattcagtggcctaacggcattactctagacctgctgagcggacgactttactgggtggatagcaagcttcactccatcagctctattgatgtaaacgggggcaacagaaagacaattctggaggacgagaaacgactggcccatccttttagcctcgccgtattcgaggacaaggtgttctggaccgatatcataaacgaagcaatcttttctgccaacaggctgacaggctccgatgtcaatctgctggccgagaacctgttgtccccagaagacatggtgttgtttcacaatttaactcagccccggggagtgaattggtgcgaaagaaccacgctgagcaatggggggtgccagtacctctgcctccctgccccacagatcaacccccactctccgaaattcacttgcgcttgcccagacggaatgttgctggcccgggatatgcgtagttgtctcaccgaagcagaggcggccgtcgctacccaggaaacatccacagtgcggctgaaggtgtcgtctaccgccgtgaggacccagcatactacaacacgacctgtccctgatacttctagactcccaggggccactcccgggctaaccacagtcgaaatcgtgacaatgtcacatcaggccctcggagacgtggccggccggggtaatgagaagaaaccatcttccgttcgggctttgtccatcgtcctccctatcgtcttactggtttttctgtgtctgggggtgtttttactatggaagaactggaggctgaagaacataaactctattaactttgataacccggtgtaccagaagactaccgaggacgaagttcatatctgccacaatcaggacggctacagctacccctctcggcagatggttagcttagaagatgatgtagcctag

SEQ ID NO: 88 - DNA, 2583 bp, Artificial Sequence
  Description of Artificial Sequence: Synthetic Transcript Sequence
atgggtccttggggctggaagctcaggtggaccgtggcgcttctgctcgcagccgctgggacagcggttggagatcgatgtgagcgtaacgagtttcagtgtcaagacggtaaatgtatctcatacaaatgggtttgtgacggatcagccgaatgccaggacgggagcgatgaatcgcaggaaacatgtttgtccgtgacttgtaagtctggcgatttttcctgcggaggaagagtgaaccgctgtatcccccaattttggaggtgtgatgggcaggtggactgtgataatggatctgatgagcagggatgcccaccaaagacttgcagccaggatgaattccgctgtcacgatggcaagtgtatctccaggcagttcgtgtgcgattccgatagggattgcctcgatggctctgatgaagcatcttgtcctgtcctaacttgcggaccagcttcatttcaatgcaactcttcaacgtgtatccctcagctgtgggcctgcgacaatgacccagattgtgaggatggctctgacgagtggccccagcggtgcaggggtctgtatgtttttcagggcgatagcagcccatgttccgcgtttgagtttcactgccttagtggggagtgcattcattcctcctggcgctgcgatggggggcccgattgcaaggacaaatccgatgaagagaattgtgccgttgccacctgtagacccgatgaatttcaatgctcggatgggaattgcatccatgggtcacgccagtgtgacagggagtacgactgtaaagatatgtcagacgaagtgggatgtgtgaacgtgactttgtgcgagggtccaaacaaattcaaatgccactccggagagtgtataactctcgacaaagtctgcaatatggccagagactgccgggattggtctgacgagcctattaaagagtgtggcactaacgagtgtctcgataacaatggggggtgttcccatgtttgtaacgacctcaagataggctacgaatgcctttgtcccgacggatttcagctggttgcacagaggcgatgcgaagacatcgatgagtgtcaggaccctgatacatgtagtcagctgtgtgtcaacctcgaaggtggatataagtgtcagtgcgaggaaggcttccagctggatcctcacactaaggcttgtaaggccgttggcagtatcgcctacctattcttcacaaaccgacatgaggttagaaagatgactcttgatagatccgaatatacctctctgattcccaacttgaggaacgttgtcgccctggatacggaggtggccagtaataggatatactggtcagacctgtcacagcgcatgatctgcagtacccaactggaccgggcccacggtgtctcctcttatgatacagttatctcccgtgacatacaggcccccgatggcctggcggtcgactggattcatagtaacatctactggactgacagcgttttaggcacagtgtccgtagcagatacaaagggtgtgaaaaggaagacactcttcagagagaacgggagcaaaccacgagctattgttgtcgaccccgtgcacgggtttatgtactggactgattggggaactcctgctaagatcaagaaaggaggacttaatggtgttgacatctatagtcttgtgactgagaacatccagtggccaaatgggatcacactcgaccttctctctggccggctgtactgggtggacagtaaactacacagcatcagcagcatagacgtgaacgggggcaatcgcaaaaccatcctcgaggatgaaaaaagactggcccacccttttagtcttgctgtttttgaagataaggtgttttggactgatataatcaatgaggcgatattttccgctaatcggcttacggggtctgatgttaacctgttagctgaaaatttactcagtccagaagacatggttctctttcacaacctgactcaacctaggggggtcaactggtgcgaaaggaccaccctctctaatggcggatgtcagtatctctgtctgcctgcgccccagattaatccccatagtccgaagttcacatgtgcgtgtcctgatggaatgctccttgcccgggacatgcgttcatgcctgacagaagctgaggccgctgtggcaacccaagagacttctactgtccggctcaaagtcagctcaacggccgttcgcacccagcacacaaccactagacccgtgcccgacactagtcggttaccgggcgctaccccggggctgactacggtcgaaatagtaacaatgagccatcaggcactgggcgacgtcgcaggaagaggcaacgaaaaaaagccctctagcgtcagggccctgtcaatcgtgctgcccatcgtgctgctcgtgtttctgtgcctcggcgtttttttattgtggaagaactggcggttgaaaaacattaattctatcaacttcgacaaccccgtgtatcagaagacaacagaggatgaggtgcacatttgtcacaatcaggacgggtatagttacccaagtcggcagatggtgtccttggaagatgacgttgcttag

SEQ ID NO: 89 - DNA, 2079 bp, Artificial Sequence
  Description of Artificial Sequence: Synthetic Transcript Sequence
atgggcccctggggctggaagctgcgctggacagtggccctgctgctggccgctgctggaacagctgtgggggacagatgtgaaagaaatgagttccagtgccaggacggcaagtgcatctcctacaagtgggtgtgtgatggcagcgctgagtgccaggacggcagtgatgagagccaggagacctgcctgtctgtgacctgcaagagcggggacttcagctgtggcggccgggtgaaccgctgcatcccccagttctggaggtgtgatggccaggtggactgtgacaatggaagtgatgagcagggctgcctgaccctgtgtgagggccccaacaagttcaagtgccacagcggggagtgcatcaccctggacaaggtgtgcaacatggcccgggactgccgggactggagcgatgagcccatcaaggaatgtggcaccaatgaatgtctggacaacaacggcggctgcagccacgtgtgcaatgacctgaagattggctatgaatgtctgtgcccagatggcttccagctggtggcccagaggcgctgtgaagatattgatgagtgccaggaccctgacacctgcagccagctgtgtgtgaacctggagggcggctacaagtgccagtgtgaggagggcttccagctggacccccacaccaaggcctgcaaggctgtgggcagcatcgcctacctgttcttcaccaacagacatgaggtgaggaagatgaccctggacagaagtgagtacaccagcctcatccccaacctgagaaatgtggtggccctggacacagaggtggccagcaaccgcatctactggagcgacctgagccagaggatgatctgcagcacccagctggaccgggcccacggcgtgagcagctatgacaccgtcatcagccgggacatccaggccccagatggcctggccgtggactggatccacagcaacatctactggacagattctgtgctgggcaccgtgtctgtggccgacaccaagggcgtgaagaggaagaccctcttccgggagaatggcagcaagccccgggccatcgtggtggaccctgtgcacggcttcatgtactggacagactggggcaccccagccaagatcaagaagggcggcctgaatggagtggacatctacagcctggtgacagagaacatccagtggcccaacggcatcaccctggacctgctgagcggccgcctgtactgggtggacagcaagctgcacagcatcagcagcattgatgtgaatggaggcaacaggaagaccatcctggaggatgagaagaggctggcccaccccttcagcctggccgtgtttgaggacaaggtgttctggacagacatcatcaatgaggccatcttcagcgccaaccggctgactggaagtgatgtgaacctgctggccgagaacctgctgagccctgaggacatggtgctcttccacaacctgacccagccccggggcgtgaactggtgtgagaggaccaccctgagcaatggaggctgccagtacctgtgcctgcctgccccccagatcaacccccacagccccaagttcacctgtgcctgcccagatggcatgctgctggcccgggacatgaggagctgcctgacagaagctgaggccgctgtggccacccaggagaccagcacagtgcggctgaaggtgagcagcacagctgtgaggacccagcacaccaccaccaggcctgtgcctgacaccagccggctgcccggggccaccccaggcctgaccaccgtggagatcgtgaccatgagccaccaggccctgggagatgtggccggcagaggaaatgagaagaagcccagctctgtgcgggccctgagcatcgtgctgcccatcgtgctgctggtgttcctgtgcctgggcgtcttcctgctgtggaagaactggaggctgaagaacatcaacagcatcaactttgacaaccctgtgtaccagaagaccacagaagatgaggtgcacatctgccacaaccaggacggctacagctaccccagccggcagatggtgtccctggaggatgatgtggcctag

SEQ ID NO: 90 - DNA, 2460 bp, Artificial Sequence
  Description of Artificial Sequence: Synthetic Transcript Sequence
atgggcccctggggctggaagctgcgctggacagtggccctgctgctggccgctgctggaacagctgtgggggacagatgtgaaagaaatgagttccagtgccaggacggcaagtgcatctcctacaagtgggtgtgtgatggcagcgctgagtgccaggacggcagtgatgagagccaggagacctgcagccccaagacctgcagccaggatgagttccgctgccatgatggcaagtgcatcagccggcagtttgtgtgtgacagcgaccgggactgcctggatggcagtgatgaggccagctgccctgtgctgacctgtggccctgccagcttccagtgcaacagcagcacctgcatcccccagctgtgggcctgtgacaatgaccctgactgtgaagatggcagtgatgagtggccccagcgctgccggggcctgtatgtgttccagggcgacagcagcccctgcagcgcctttgagttccactgcctgtctggagagtgcatccacagctcctggaggtgtgatggcggccctgactgcaaggacaagagtgatgaggagaactgtgctgtggccacctgcaggccagatgagttccagtgcagtgatggcaactgcatccacggcagccggcagtgtgaccgggagtatgactgcaaggacatgtctgatgaggtgggctgtgtgaatgtgaccctgtgtgagggccccaacaagttcaagtgccacagcggggagtgcatcaccctggacaaggtgtgcaacatggcccgggactgccgggactggagcgatgagcccatcaaggaatgtggcaccaatgaatgtctggacaacaatggaggctgcagccacgtgtgcaatgacctgaagattggctatgagtgcctgtgcccagatggcttccagctggtggcccagaggcgctgtgaggacattgatgagtgccaggaccctgacacctgcagccagctgtgtgtgaacctggagggcggctacaagtgccagtgtgaggagggcttccagctggacccccacaccaaggcctgcaaggctgtgggcagcatcgcctacctgttcttcaccaacagacatgaggtgaggaagatgaccctggacagaagtgagtacaccagcctcatccccaacctgagaaatgtggtggccctggacacagaggtggccagcaaccgcatctactggagcgacctgagccagaggatgatctgcagcacccagctggaccgggcccatggagtgtcctcctatgacaccgtcatcagccgggacatccaggccccagatggcctggccgtggactggatccacagcaacatctactggacagacagcgtgctgggcaccgtgtctgtggccgacaccaagggcgtgaagaggaagaccctcttcagagaaaatggcagcaagccccgggccatcgtggtggaccctgtgcacggcttcatgtactggacagactggggcaccccagccaagatcaagaagggcggcctgaatggagtggacatctacagcctggtgacagagaacatccagtggcccaacggcatcaccctggacctgctgagcggccgcctgtactgggtggacagcaagctgcacagcatcagcagcattgatgtgaatggaggcaacaggaagaccatcctggaggatgagaagaggctggcccaccccttcagcctggccgtgtttgaggacaaggtgttctggacagacatcatcaatgaggccatcttcagcgccaaccggctgaccggcagtgatgtgaacctgctggccgagaacctgctgagccctgaggacatggtgctcttccacaacctgacccagccccggggcgtgaactggtgtgagaggaccaccctgagcaatggaggctgccagtacctgtgcctgcctgccccccagatcaacccccacagccccaagttcacctgtgcctgcccagatggcatgctgctggcccgggacatgaggagctgcctgacagaggccgaggccgctgtggccacccaggagaccagcacagtgcggctgaaggtgagcagcacagctgtgaggacccagcacaccaccaccaggcctgtgcctgacaccagccggctgcccggggccaccccaggcctgaccaccgtggagatcgtgaccatgagccaccaggccctgggagatgtggccggcagaggaaatgagaagaagcccagctctgtgcgggccctgagcatcgtgctgcccatcgtgctgctggtgttcctgtgcctgggcgtcttcctgctgtggaagaactggaggctgaagaacatcaacagcatcaactttgacaaccctgtgtaccagaagaccacagaagatgaggtgcacatctgccacaaccaggacggctacagctaccccagccggcagatggtgtccctggaggatgatgtggcctag

SEQ ID NO: 91 - DNA, 2049 bp, Artificial Sequence
  Description of Artificial Sequence: Synthetic Transcript Sequence
atgggcccctggggctggaagctgcgctggacagtggccctgctgctggccgctgctggaacagctgtgggggacagatgtgaaagaaatgagttccagtgccaggacggcaagtgcatctcctacaagtgggtgtgtgatggcagcgctgagtgccaggacggcagtgatgagagccaggagacctgcctgtctgtgacctgcaagagcggggacttcagctgtggcggccgggtgaaccgctgcatcccccagttctggaggtgtgatggccaggtggactgtgacaatggaagtgatgagcagggctgccctgtggccacctgcaggccagatgagttccagtgcagtgatggcaactgcatccacggcagccggcagtgtgaccgggagtatgactgcaaggacatgtctgatgaggtgggctgtgtgaatgtgaccctgtgtgagggccccaacaagttcaagtgccacagcggggagtgcatcaccctggacaaggtgtgcaacatggcccgggactgccgggactggagcgatgagcccatcaaggaatgtggcaccaatgaatgtctggacaacaatggaggctgcagccacgtgtgcaatgacctgaagattggctatgagtgcctgtgcccagatggcttccagctggtggcccagaggcgctgtgaggacattgatgagtgccaggaccctgacacctgcagccagctgtgtgtgaacctggagggcggctacaagtgccagtgtgaggagggcttccagctggacccccacaccaaggcctgcaaggctgtgggcagcatcgcctacctgttcttcaccaacagacatgaggtgaggaagatgaccctggacagaagtgagtacaccagcctcatccccaacctgagaaatgtggtggccctggacacagaggtggccagcaaccgcatctactggagcgacctgagccagaggatgatctgcagcacccagctggaccgggcccatggagtgtcctcctatgacaccgtcatcagccgggacatccaggccccagatggcctggccgtggactggatccacagcaacatctactggacagacagcgtgctgggcaccgtgtctgtggccgacaccaagggcgtgaagaggaagaccctcttcagagaaaatggcagcaagccccgggccatcgtggtggaccctgtgcacggcttcatgtactggacagactggggcaccccagccaagatcaagaagggcggcctgaatggagtggacatctacagcctggtgacagagaacatccagtggcccaacggcatcaccctggacctgctgagcggccgcctgtactgggtggacagcaagctgcacagcatcagcagcattgatgtgaatggaggcaacaggaagaccatcctggaggatgagaagaggctggcccaccccttcagcctggccgtgtttgaggacaaggtgttctggacagacatcatcaatgaggccatcttcagcgccaaccggctgaccggcagtgatgtgaacctgctggccgagaacctgctgagccctgaggacatggtgctcttccacaacctgacccagccccgggaggccgaggccgctgtggccacccaggagaccagcacagtgcggctgaaggtgagcagcacagctgtgaggacccagcacaccaccaccaggcctgtgcctgacaccagccggctgcccggggccaccccaggcctgaccaccgtggagatcgtgaccatgagccaccaggccctgggagatgtggccggcagaggaaatgagaagaagcccagctctgtgcgggccctgagcatcgtgctgcccatcgtgctgctggtgttcctgtgcctgggcgtcttcctgctgtggaagaactggaggctgaagaacatcaacagcatcaactttgacaaccctgtgtaccagaagaccacagaagatgaggtgcacatctgccacaaccaggacggctacagctaccccagccggcagatggtgtccctggaggatgatgtggcctag

SEQ ID NO: 92 - DNA, 2577 bp, Artificial Sequence
  Description of Artificial Sequence: Synthetic Transcript Sequence
atgggcccctggggctggaagctgcgctggacagtggccctgctgctggccgctgctggaacagctgtgggggacagatgtgaaagaaatgagttccagtgccaggacggcaagtgcatctcctacaagtgggtgtgtgatggcagcgctgagtgccaggacggcagtgatgagagccaggagacctgcctgtctgtgacctgcaagagcggggacttcagctgtggcggccgggtgaaccgctgcatcccccagttctggaggtgtgatggccaggtggactgtgacaatggaagtgatgagcagggctgcccccccaagacctgcagccaggatgagttccgctgccatgatggcaagtgcatcagccggcagtttgtgtgtgacagcgaccgggactgcctggatggcagtgatgaggccagctgccctgtgctgacctgtggccctgccagcttccagtgcaacagcagcacctgcatcccccagctgtgggcctgtgacaatgaccctgactgtgaagatggcagtgatgagtggccccagcgctgccggggcctgtatgtgttccagggcgacagcagcccctgcagcgcctttgagttccactgcctgagcggggagtgcatccacagctcctggaggtgtgatggcggccctgactgcaaggacaagagtgatgaggagaactgtgctgtggccacctgcaggccagatgagttccagtgcagtgatggcaactgcatccacggcagccggcagtgtgaccgggagtatgactgcaaggacatgtctgatgaggtgggctgtgtgaatgtgaccctgtgtgagggccccaacaagttcaagtgccacagcggggagtgcatcaccctggacaaggtgtgcaacatggcccgggactgccgggactggagcgatgagcccatcaaggaatgtggcaccaatgaatgtctggacaacaacggcggctgcagccacgtgtgcaatgacctgaagattggctatgaatgtctgtgcccagatggcttccagctggtggcccagaggcgctgtgaagatattgatgagtgccaggaccctgacacctgcagccagctgtgtgtgaacctggagggcggctacaagtgccagtgtgaggagggcttccagctggacccccacaccaaggcctgcaaggctgtgggcagcatcgcctacctgttcttcaccaacagacatgaggtgaggaagatgaccctggacagaagtgagtacaccagcctcatccccaacctgagaaatgtggtggccctggacacagaggtggccagcaaccgcatctactggagcgacctgagccagaggatgatctgcagcacccagctggaccgggcccacggcgtgagcagctatgacaccgtcatcagccgggacatccaggccccagatggcctggccgtggactggatccacagcaacatctactggacagattctgtgctgggcaccgtgtctgtggccgacaccaagggcgtgaagaggaagaccctcttccgggagaatggcagcaagccccgggccatcgtggtggaccctgtgcacggcttcatgtactggacagactggggcaccccagccaagatcaagaagggcggcctgaatggagtggacatctacagcctggtgacagagaacatccagtggcccaacggcatcaccctggacctgctgagcggccgcctgtactgggtggacagcaagctgcacagcatcagcagcattgatgtgaatggaggcaacaggaagaccatcctggaggatgagaagaggctggcccaccccttcagcctggccgtgtttgaggacaaggtgttctggacagacatcatcaatgaggccatcttcagcgccaaccggctgactggaagtgatgtgaacctgctggccgagaacctgctgagccctgaggacatggtgctcttccacaacctgacccagccccggggcgtgaactggtgtgagaggaccaccctgagcaatggaggctgccagtacctgtgcctgcctgccccccagatcaacccccacagccccaagttcacctgtgcctgcccagatggcatgctgctggcccgggacatgaggagctgcctgacagaagctgaggccgctgtggccacccaggagaccagcacagtgcggctgaaggtgagcagcacagctgtgaggacccagcacaccaccaccaggcctgtgcctgacaccagccggctgcccggggccaccccaggcctgaccaccgtggagatcgtgaccatgagccaccaggccctgggagatgtggccggcagaggaaatgagaagaagcccagctctgtgcgggccctgagcatcgtgctgcccatcgtgctgctggtgttcctgtgcctgggcgtcttcctgctgtggaagaactggaggctgaagaacatcaacagcatcaactttgacaaccctgtgtaccagaagaccacagaagatgaggtgcacatctgccacaaccaggacggctacagctaccccagcatggtgtccctggaggatgatgtggcctag

SEQ ID NO: 93 - DNA, 2838 bp, Artificial Sequence
  Description of Artificial Sequence: Synthetic Transcript Sequence
tgaggaagacctggggtgcccccacgcttcctgagccagaggcggcggcaggtgcccggccccaggagccggctgcgggacatccacgagagccccagcgtcatcctgggccccccaggagaggtgcccggcttccgctgtgccctgtggaggcacctgcggccccacctggtgctgggcggggccctggcccccccagcccccatcaagttcacagagggccccccagccaccctgaaggcctctgtgccctatgaggtggagaccctgccccagaacctgcctgccccaccctggagcgctgctgagatcttcagccacgtgggggacagatgtgaaagaaatgagttccagtgccaggacggcaagtgcatctcctacaagtgggtgtgtgatggcagcgctgagtgccaggacggcagtgatgagagccaggagacctgcctgtctgtgacctgcaagagcggggacttcagctgtggcggccgggtgaaccgctgcatcccccagttctggaggtgtgatggccaggtggactgtgacaatggaagtgatgagcagggctgcccccccaagacctgcagccaggatgagttccgctgccatgatggcaagtgcatcagccggcagtttgtgtgtgacagcgaccgggactgcctggatggcagtgatgaggccagctgccctgtgctgacctgtggccctgccagcttccagtgcaacagcagcacctgcatcccccagctgtgggcctgtgacaatgaccctgactgtgaagatggcagtgatgagtggccccagcgctgccggggcctgtatgtgttccagggcgacagcagcccctgcagcgcctttgagttccactgcctgtctggagagtgcatccacagctcctggaggtgtgatggcggccctgactgcaaggacaagagtgatgaggagaactgtgctgtggccacctgcaggccagatgagttccagtgcagtgatggcaactgcatccacggcagccggcagtgtgaccgggagtatgactgcaaggacatgtctgatgaggtgggctgtgtgaatgtgaccctgtgtgagggccccaacaagttcaagtgccacagcggggagtgcatcaccctggacaaggtgtgcaacatggcccgggactgccgggactggagcgatgagcccatcaaggaatgtggcaccaatgaatgtctggacaacaatggaggctgcagccacgtgtgcaatgacctgaagattggctatgagtgcctgtgcccagatggcttccagctggtggcccagaggcgctgtgaggacattgatgagtgccaggaccctgacacctgcagccagctgtgtgtgaacctggagggcggctacaagtgccagtgtgaggagggcttccagctggacccccacaccaaggcctgcaaggctgtgggcagcatcgcctacctgttcttcaccaacagacatgaggtgaggaagatgaccctggacagaagtgagtacaccagcctcatccccaacctgagaaatgtggtggccctggacacagaggtggccagcaaccgcatctactggagcgacctgagccagaggatgatctgcagcacccagctggaccgggcccatggagtgtcctcctatgacaccgtcatcagccgggacatccaggccccagatggcctggccgtggactggatccacagcaacatctactggacagacagcgtgctgggcaccgtgtctgtggccgacaccaagggcgtgaagaggaagaccctcttcagagaaaatggcagcaagccccgggccatcgtggtggaccctgtgcacggcttcatgtactggacagactggggcaccccagccaagatcaagaagggcggcctgaatggagtggacatctacagcctggtgacagagaacatccagtggcccaacggcatcaccctggacctgctgagcggccgcctgtactgggtggacagcaagctgcacagcatcagcagcattgatgtgaatggaggcaacaggaagaccatcctggaggatgagaagaggctggcccaccccttcagcctggccgtgtttgaggacaaggtgttctggacagacatcatcaatgaggccatcttcagcgccaaccggctgaccggcagtgatgtgaacctgctggccgagaacctgctgagccctgaggacatggtgctcttccacaacctgacccagccccggggcgtgaactggtgtgagaggaccaccctgagcaatggaggctgccagtacctgtgcctgcctgccccccagatcaacccccacagccccaagttcacctgtgcctgcccagatggcatgctgctggcccgggacatgaggagctgcctgacagaggccgaggccgctgtggccacccaggagaccagcacagtgcggctgaaggtgagcagcacagctgtgaggacccagcacaccaccaccaggcctgtgcctgacaccagccggctgcccggggccaccccaggcctgaccaccgtggagatcgtgaccatgagccaccaggccctgggagatgtggccggcagaggaaatgagaagaagcccagctctgtgcgggccctgagcatcgtgctgcccatcgtgctgctggtgttcctgtgcctgggcgtcttcctgctgtggaagaactggaggctgaagaacatcaacagcatcaactttgacaaccctgtgtaccagaagaccacagaagatgaggtgcacatctgccacaaccaggacggctacagctaccccagccggcagatggtgtccctggaggatgatgtggcctag

SEQ ID NO: 94 - DNA, 2220 bp, Artificial Sequence
  Description of Artificial Sequence: Synthetic Transcript Sequence
atgggcccctggggctggaagctgcgctggacagtggccctgctgctggccgctgctggaacagctgtgggggacagatgtgaaagaaatgacttccagtgcaacagcagcacctgcatcccccagctgtgggcctgtgacaatgaccctgactgtgaagatggcagtgatgagtggccccagcgctgccggggcctgtatgtgttccagggcgacagcagcccctgcagcgcctttgagttccactgcctgtctggagagtgcatccacagctcctggaggtgtgatggcggccctgactgcaaggacaagagtgatgaggagaactgtgctgtggccacctgcaggccagatgagttccagtgcagtgatggcaactgcatccacggcagccggcagtgtgaccgggagtatgactgcaaggacatgtctgatgaggtgggctgtgtgaatgtgaccctgtgtgagggccccaacaagttcaagtgccacagcggggagtgcatcaccctggacaaggtgtgcaacatggcccgggactgccgggactggagcgatgagcccatcaaggaatgtggcaccaatgaatgtctggacaacaatggaggctgcagccacgtgtgcaatgacctgaagattggctatgagtgcctgtgcccagatggcttccagctggtggcccagaggcgctgtgaggacattgatgagtgccaggaccctgacacctgcagccagctgtgtgtgaacctggagggcggctacaagtgccagtgtgaggagggcttccagctggacccccacaccaaggcctgcaaggctgtgggcagcatcgcctacctgttcttcaccaacagacatgaggtgaggaagatgaccctggacagaagtgagtacaccagcctcatccccaacctgagaaatgtggtggccctggacacagaggtggccagcaaccgcatctactggagcgacctgagccagaggatgatctgcagcacccagctggaccgggcccatggagtgtcctcctatgacaccgtcatcagccgggacatccaggccccagatggcctggccgtggactggatccacagcaacatctactggacagacagcgtgctgggcaccgtgtctgtggccgacaccaagggcgtgaagaggaagaccctcttcagagaaaatggcagcaagccccgggccatcgtggtggaccctgtgcacggcttcatgtactggacagactggggcaccccagccaagatcaagaagggcggcctgaatggagtggacatctacagcctggtgacagagaacatccagtggcccaacggcatcaccctggacctgctgagcggccgcctgtactgggtggacagcaagctgcacagcatcagcagcattgatgtgaatggaggcaacaggaagaccatcctggaggatgagaagaggctggcccaccccttcagcctggccgtgtttgaggacaaggtgttctggacagacatcatcaatgaggccatcttcagcgccaaccggctgaccggcagtgatgtgaacctgctggccgagaacctgctgagccctgaggacatggtgctcttccacaacctgacccagccccggggcgtgaactggtgtgagaggaccaccctgagcaatggaggctgccagtacctgtgcctgcctgccccccagatcaacccccacagccccaagttcacctgtgcctgcccagatggcatgctgctggcccgggacatgaggagctgcctgacagaggccgaggccgctgtggccacccaggagaccagcacagtgcggctgaaggtgagcagcacagctgtgaggacccagcacaccaccaccaggcctgtgcctgacaccagccggctgcccggggccaccccaggcctgaccaccgtggagatcgtgaccatgagccaccaggccctgggagatgtggccggcagaggaaatgagaagaagcccagctctgtgcgggccctgagcatcgtgctgcccatcgtgctgctggtgttcctgtgcctgggcgtcttcctgctgtggaagaactggaggctgaagaacatcaacagcatcaactttgacaaccctgtgtaccagaagaccacagaagatgaggtgcacatctgccacaaccaggacggctacagctaccccagccggcagatggtgtccctggaggatgatgtggcctag

SEQ ID NO: 95 - DNA, 2583 bp, Artificial Sequence
  Description of Artificial Sequence: Synthetic Transcript Sequence
atgggcccctggggctggaagctgcgctggacagtggccctgctgctggccgctgctggaacagctgtgggggacagatgtgaaagaaatgagttccagtgccaggacggcaagtgcatctcctacaagtgggtgtgtgatggcagcgctgagtgccaggacggcagtgatgagagccaggagacctgcctgtctgtgacctgcaagagcggggacttcagctgtggcggccgggtgaaccgctgcatcccccagttctggaggtgtgatggccaggtggactgtgacaatggaagtgatgagcagggctgcccccccaagacctgcagccaggatgagttccgctgccatgatggcaagtgcatcagccggcagtttgtgtgtgacagcgaccgggactgcctggatggcagtgatgaggccagctgccctgtgctgacctgtggccctgccagcttccagtgcaacagcagcacctgcatcccccagctgtgggcctgtgacaatgaccctgactgtgaagatggcagtgatgagtggccccagcgctgccggggcctgtatgtgttccagggcgacagcagcccctgcagcgcctttgagttccactgcctgagcggggagtgcatccacagctcctggaggtgtgatggcggccctgactgcaaggacaagagtgatgaggagaactgtgctgtggccacctgcaggccagatgagttccagtgcagtgatggcaactgcatccacggcagccggcagtgtgaccgggagtatgactgcaaggacatgtctgatgaggtgggctgtgtgaatgtgaccctgtgtgagggccccaacaagttcaagtgccacagcggggagtgcatcaccctggacaaggtgtgcaacatggcccgggactgccgggactggagcgatgagcccatcaaggaatgtggcaccaatgaatgtctggacaacaacggcggctgcagccacgtgtgcaatgacctgaagattggctatgaatgtctgtgcccagatggcttccagctggtggcccagaggcgctgtgaagatattgatgagtgccaggaccctgacacctgcagccagctgtgtgtgaacctggagggcggctacaagtgccagtgtgaggagggcttccagctggacccccacaccaaggcctgcaaggctgtgggcagcatcgcctacctgttcttcaccaacagacatgaggtgaggaagatgaccctggacagaagtgagtacaccagcctcatccccaacctgagaaatgtggtggccctggacacagaggtggccagcaaccgcatctactggagcgacctgagccagaggatgatctgcagcacccagctggaccgggcccacggcgtgagcagctatgacaccgtcatcagccgggacatccaggccccagatggcctggccgtggactggatccacagcaacatctactggacagattctgtgctgggcaccgtgtctgtggccgacaccaagggcgtgaagaggaagaccctcttccgggagaatggcagcaagccccgggccatcgtggtggaccctgtgcacggcttcatgtactggacagactggggcaccccagccaagatcaagaagggcggcctgaatggagtggacatctacagcctggtgacagagaacatccagtggcccaacggcatcaccctggacctgctgagcggccgcctgtactgggtggacagcaagctgcacagcatcagcagcattgatgtgaatggaggcaacaggaagaccatcctggaggatgagaagaggctggcccaccccttcagcctggccgtgtttgaggacaaggtgttctggacagacatcatcaatgaggccatcttcagcgccaaccggctgactggaagtgatgtgaacctgctggccgagaacctgctgagccctgaggacatggtgctcttccacaacctgacccagccccggggcgtgaactggtgtgagaggaccaccctgagcaatggaggctgccagtacctgtgcctgcctgccccccagatcaacccccacagccccaagttcacctgtgcctgcccagatggcatgctgctggcccgggacatgaggagctgcctgacagaagctgaggccgctgtggccacccaggagaccagcacagtgcggctgaaggtgagcagcacagctgtgaggacccagcacaccaccaccaggcctgtgcctgacaccagccggctgcccggggccaccccaggcctgaccaccgtggagatcgtgaccatgagccaccaggccctgggagatgtggccggcagaggaaatgagaagaagcccagctctgtgcgggccctgagcatcgtgctgcccatcgtgctgctggtgttcctgtgcctgggcgtcttcctgctgtggaagaactggaggctgaagaacatcaacagcatcaactttgacaaccctgtgtaccagaagaccacagaagatgaggtgcacatctgccacaaccaggacggctacagctaccccagccggcagatggtgtccctggaggatgatgtggcctag

SEQ ID NO: 96 - DNA, 2079 bp, Artificial Sequence
  Description of Artificial Sequence: Synthetic Transcript Sequence
atgggcccctggggctggaagctgcggtggaccgtggccctgctgcttgcagctgcgggcactgcagtgggtgatcggtgcgagcggaacgagtttcagtgtcaggatgggaagtgcatctcgtacaaatgggtttgcgacggcagcgccgaatgccaggacggctctgacgagtcccaggaaacatgcctgtcagtaacctgcaagtcaggagatttttcttgcggtgggagggtcaatcgctgcatcccccaattttggcgatgtgacggacaagtggactgcgataacggctctgatgagcagggctgcctcactctttgcgagggcccgaacaaatttaagtgccactcaggcgagtgcatcaccctggacaaagtgtgcaacatggccagggactgtagggactggagtgacgaaccgattaaggagtgcggaaccaatgagtgcctggacaacaacggcggctgttctcacgtgtgtaatgatctgaagattgggtatgaatgcctctgccctgatggtttccagctggtggcccaacggcgatgcgaggacattgatgagtgtcaggatcccgacacgtgttcacagctgtgtgttaatctcgaagggggctataaatgccagtgcgaagagggctttcagctggatcctcataccaaagcttgcaaggctgtggggtctatcgcctacctattcttcacgaaccgccacgaagtcagaaaaatgactctggacaggtccgaatacacttccctgattcctaatctgagaaacgtagtggcgcttgatacagaagtggcgagtaaccgtatctattggagcgacttaagccagaggatgatctgcagcacccagctggacagggcacatggagtgtcatcgtacgatacagtcatttcacgggatatacaggctcccgatggtctcgctgtagactggattcactccaacatatattggacagatagtgtccttggtacagtgtcagtggctgatacaaaaggtgtcaagcggaaaactctgttccgtgaaaacggaagcaagcctagggccattgttgtggacccagtccatggcttcatgtattggaccgattgggggaccccagccaaaataaaaaagggcggcctcaacggagtggacatctacagtttagtgaccgagaacatccaatggcctaatggaattactttggacctcttatccggaaggctatactgggtcgatagcaagttacatagcatctcatcaatcgacgtcaatggcggcaaccgaaagaccattctggaggacgaaaaacgcttggcccatcccttctcactggccgtctttgaggacaaggttttttggactgacataataaacgaagccatcttctccgcaaatcggcttactggatccgacgtcaacttgctggccgaaaatctgctctccccggaggacatggttctcttccacaaccttacacagcctaggggagttaattggtgtgaaagaactaccctgtcgaacggcggatgccagtacctgtgccttccagcccctcaaatcaacccacattcccccaaattcacctgcgcctgtcccgatggcatgctcctcgccagagacatgcggagttgcctgacagaggccgaggccgccgtggctacccaagaaacttcaactgttagactcaaagtgagctctacggccgttcggacccaacataccactaccagaccagttcccgacacatcacgcctgcctggtgctacacccggcctgacaactgtcgagatagtaaccatgagccatcaggctctgggagacgtggcaggaagaggaaatgagaagaagccctcctctgtgcgggcactatcaatcgttctgcctattgtgctgctagttttcctttgtctaggtgtttttctcttatggaagaactggaggctgaaaaacataaacagcatcaattttgataaccccgtctaccagaagaccaccgaagacgaggtgcatatctgccacaaccaggatggctattcttatccttcacgccaaatggtttctcttgaggatgatgtcgcctag

SEQ ID NO: 97 - DNA, 2460 bp, Artificial Sequence
  Description of Artificial Sequence: Synthetic Transcript Sequence
atgggcccctggggctggaagctgcggtggaccgtggccctgctgctggcggcagccgggacggcggtcggagatcgttgtgagaggaacgagttccagtgccaggacggtaaatgtatcagttacaagtgggtctgtgacggaagcgctgaatgtcaggacggatctgacgaatcacaggagacctgctcacccaaaacatgtagccaagacgaatttcggtgtcacgatggcaaatgcatctcccgacagttcgtatgcgacagcgacagagactgcctcgatggctctgatgaggcaagttgcccagtcctgacctgcggcccggcctctttccaatgcaattcttcaacatgcataccacagctctgggcttgcgacaacgatcccgactgtgaggatgggtctgatgaatggcctcagaggtgtagaggattgtatgtgtttcagggcgatagcagtccctgttctgccttcgagtttcattgcctgagtggtgaatgcatccatagtagctggcggtgcgacggcggcccagattgtaaagataagtcagacgaggagaattgtgcagtcgccacctgcagacccgacgagttccagtgctctgacggaaattgcatccatggttcacggcagtgcgaccgagagtatgactgtaaagacatgtctgacgaggtaggttgcgtcaatgtcacactttgcgaggggccaaataaattcaaatgtcactcgggggaatgcatcaccctggacaaggtatgtaacatggccagggactgccgggactggagcgacgagccgataaaggagtgcggtactaacgaatgtctggacaataatggcggctgctcacatgtctgtaacgatctaaaaattgggtatgaatgtttatgccccgacgggttccagctcgtcgctcagcgcagatgcgaagacatcgatgaatgccaggatccagacacctgctcccagttgtgcgtgaatttagagggtggctataaatgtcaatgcgaagaaggattccagctcgatccccacaccaaggcttgcaaggccgtcggatctattgcgtacttgtttttcactaatagacacgaagtcaggaagatgaccctcgataggtcagagtacacatcccttattcctaacctgcgcaacgtcgttgccctcgacacagaggttgccagtaatcggatatattggtcggacctgagccaacggatgatctgttctacccagcttgatcgagcccatggtgtgtcctcttacgatacagttatctctcgggatatccaagcacccgatgggttagctgtcgattggatccacagtaatatttattggacggacagcgtgctgggcaccgtgagtgtcgctgacacaaaaggagtgaagcgaaaaaccctcttcagggagaatggatcgaagccgcgagccattgttgtggatcctgtgcacgggtttatgtactggacggattggggaacccctgctaaaataaagaagggagggctgaatggagtcgatatctattctctcgtcactgagaacatacagtggcccaatggcatcacactggatttgttgtccgggcggttgtactgggttgattccaagctccactcgatatcttcaatcgatgtaaacggaggaaaccggaagacaatcctggaagacgagaaacgcttggcacaccctttcagtctcgccgtgttcgaagacaaggtcttctggaccgacattattaatgaggccatattcagtgctaacagattgactggcagtgatgtgaatctgcttgccgagaatttactctcacccgaagatatggttctttttcacaacttgactcagcctcgtggggtgaattggtgtgaacgaactacactttcaaacggtggctgtcaatacctctgtctgccagcgccccaaatcaaccctcattcccctaagtttacctgtgcatgcccagatggaatgctactggctagagacatgcgaagctgcctgacggaagccgaagcggcagttgctacccaggagacgagcacagtcagactcaaggtgagcagcaccgcagtgagaacacagcacactacaacccggccagttcccgatacaagtagactacccggcgccaccccagggttgaccaccgtcgaaattgtgacgatgtcccatcaggccctgggcgatgttgcaggacggggaaatgagaagaagccctcttccgtgcgggcccttagcatcgttctcccaattgtcctcctggtgttcttatgtctgggagtgttcttattatggaagaattggaggcttaagaatatcaacagtatcaactttgacaaccccgtttaccaaaagaccacagaggacgaggttcacatttgccacaatcaggacggatacagctatccatccaggcagatggtctccctcgaggacgacgtggcctag

SEQ ID NO: 98 - DNA, 2049 bp, Artificial Sequence
  Description of Artificial Sequence: Synthetic Transcript Sequence
atgggcccctggggctggaagctgcggtggaccgtggccctgctgctggccgctgctgggacagctgtgggcgatcggtgcgagagaaacgaatttcaatgccaggacggcaagtgtattagctataagtgggtatgcgacggaagtgcagagtgccaagatggatcagatgagagccaggaaacctgcctcagcgtgacttgtaaatctggggacttctcatgcggcggaagagtgaataggtgtataccgcaattctggcggtgcgatggacaggtggattgcgacaatggctccgatgagcaggggtgcccagttgccacatgccgtcctgatgagttccaatgttctgacggcaactgtatacatggcagcaggcaatgtgatcgtgagtatgattgcaaggatatgagcgacgaagtaggctgtgtcaacgttacactatgcgagggacctaataagttcaagtgccactctggggaatgtatcactctggacaaggtatgtaacatggcacgcgattgccgggactggtctgatgagccaatcaaagagtgtggtactaacgaatgcctggataataatgggggctgttcccacgtgtgcaatgacctaaagattggctacgagtgtttatgtcccgatggcttccagctggtggcccagaggcgatgtgaggacatcgatgaatgccaggatccagacacgtgtagccaattatgcgtgaacttagagggagggtataagtgccaatgtgaggaaggcttccagctggatcctcacaccaaagcgtgtaaagctgtggggagcatcgcctaccttttcttcaccaatcgccacgaagtcaggaaaatgactctggataggtcggagtatacctctctcattcccaatctgagaaacgtggttgctctcgatactgaagtcgcatccaaccgaatctactggtctgacctttcccagcgcatgatttgctccacacagctggatagggctcacggtgtgagtagctatgataccgttattagtagagatatacaggctccagatggcctcgccgtggactggatccactcaaacatatattggaccgacagcgtcctaggcaccgtgtctgtcgcggacaccaagggggtgaaaaggaaaaccctctttcgcgagaacgggtcaaagcctcgagccatcgtggtggaccctgttcacggcttcatgtactggactgattggggaactcccgccaaaatcaagaaaggtggcctgaatggcgttgacatttactccttggtgactgaaaatatccagtggcccaacgggattactctggatctgctgtctggccgcctctattgggtcgattctaagctgcattccatcagctctattgacgtgaacggaggaaatcgaaaaacaatcttagaagacgagaagcgccttgcccacccgtttagccttgccgtgttcgaggataaagttttttggaccgacattatcaatgaggcaatcttttcggcaaacaggctgacaggatccgacgtcaacctcttagcagagaatctgctgtctcccgaggatatggtcctgtttcacaatctaacccagccgcgcgaggccgaggccgcagtggccactcaagaaaccagtaccgtcagactgaaagtgagcagcactgctgttagaacccagcataccactacgagaccagtaccagatactagccgcctgccaggggcgactcccggtctcactaccgtagagatcgtgactatgagccatcaagccctcggagatgtggccgggcgcggtaatgagaagaagccttcaagtgttagagctctatctattgtcctgcccattgtcctgctggttttcctctgcctgggtgtgtttctcttgtggaagaactggaggcttaaaaatatcaattctataaacttcgacaaccctgtctatcagaagaccactgaggacgaggtgcatatctgccacaatcaggacggatattcatatccctctaggcaaatggtgagtttagaggacgatgtcgcatag

SEQ ID NO: 99 - DNA, 2577 bp, Artificial Sequence
  Description of Artificial Sequence: Synthetic Transcript Sequence
atgggcccctggggctggaagctgcggtggaccgtggccctgctgctcgctgccgcaggtactgccgtcggcgaccggtgcgaacgaaacgaatttcagtgccaggacggtaaatgcatctcttacaagtgggtgtgcgatgggagcgctgagtgtcaggacggctctgacgaatcgcaggaaacatgtcttagtgtgacatgcaagtccggcgacttcagttgcggaggcagggtcaatcgatgtatacctcaattttggcggtgcgacgggcaggtggattgcgacaacggcagtgatgagcagggatgtccacccaagacttgttctcaggacgagtttcggtgtcatgatgggaagtgcatttcacgccagtttgtgtgcgattccgaccgagactgtctagacggaagcgatgaagccagctgtcctgtcttgacttgtggacccgcttcatttcaatgcaacagctccacatgtatcccccagctgtgggcttgcgacaatgatccggactgtgaagatgggtccgacgaatggcctcagcgctgtaggggactctacgtctttcagggtgattccagcccttgctctgcatttgaatttcactgtctgagcggggaatgtatccacagcagctggaggtgcgatggcggaccagattgcaaagacaagtccgacgaagagaactgtgccgtggccacctgtaggcctgatgagttccagtgtagcgatgggaactgcatccatggttcccggcagtgcgatcgtgagtacgattgtaaggatatgtccgatgaggtagggtgtgtcaatgtgaccctttgtgagggacctaataagtttaagtgtcacagtggggaatgcatcacactcgacaaagtctgtaacatggcaagagattgtagggattggtctgatgagccaatcaaggagtgtggtaccaacgagtgccttgataacaatggtggatgttctcacgtgtgtaatgatttaaagatcggttacgagtgcttgtgccccgacgggtttcagctggtcgcccagcggcggtgtgaggatatcgatgaatgtcaggatccggatacatgcagccagctatgcgtgaatcttgaagggggctataagtgccagtgtgaagaagggttccagctcgacccccacacaaaggcttgcaaggccgtggggagcattgcttacctcttcttcacaaatcgtcatgaggtccgcaaaatgactctggatcgatctgaatacacctcactcatacctaaccttcgcaatgtggtggccctcgacacggaagtggctagcaatcgcatctattggtcagatcttagccagcggatgatctgctctacccagcttgaccgcgctcacggagtgagcagttacgacaccgtgatctcacgcgacatccaggctcccgacggattagcagtcgactggattcactctaacatctactggactgattcggtactgggcactgtatccgtggcagacaccaagggcgttaagcgtaagacacttttccgcgaaaatggatcgaagcctcgcgccattgtcgtcgatcccgtgcatggttttatgtactggacagactggggcaccccggccaagattaagaagggaggcctgaacggcgtggacatatactctctggttacagaaaacatacagtggccgaatggaataacgctggacctcctttcaggaaggttgtattgggtggactctaagctgcacagtatctcaagtattgatgtcaatggggggaaccgtaagaccattttggaagatgagaagagactggcgcacccctttagtctggccgtctttgaggacaaggtcttttggaccgatatcatcaacgaagcaatattttcagcaaatcgtttaacaggtagtgacgtcaatctgctcgccgaaaatctgctctctcccgaagatatggtgctgtttcataacctcactcaaccccgaggggtgaattggtgtgaacggactacactgtccaacgggggctgccagtacttatgcctgcctgccccccaaataaacccacatagtcctaagttcacatgcgcctgcccggacgggatgctgcttgctcgtgacatgcggtcttgcctgactgaagcggaggctgcagtcgccacccaggaaactagcaccgttagactgaaagtgagttcgactgctgtcaggacacaacacacaaccacaaggcctgtccccgacacctctcggctgccgggagcaacccctggcctcacgaccgtggagattgtcactatgagccaccaggccctgggcgatgtagctggaagagggaacgagaagaaaccctctagtgtgcgtgccctgagtatcgtgctccccattgtcctgctcgttttcctgtgtctgggggtgtttctactgtggaagaactggcgactcaagaacattaacagcatcaacttcgataatccagtttaccagaaaacaacagaggacgaggtccacatttgtcataatcaagatggctactcttacccatccatggtaagccttgaggatgatgtggcctag

SEQ ID NO: 100 - DNA, 2838 bp, Artificial Sequence
  Description of Artificial Sequence: Synthetic Transcript Sequence
tgaggccggcccggcgtgcccccccggttcctgagccagcggcggcgtcaggtgcccggccctaggtccaggttacgcgatatccacgagtcgcccagtgtgattctgggtccccctggtgaagtccccggctttcgctgcgccctttggaggcacttgcgaccccacctggtgcttggaggagccttagccccacccgcccctatcaagtttactgagggccctcccgctactctgaaggcatccgtgccttacgaggttgagactctgccccaaaatcttcctgccccgccttggtctgctgctgagattttctctcacgtgggggaccggtgtgagcgcaacgaatttcaatgtcaagatggcaagtgcatttcctacaaatgggtgtgtgacggtagcgcagagtgtcaggacgggtctgatgagagccaggaaacatgcttgtctgtcacctgcaagtccggagatttctcttgcggaggccgagtgaaccggtgcattcctcagttctggcggtgtgacggacaggttgactgtgataatgggtcggatgagcaagggtgtcccccaaaaacctgtagccaagacgagtttaggtgtcatgacggtaagtgtatcagccggcagtttgtgtgcgatagcgaccgggattgcttagatggaagtgatgaggccagctgcccggtactcacctgtggccctgcttcctttcagtgcaactcaagcacttgcatccctcaactatgggcttgtgataacgaccccgattgcgaagatggtagtgatgaatggcctcagcggtgccgcggcctgtatgtgttccagggtgattccagtccttgttctgctttcgaattccactgcctgtccggcgaatgtatacatagcagctggcgctgtgatggaggaccagactgtaaagacaagtctgacgaagagaactgcgctgtggctacctgcagacctgatgaattccaatgttctgacggaaattgtatccatggctcgcgccagtgcgaccgtgaatatgattgtaaagatatgtcggatgaagttggttgtgtgaacgtcacattgtgcgagggccccaacaaattcaagtgccactcaggcgagtgcatcaccttggacaaggtgtgcaatatggcccgcgactgccgcgactggtctgacgaaccgatcaaggaatgcgggacgaatgaatgtctggacaacaatggaggctgcagccacgtgtgcaatgatctcaaaatcggctatgaatgtctctgcccggacggatttcagttggtcgctcagcgtaggtgcgaggacatcgatgagtgtcaagacccagacacctgctcccagctctgcgttaacctagagggcggctacaagtgccagtgtgaggagggatttcagctcgacccacacacgaaggcatgcaaggctgtagggtcaatcgcctacctcttctttaccaacagacatgaagtgagaaagatgaccctcgaccgctcagaatacaccagcctgatcccgaatttgcggaacgtggttgccttggatactgaggtagcgagcaatagaatctattggtcggatctgagccagagaatgatttgtagcactcaactggatcgggcccatggagtgtcttcatatgacaccgttatcagtagagatattcaggccccagacgggctagccgtggactggattcattcgaacatctactggaccgattctgtcctgggaaccgtctcagtcgcagacacaaaaggtgtgaaacgcaagaccttgtttcgcgagaacggatccaagcccagagcgattgtggtcgaccctgtgcatggattcatgtattggaccgattggggcactcccgctaaaataaagaaaggcggtctcaacggggttgatatctacagcctggttactgagaatatacagtggccaaatggaattactctggacctgttgagcggtaggttgtactgggtggattcaaaactccatagtatatcctctatcgatgtgaacggtggcaaccgcaagaccatattagaagatgaaaaacggctagcgcatccgttttcccttgccgtgtttgaagacaaggtcttctggactgacatcattaatgaggccattttttccgcaaaccgactgaccggctcggacgtgaatctactcgcagagaacctgcttagccctgaggacatggtgctatttcataatttgacccagccacgcggagtcaattggtgtgagcgtaccacgctgagcaacgggggatgccaatacttatgtctcccggctccgcaaattaatccacacagtcccaagtttacctgcgcctgccccgacgggatgttgctcgccagagacatgcgctcatgcctgactgaggcggaggccgctgtagctacgcaggagacgtccaccgtgcggctgaaggtttcatcgaccgcagtcagaacccagcacacaactacacgaccagtccccgatacatcccgattaccgggcgctacacccggtctaacgaccgttgaaatagtgaccatgagtcatcaagccctcggcgacgttgcgggacggggcaacgagaagaaaccctctagcgttcgcgccctgtccatcgtcctgccaatcgtgttgctggtcttcttgtgcctcggggtgttcttgctatggaaaaattggaggctgaagaacatcaactctattaacttcgataaccctgtctaccagaaaaccactgaagatgaggtgcatatctgccataatcaggacgggtacagttacccaagccgacagatggtctccctggaggacgacgttgcctag

SEQ ID NO: 101 - DNA, 2220 bp, Artificial Sequence
  Description of Artificial Sequence: Synthetic Transcript Sequence
atgggcccctggggctggaagctgcggtggaccgtggccctgctgctcgccgccgccggtactgctgtgggggaccgctgcgaacgcaatgattttcagtgcaactcaagcacctgtatcccacagctatgggcatgcgacaatgaccccgattgtgaggacggaagcgatgagtggcctcaacgatgcaggggactctatgtttttcagggggattctagcccatgttccgcctttgagttccattgcttgagcggtgaatgcattcatagcagctggcgatgtgatggtggaccagactgtaaggacaagtccgacgaagagaactgcgccgttgcaacctgtaggcctgacgaatttcagtgctccgacggaaattgcatccacggcagtaggcagtgcgatagagaatatgattgtaaagacatgtctgacgaagtgggttgcgtgaatgtcacattgtgtgaaggaccgaacaaatttaagtgccactcgggcgaatgcatcaccctggacaaagtgtgtaacatggctagggactgccgcgactggtccgatgaacccatcaaggagtgtggcacaaacgagtgtttagataataacggcgggtgctcccacgtgtgtaatgatctgaaaatcggatacgagtgcctctgcccagatgggtttcagttagtggctcagcgacgatgcgaggatatcgatgagtgccaggatcctgacacatgctctcagctgtgcgttaacctggaagggggttataaatgtcagtgcgaggagggcttccaactggacccacacacaaaagcctgcaaagctgtgggctctatcgcctacctgttcttcactaatcgccatgaagttagaaaaatgacgcttgataggagtgagtacaccagcttgatccccaatttacgaaacgtagtggcgctcgacacagaagtggcttccaataggatttattggtcggatctcagtcagcgaatgatttgctcgacgcagcttgaccgggcccatggagtgtcctcctatgacaccgtaataagcagagacatccaagccccggatggtcttgctgtggactggatccattctaacatctattggactgattccgtgttaggaacagtcagcgtagctgatacaaaaggggtgaagcgaaaaacgctgtttagagagaatggcagtaaaccccgcgctattgtggtcgaccccgttcatggttttatgtactggacagactggggcacacccgcaaagattaagaaaggcgggttaaatggagtcgatatttattccctagtgacggagaacattcagtggcctaatggcataactctggacctcctgtctggaaggctgtattgggtcgactctaaacttcatagcatatcctctattgacgttaacggagggaaccggaaaacaatcctcgaggacgaaaagcgtcttgcacacccgttctccctggctgtgtttgaggacaaagtcttctggactgatataattaatgaagcgatcttctctgcaaataggctcactggcagtgacgtgaacttgctcgcggagaatctgctgtccccagaagatatggtgctcttccacaacttgacacaacctcggggagttaattggtgcgagcggacgaccctctctaacgggggttgccagtacctctgtctgcctgcccctcagataaacccgcactcaccaaagttcacttgcgcttgcccagatggtatgctgctggcacgcgacatgcggagctgtctgacggaagctgaggccgctgttgccacacaggagacctccaccgtcagactcaaagtgtcctcaactgccgtgcgcacacagcacacgaccaccagacccgtccccgacacaagtagactgcccggcgccactcccggattgaccacggttgagattgtcaccatgagccaccaggcccttggagatgtggccggcaggggaaatgagaagaagccaagcagtgtcagagcgctctcgattgtgttgcccatagtcttactggtgtttctgtgtttaggggtgtttctgctttggaagaattggaggttaaagaacattaattccatcaattttgacaacccagtctaccagaaaacaactgaagatgaggtacacatttgtcacaaccaggatggctatagctatccaagccggcagatggtttccttggaggatgatgtggcatag

SEQ ID NO: 102 - DNA, 2583 bp, Artificial Sequence
  Description of Artificial Sequence: Synthetic Transcript Sequence
atgggcccctggggctggaagctgcggtggaccgtggccctgctgttggcagcggcaggaacggccgttggagacagatgcgaacggaatgagtttcaatgtcaggacggcaagtgtatttcatacaaatgggtctgcgatggatctgcagaatgccaagatggctccgatgaatcacaggaaacgtgcctatctgttacatgtaaaagcggtgacttttcatgtggtggacgagtgaataggtgcataccacagttctggagatgcgatggccaggtcgattgtgataatgggagcgatgaacagggctgtcctcctaagacgtgcagccaggacgaatttcgatgccacgatggcaagtgcatcagtcggcagtttgtatgtgactctgacagggattgtctggatggctctgacgaagcctcttgcccggtacttacctgtggacccgctagctttcagtgtaactccagtacctgtatccctcagttgtgggcttgcgacaatgaccctgactgtgaggatggctctgacgagtggccacagagatgtcgtgggttgtacgtgtttcagggagatagtagcccctgcagtgccttcgagtttcattgtcttagtggggagtgcattcacagctcgtggcggtgtgatggcggccccgactgcaaggataagtcagacgaagagaattgcgcggtggccacctgcagaccagacgagtttcagtgtagcgacggtaactgcatccatgggtcaaggcaatgcgaccgcgaatacgattgcaaagatatgtctgacgaagtcggttgcgttaatgtcaccctatgcgagggtcccaataaatttaagtgccattctggggagtgtattactctggacaaagtgtgcaacatggcgagagactgcagagattggagcgacgaacccattaaagaatgcggaacaaacgagtgcctggacaataatggagggtgctcgcatgtgtgcaatgacctcaagatcggatacgaatgcctgtgcccagatggcttccagttggttgctcagagacggtgtgaggatattgatgagtgccaggatcctgatacctgcagtcaactttgcgtcaaccttgaaggaggatacaagtgtcagtgcgaggaaggatttcagttagatcctcataccaaagcctgcaaggccgttggaagcatagcctacctgttctttactaacagacacgaggtgaggaagatgacgttggacaggagtgaatacactagcctaatccccaatctgaggaacgtcgtggccctggatactgaagtagcaagcaacagaatctattggtctgacctctctcaacgcatgatctgttcgacccaactcgatcgggctcatggtgtctcatcctacgacacggtgattagcagggatatacaggctcccgacgggctggctgtggactggatccattccaatatctactggacagactctgttctgggcaccgtgtccgtggccgacactaaaggagtcaagcggaagaccctcttcagagagaacggctctaaacctcgggccattgtcgtcgatcccgtgcacgggtttatgtattggacggattggggaactccggctaagatcaaaaaggggggacttaacggcgtggacatatactctctcgtaacggagaatatccagtggcctaatggcatcacactcgacctcttgtcaggccgcctgtactgggtggatagcaaactccatagcattagctctatcgacgtgaatggaggaaaccggaaaactatcctcgaggatgagaagcgcctcgcacatccattctccctggccgtcttcgaagacaaagtcttttggactgacattatcaatgaagccatcttctcggccaatcgcctgactggcagcgatgtcaatctcctcgcggaaaatctgcttagtcccgaagatatggtgctgttccacaatcttacacagccgcgcggagtcaactggtgcgagaggactactttgtcaaacggaggctgccagtacttatgccttcccgcaccacagatcaatccacacagccctaaattcacatgtgcttgccctgatggtatgctcctggcacgggacatgcgtagctgtctcacagaagccgaagctgctgtggctacacaggaaacttcgactgtaaggctgaaggtaagttcaactgccgttcgtacacagcatacaacaaccaggccagtacccgacacttccagactccctggagctacccccggtctgactactgtcgaaatcgtgacgatgtctcatcaagctttaggagatgtagcaggcaggggtaacgagaaaaaaccctcatccgttcgggctctttctatcgtgctgcctatagtcttgttagtatttctttgcctcggtgtctttctcctgtggaaaaactggagacttaagaacatcaattccattaactttgacaatcccgtgtaccagaaaactacagaggacgaagtccatatttgccacaaccaggacgggtactcttatccttctagacagatggtcagcctggaggatgatgtagcatag

SEQ ID NO: 103 - DNA, 2079 bp, Artificial Sequence
  Description of Artificial Sequence: Synthetic Transcript Sequence
atgggcccttggggctggaagctcaggtggactgtcgccctcctgctggcagctgccggaaccgctgtgggagatcggtgtgagcgcaacgaattccaatgtcaagatggcaaatgtatcagctacaagtgggtgtgtgatggctcagctgagtgtcaggacggcagcgacgagagccaggagacatgcctgtccgtcacttgcaagagtggagatttttcctgcggcggacgggtgaacaggtgcatccctcagttctggagatgcgatggccaagtggattgcgacaatggaagtgacgagcagggatgtctgaccctgtgcgaaggccctaataagtttaaatgccacagcggggagtgtattaccctggataaagtgtgcaacatggcacgagactgtcgggactggagcgacgaacccataaaggaatgtggcaccaacgaatgcctggacaacaatggtggctgttcccacgtctgtaatgacctaaagattggctacgaatgcctgtgccctgatgggttccagttggtggcccaacgcagatgtgaggatatagacgagtgtcaggaccccgacacctgctcccaactctgcgtcaacttggagggcggatataagtgtcagtgtgaagagggcttccaactcgacccacatacaaaggcttgcaaggccgtgggcagcatcgcctatctctttttcactaatcgacacgaagtgcggaagatgacgttagatcgatcggaatacaccagcttgatacccaaccttcggaacgtggtggccttagatacagaggtggcatccaacagaatctactggtccgatctgagtcagagaatgatctgtagcacgcaactcgatcgcgcacacggcgtgtcatcttatgatactgtcattagtcgcgatatacaggccccagacggccttgccgtcgactggatccactcaaatatctattggaccgacagtgtgcttggcaccgtgagtgtggccgacacaaaaggggtgaagcgaaagaccttatttcgggaaaacgggtctaagccgagggctatcgtcgtcgatcccgtgcacggcttcatgtactggactgattggggcacacctgcaaaaattaagaaaggaggactgaatggcgttgacatttactcactggtgactgaaaacatccagtggcctaacggcataaccctggatctactgagcggcaggttatactgggtcgattcaaagctgcactcaatcagtagtattgatgtaaatggtggaaatcgcaaaaccatcctggaagatgagaagaggcttgcccatccttttagcctggccgtgtttgaggataaggtgttctggacagatataataaacgaggcaatcttctctgccaacaggctgaccgggtccgatgtgaacctcttagcagagaatctcctgtcacccgaggacatggtgctatttcataacttaacacagcccaggggagtcaactggtgtgagcggaccactctcagcaacggaggatgccagtatctctgtctccccgctccgcaaattaatccacattctcctaagttcacatgcgcatgcccggatggaatgctgctggccagggatatgaggtcctgtttgactgaagccgaagctgccgtggcaacccaggagactagcaccgtgcgtctcaaggtttcttccacggcagtacggacgcaacatactaccacgcggcctgtgccggatacgtcacgcctgccaggtgccacgcctgggctcactactgtggaaatcgtcactatgagccatcaggcgttaggggatgtggcgggtcggggaaatgagaagaagccaagctccgtgagagcactttctattgtcttacccattgttctgctagtgttcctgtgcttaggtgtgtttctcctgtggaagaattggcgtctgaaaaacattaactccattaactttgataatcctgtgtatcaaaaaacaacagaggatgaagtgcacatttgccataaccaggatggctacagttatcctagcagacaaatggtatccctggaggacgacgtggcctag

SEQ ID NO: 104 - DNA, 2460 bp, Artificial Sequence
  Description of Artificial Sequence: Synthetic Transcript Sequence
atgggaccgtggggctggaaactgaggtggaccgtggctctgcttctggccgcagccggaacagccgtgggcgaccgctgcgagaggaacgagttccagtgccaggacgggaagtgcataagttataaatgggtctgcgacgggagtgcagaatgtcaggatggttcggatgaaagtcaggagacttgttctcccaaaacatgtagccaggacgagtttaggtgccacgatggcaaatgcatctcgaggcagtttgtgtgcgactccgaccgcgattgtttggatgggagtgacgaggcctcttgccctgttctgacttgtgggccagcctccttccagtgcaattctagcacctgcatcccccaactgtgggcctgcgacaatgatccagactgtgaggatggcagtgacgagtggccacaacggtgtcgcggtctgtacgtcttccagggcgactcctcaccctgctcagcgtttgaattccactgtctctctggtgagtgcattcactccagttggagatgcgatgggggacccgattgcaaggataaatccgatgaggagaattgtgccgtggctacttgccggccagacgagttccaatgctcagacggaaactgcatccacggatcccgccagtgcgaccgggagtacgactgtaaagatatgtcggatgaagtgggatgtgtgaacgtgacgctgtgcgagggcccaaataaattcaaatgccattccggtgagtgcatcacattagataaagtgtgcaacatggccagagattgtcgtgattggagcgatgaacccataaaggaatgtgggaccaacgaatgcctagataataatggtggttgttcccacgtctgtaacgatctaaagatcggttacgagtgcctgtgtccagacgggtttcagttagttgcacaacgcagatgtgaggacatcgacgaatgtcaggaccccgatacctgttcacaactctgtgtcaacctggaaggcggatataagtgccagtgtgaggagggttttcagctcgatcctcacactaaggcatgtaaagcagtgggaagcatcgcgtatctttttttcaccaaccgtcatgaggtgaggaagatgacactcgatagatcggaatacacgtccctcattccaaacctaaggaatgtggtggccttagataccgaggtggccagcaatcgtatctattggtctgatctgtcacagcggatgatttgctctacgcaactggacagagcacacggagtgtcctcatacgacaccgttattagtcgcgacattcaggctcctgacggtctggccgtcgactggatacacagcaatatttattggacagactcagttctgggcactgtaagcgtggccgacacaaaaggggtaaaacggaagaccttgtttcgggaaaacggtagtaaaccccgtgctatagtcgttgatcccgtccacggcttcatgtactggactgactgggggactcctgctaagatcaaaaaaggcggattaaatggagtagatatctactctctagtaacagagaacattcaatggcccaacgggatcaccctggacctgttgtcgggtcgtctgtactgggtggattctaagctgcatagcatctccagcattgatgtgaacggaggtaacagaaagaccatcttggaagacgagaagaggctcgctcacccattcagcctggctgtctttgaagataaagtattctggactgacataattaacgaagcgattttcagtgccaacaggcttacgggatctgatgtcaatctgctggccgagaacctgctctcccctgaggacatggtgctgtttcataatctcactcaacctaggggggtgaactggtgtgagaggaccaccttatccaatggcggttgtcaatacttgtgtctgcccgcaccgcagatcaatccgcactcacctaagttcacttgtgcctgccccgacggaatgttgcttgcgagggatatgagatcctgccttaccgaggctgaggccgcagtcgctacacaagaaacatcgacggtaaggttaaaggtgagtagtaccgcagtcaggacccaacacaccacgacgcgccctgttcctgatacctcccgtctgccaggggcaaccccaggcctcaccaccgtcgaaattgtgaccatgtcccaccaagcactcggtgatgtggccggacgaggtaacgaaaagaagccctcaagtgtcagagcactgtcgatcgtgctgcctattgtcctgctcgtgttcctgtgtctgggggtcttcctgctctggaaaaattggagattgaagaacatcaattctatcaacttcgacaatcctgtctaccagaaaacaacagaagacgaggttcacatctgccataatcaagacggttatagttatcctagcagacagatggtcagtcttgaggatgacgtcgcctag

SEQ ID NO: 105 - DNA, 2049 bp, Artificial Sequence
  Description of Artificial Sequence: Synthetic Transcript Sequence
atgggcccttggggctggaaactacgctggaccgtggccctgctgctcgctgccgcagggaccgcagtgggtgatcggtgtgagcgcaatgaatttcagtgccaggacggaaaatgtatttcatacaagtgggtttgtgacggcagcgccgagtgtcaggatggaagcgatgagtctcaggaaacctgcctatccgtgacatgtaagtcaggggatttctcctgtggcggacgggttaatcggtgcataccccagttttggcgttgcgatgggcaggtggattgcgacaacggcagtgacgaacaaggctgtcccgttgccacatgcaggcctgacgaatttcagtgcagcgatggaaactgcattcacggatcccgccagtgcgatcgcgaatacgactgcaaggatatgagcgatgaagtcggatgtgtgaatgtaactctgtgcgagggtccaaataaatttaagtgtcatagcggcgagtgtatcaccctcgataaagtttgtaatatggcgcgtgattgcagagattggagcgacgagcctattaaggagtgcggaacaaatgagtgcctggataacaatggaggctgctcacatgtgtgcaatgacctcaagattggctacgagtgcctgtgcccagatggtttccaactggtagcgcagagaaggtgcgaagacatcgacgaatgtcaagaccctgacacctgctcccaactgtgcgttaatctggagggcggatacaagtgccagtgcgaggaaggctttcaactggaccctcatacaaaggcatgtaaggcggtaggcagcatcgcttatctgtttttcaccaaccgtcacgaagttcggaaaatgaccctcgaccgatccgagtacaccagcctaatccccaatctcagaaatgtggtcgctctggacaccgaggtcgcatcaaataggatttactggagcgatctgagccagcgcatgatctgctctactcagctggatcgggctcatggggtatcctcgtatgatacagtcatctcgcgagatattcaggcgcctgacggccttgctgttgactggatacacagcaacatatactggactgatagcgtgctgggcaccgtgagtgtggccgatacgaagggtgtgaagaggaaaacactgtttagagagaacggtagcaaacctcgcgctatcgtcgtggacccagtgcatggattcatgtattggaccgactgggggacccccgctaaaatcaagaaaggaggactcaacggcgtggacatctacagcttggttactgaaaatatccagtggcccaacggcatcaccctggatctgttaagtggccgtctgtactgggttgactctaaactccatagcatatcttccatcgacgttaatggtggcaatagaaagacaatcctggaggacgaaaagcggcttgctcatcccttttccctcgccgtgttcgaggacaaggttttttggacggatatcattaatgaagctatcttctccgccaatcgtcttacggggtccgacgttaaccttctcgcagaaaatctgctgtcaccagaagacatggtgctgtttcacaatctcacacaacccagagaagccgaagccgcagttgccacgcaggaaacctctacagttcgtttgaaagtttcctctaccgccgtgcgcactcagcacacaaccacaagacccgtgccggacacttcacgactgccaggcgctactccaggacttacaacagtggagatcgtcaccatgtcccatcaggccctgggcgatgttgccggtcgcggaaatgagaaaaaaccaagctccgtccgagcactatctatcgtgcttcccatcgtgctgctggtgtttctgtgtctgggcgttttcctcctgtggaagaactggagactgaagaacatcaacagtattaacttcgataacccggtctaccagaaaaccaccgaggatgaggtgcacatttgccacaaccaagacggatactcttacccaagtcgccaaatggtgtctctggaagacgacgtcgcgtag

SEQ ID NO: 106 - DNA, 2577 bp, Artificial Sequence
  Description of Artificial Sequence: Synthetic Transcript Sequence
atgggaccctgggggtggaaacttagatggactgttgctctcctgctcgccgcagctggaaccgctgttggagacagatgcgaacggaacgaatttcagtgccaggacgggaagtgtatctcttacaagtgggtctgcgatggctccgcagagtgccaggatggatccgatgagagccaggagacctgcttgtcagtcacgtgtaagagcggtgacttctcatgtgggggacgggtaaaccgctgtatacctcagttctggcggtgcgacggccaagtagattgcgacaatggcagtgacgaacaaggctgccccccaaaaacctgcagccaagatgaatttcggtgccatgacggtaagtgcatttcgagacagtttgtgtgtgacagtgacagagactgtctggatggttctgacgaagcctcctgcccggtcctgacatgcggaccggcatcgtttcaatgtaatagttctacatgcataccgcagctatgggcttgcgacaacgatcctgattgcgaagacggttccgacgagtggcctcagcgatgtcgaggactgtacgtattccagggagactctagtccatgttccgcttttgaatttcactgtttgagtggggaatgcattcatagctcttggagatgtgatggaggcccagattgcaaggataagagcgacgaggagaattgtgctgtggctacctgccgacctgatgagttccagtgttcggatggaaattgcattcacggaagcagacaatgcgaccgcgagtatgactgtaaggatatgagcgacgaggtggggtgcgtcaacgtaaccctttgtgagggccctaataaattcaagtgccattccggcgagtgtatcaccctggacaaggtgtgtaacatggcccgagactgcagggattggtctgatgaacctatcaaggagtgcggaaccaacgaatgcctggataacaacggaggctgcagccacgtttgtaacgacctgaagatcggctacgagtgtttgtgccccgacgggttccaactcgttgcccaaagaagatgcgaggatattgatgaatgtcaggatcccgatacctgttctcagctgtgtgtgaatctggagggaggatacaagtgccagtgcgaagaagggtttcaactcgacccccatacaaaggcgtgtaaggcagtcggcagtatcgcctatctttttttcactaataggcatgaagtgcgaaaaatgaccctagaccggagcgagtacacctcgctgatccctaatttacgtaacgtcgttgcccttgacaccgaggtcgcatccaacaggatctattggagcgatcttagccagcgaatgatttgtagcacgcaactggatagggctcacggagtcagtagttacgacactgtgatcagtcgagatattcaggccccagatggccttgccgtggattggattcattccaacatatactggaccgactcagtgttggggactgtgagcgtggctgacactaaaggagtcaagcgcaagacactattcagagaaaacgggtctaagccgagagctatagtggttgatcctgttcatgggttcatgtactggacggactggggcactccggcaaagatcaagaagggaggacttaatggagtggatatatattcactggtaacggagaacatacagtggcccaatggcatcactcttgatttactctccgggcgtctgtactgggtcgatagcaagctgcattccattagtagtatcgacgtgaatggtggcaatagaaagactattttagaagatgaaaagcgcctcgcccatccgtttagcttggctgtgtttgaggacaaggtcttctggacagacattattaacgaggccattttttccgcaaatcgtctcaccggcagcgatgtgaacctcctggccgagaaccttttgagccccgaggatatggtcctgttccataatctgactcagcctcgaggagttaattggtgcgaacgtactacacttagtaacggcggttgccaatatctgtgcctcccagctccacagattaatccacactcacctaaattcacatgcgcctgtccagacggtatgttactagccagagatatgagatcttgccttaccgaggccgaggccgctgttgctacccaagagacctcaaccgtgaggctaaaggtttctagtactgctgtgaggactcagcataccaccacccggccagtcccagacactagtcggctgcccggagcaaccccagggctgacaaccgttgagatcgttaccatgtcccaccaggcacttggagacgttgcgggacgagggaatgagaaaaagccgagtagtgttagggctctcagcattgttctgcccattgtgctcttggtgttcttgtgcctgggcgtattcctgttgtggaaaaactggcgactaaaaaatattaatagcattaactttgacaatccagtctaccagaagactactgaagatgaggtccacatctgccataatcaggatggctattcttatccttccatggtgtccctggaggacgacgtcgcttag

SEQ ID NO: 107 - DNA, 2838 bp, Artificial Sequence
  Description of Artificial Sequence: Synthetic Transcript Sequence
tgaggtaggccaggcgtacctccgaggttcttatcacaacgcagacggcaggtaccagggcctcgctctcgactaagggacattcatgaaagccctagtgtcatcctggggcctcctggagaagtacccggattccggtgtgcactgtggagacacctaaggccgcatttggtcttaggtggtgccctagcacccccagcaccaatcaagtttaccgagggtcctccagctacattaaaggcctccgttccttatgaagtagagacactgccacaaaatctgcccgcaccaccatggtcagcagccgagatcttctcgcacgtcggtgaccgttgtgagcggaacgagtttcagtgccaagacgggaagtgcatctcttataagtgggtttgcgatgggagcgccgaatgccaggatggttcagatgaatctcaggagacctgcctcagcgtaacctgcaagagcggcgacttcagctgtgggggtcgagttaacaggtgcattccacaattctggcgttgcgatgggcaagtggattgcgacaatggatccgacgagcaaggatgcccacccaagacgtgctcccaggatgagtttaggtgccatgatggaaagtgcatcagcaggcagttcgtctgcgactccgacagggactgtctggacggctccgacgaggcctcctgcccggtcctgacctgcggacccgcatcatttcagtgtaacagcagtacctgtattccgcagctctgggcttgcgataacgaccccgattgcgaagatgggtctgacgagtggccgcaaagatgtcgcggtttgtacgtctttcagggcgattctagtccctgtagcgcctttgagttccattgtctatcgggcgaatgtatccactccagttggagatgcgacgggggtcctgactgcaaggacaaatccgatgaagaaaactgtgcggtggcaacttgtaggccagatgaatttcagtgttcggatgggaattgtattcatggatcaagacagtgtgaccgggagtatgattgcaaagacatgtctgacgaagtgggttgcgttaatgttacattatgcgaaggtcccaataaattcaagtgtcactctggagagtgtattaccctcgataaagtgtgcaacatggcccgtgactgtcgggactggtcggatgagccaatcaaggagtgtggtacaaatgagtgccttgacaataacggcggatgttcccatgtgtgcaacgacttgaaaattggttatgagtgcctgtgccccgacgggttccagttggtagcacagcggaggtgcgaggatatagacgagtgccaggatcccgatacctgcagtcagctttgtgtgaacctcgaagggggttataaatgccagtgcgaggaagggtttcaacttgatccacatactaaagcatgtaaagctgtgggttctatcgcctatttgttcttcacaaaccggcatgaggtacggaaaatgacccttgaccggtccgagtatactagcctgattcccaacctcagaaatgtggtggcactagataccgaagttgctagcaacaggatctactggagtgatctcagtcagagaatgatatgcagcacacagttagatagggcacacggcgtgagttcgtacgacaccgtgatttctagagatatccaagcccctgatggactcgcagttgactggatccactcaaacatttactggaccgactccgtgctgggaacggtgagtgtggctgacacaaagggagttaagaggaaaaccctattcagggagaatggctctaaacccagggccatcgtagtggaccccgttcatggctttatgtactggactgactgggggacacctgccaagataaagaagggaggcctgaacggcgttgatatttactccctcgtgacggagaatatccagtggcccaacgggatcaccctggatctgttaagcggaaggttgtactgggtagacagcaaacttcattccatctcaagcattgacgtcaacggcggaaatagaaagactatccttgaggatgagaaacgcctcgcacacccattcagcctcgctgtctttgaagataaagttttttggaccgatatcatcaatgaagcgatcttctccgccaaccgcttaactggttctgatgttaatttgctggcggagaatctgctctctcctgaggacatggtactcttccacaatctgacccagccccgaggggttaattggtgcgaacggaccactctgtctaacggcggttgtcagtacttatgcctgcctgcgccacagataaatcctcatagccccaaatttacctgcgcttgcccagacggtatgcttctggccagggatatgaggagttgtttaactgaagcggaggccgctgtagccacccaagagaccagcacagtgcggctgaaggtgtcctccacagcagtgcggactcagcatacaacgactcggccagtgccagacacgtccagattaccaggtgccacacccggattgaccactgtcgagattgttaccatgagccatcaagctctgggggacgtggcagggaggggcaatgaaaaaaagccgtcttccgtcagagccctctcgattgtgctaccaattgtgctgctggttttcctgtgtcttggagtgtttctcctgtggaagaactggcgactgaagaacatcaactcaattaacttcgataaccccgtgtaccaaaaaactactgaggacgaagtccacatctgtcataaccaggacggctacagctatccaagtaggcagatggttagtctcgaagatgacgttgcatag

SEQ ID NO: 108 - DNA, 2220 bp, Artificial Sequence
  Description of Artificial Sequence: Synthetic Transcript Sequence
atgggaccttgggggtggaagctgcggtggactgttgccctcctactggccgctgctgggactgccgtaggtgacagatgcgagcgaaacgactttcagtgcaattcatccacttgtataccccagctttgggcatgcgataatgacccagattgcgaagatgggagtgacgagtggccacaacgatgcaggggcttgtacgtgttccagggagacagcagcccctgctccgccttcgagtttcattgcttgagtggcgagtgcatccactccagctggagatgtgacggaggtccggactgcaaggacaaaagtgacgaagaaaactgtgcagtggccacatgccggccagacgaattccagtgctcggatggtaattgcatccacggaagcagacaatgtgaccgggagtacgactgcaaggatatgtctgatgaagtgggttgcgtgaacgtcactctgtgtgaaggacctaacaagtttaagtgccattcaggggagtgcattacccttgataaggtgtgcaatatggctcgggactgtagagactggtccgacgagccgatcaaggagtgtggcacaaatgagtgcctcgataataacggcggatgcagtcacgtatgcaatgacctgaaaatcgggtacgagtgcctgtgtccagatggcttccagttagtcgcacaacgtcgatgtgaggatatcgacgagtgccaggatccagacacgtgctctcagttatgtgttaatttggagggcggttacaagtgccaatgcgaggagggtttccagctggatccccatacgaaggcatgtaaggcagtggggagcatagcctacctgttctttactaatcggcacgaagtgcggaagatgaccttggacagatcagagtacacatcactgattcccaacctccgcaacgtggtcgcgttggatacagaggtggcatcaaaccgcatatactggtcggacctttcgcagagaatgatctgctccacccagctcgatagagcacacggagtctcttcctacgataccgtaatttccagggacattcaggccccagatggtctggcggtggattggatccactctaatatctactggacagacagcgttctcggaacagtcagcgtggccgatactaagggggtaaagagaaaaactctgtttagggagaatgggtctaaaccaagagccatagtagtggatcctgtacacggtttcatgtactggacagactggggaacacctgccaaaattaaaaagggcggattaaatggtgtcgacatctacagtctggttactgagaacatccagtggcctaatggtattactttggacctactcagcggacgcctgtactgggttgattccaaactccactccatatcttcgatagacgtgaatggagggaatagaaagaccattttggaggatgagaagagacttgcccacccattctcactcgctgtgttcgaagataaagtgttttggacagatatcattaacgaggctattttcagcgcaaatcggttaacagggtctgatgtcaacctgctggcagaaaatctcctttcgccggaagatatggtactctttcacaacctaacacagccaagaggagtaaactggtgcgagcggacgacgcttagcaacggaggttgccagtacttgtgtctccccgctccacagatcaaccctcattctccaaaattcacctgcgcatgtcccgacggcatgctgctggccagagacatgcggagctgtctgacagaagctgaagcggcagtggccacccaagagacctcgactgttaggttgaaagtatcttctacggctgtgaggacacagcacaccaccaccaggcctgtaccagatacttccagactacccggagctactccaggcctaacaaccgttgaaattgttacgatgtcacaccaagcacttggagacgtggctggtcgcggtaacgagaagaaaccatcctctgtgcgagccctgtcaatagtgctccccatcgtcctgctggtgttcctgtgtctgggcgttttcctactgtggaagaattggaggctcaaaaatataaattccatcaactttgacaatcctgtataccagaagactactgaggatgaagtacatatctgtcataatcaggatggatactcctaccctagccgtcagatggtttcactcgaggacgatgttgcttag

SEQ ID NO: 109 - DNA, 2583 bp, Artificial Sequence
  Description of Artificial Sequence: Synthetic Transcript Sequence
atgggaccctgggggtggaaactgcgctggactgtcgccctgctgttagccgctgctgggaccgcagtaggcgatcgatgtgaacggaatgaatttcagtgccaggacggtaaatgtatctcctataagtgggtctgcgatggtagcgccgaatgtcaagacgggagtgatgaatctcaggagacttgtttatctgtgacatgcaagtccggcgacttttcttgtggcggaagagtgaaccggtgtatcccccagttctggaggtgcgatggacaggtagattgcgataacgggtcggatgaacagggctgtcctcccaagacatgtagccaggatgaattccgatgccacgacggcaagtgtatttcacggcagtttgtgtgtgactctgatcgcgattgtcttgatggttctgacgaagcaagctgccccgtgctaacttgcggccctgcaagtttccagtgcaattcctctacatgtatcccccagctgtgggcttgtgataacgatccagactgtgaggacggatctgatgaatggccccagcgatgtagggggctgtacgtgtttcagggtgattcaagtccatgctctgcgtttgaattccattgccttagtggtgagtgcatccactcatcgtggcggtgtgacgggggaccagattgcaaggataagtcggatgaggaaaactgtgccgtggcaacttgccgtcccgatgaatttcagtgtagcgatggaaactgcattcatggatccaggcagtgtgatcgcgaatacgactgcaaagacatgagtgatgaggtgggttgtgtcaacgtgactctttgcgagggtccaaataagtttaaatgccattccggcgagtgtataacactggataaagtgtgcaacatggcacgggactgccgcgattggtccgatgagccaattaaggagtgcggcaccaatgagtgtctcgacaacaacggaggttgttcccatgtctgcaacgacctcaagataggttacgaatgtttatgccctgatggctttcagctggtggcacagcgaaggtgcgaagacatcgatgagtgtcaagaccctgacacctgcagccaactgtgtgttaacctcgaaggaggctacaagtgtcagtgcgaagaggggttccagctggaccctcacacaaaggcctgcaaggccgtgggaagtatcgcgtatttgtttttcactaaccgccacgaggtgcggaagatgactctcgaccgtagcgagtatacttcattgatccccaacctcaggaacgtagtcgccttagatactgaagttgcttccaacagaatatactggagtgatctttcacagcgtatgatttgcagcacgcagttagatcgtgcacacggagtgagctcatacgatactgtgatcagtcgtgatatccaggccccagacggactagcggtggactggatccattcaaacatctattggacagacagtgtgttaggcacggtcagcgttgctgacaccaaaggcgtcaagaggaagactttgttccgcgaaaacggaagcaaaccgagggctatcgtggttgaccccgtgcatggtttcatgtattggacggactggggaacccctgctaagatcaagaaagggggactgaacggcgtggacatctatagtttggtaaccgaaaacattcagtggccaaatggcattacgctcgatcttctgtccggccgattatattgggtggattccaagctgcattctatttcaagcattgatgtcaatggtggtaatcgcaagactatcctggaggacgaaaagaggctggcacatccctttagcctggccgtgtttgaggataaggtcttttggacagacatcattaatgaggcgatcttcagcgctaatcgcctgactggatcagatgtcaacctgctagccgagaacctcctgtctcccgaagacatggtactgtttcacaacctgacccaacctagaggcgtgaactggtgtgagcgcaccacgctctccaacgggggatgccagtacctgtgtcttccagctccgcagatcaaccctcattctcccaaattcacatgcgcgtgccccgacggcatgttactcgcccgagatatgagatcttgtctgaccgaggccgaggctgccgtcgccacccaagagacatctaccgtgcgactgaaggtgtcttctacagcggtgcggacacagcacacaacaacgagacccgtgcccgatacctccagattgcccggagcaacccccggtctgacaaccgtagagatcgtgacaatgtcccaccaggccctgggagacgtggctggcagaggaaacgaaaagaagcctagtagtgttcgtgccctgtccatcgtccttccaattgttctgctggtattcctctgtctcggggtgtttctgctttggaaaaactggaggctgaagaatataaactccattaattttgataatccagtctatcagaagaccactgaggacgaagtccacatctgccataaccaggatggctattcctaccctagcagacaaatggtgtctctggaagatgatgtggcttag

SEQ ID NO: 110 - DNA, 2580 bp, Artificial Sequence
  Description of Artificial Sequence: Synthetic Transcript Sequence
atgggaccatggggctggaagctgcgatggacggtcgccctgctcctcgctgctgccggaactgcggtgggcgacaggtgcgagagaaacgagtttcaatgccaggatggcaagtgcatatcttacaaatgggtgtgcgacggttctgctgagtgtcaggacggtagtgatgagtctcaggagacatgtctaagcgtcacctgtaagtctggggatttttcgtgtgggggaagggttaatcgatgtattcctcagttctggaggtgcgacggtcaggtggactgtgataacggatctgacgagcaggggtgtcctcctaagacttgcagccaggacgagttccgctgtcacgacgggaagtgcattagcaggcagtttgtgtgtgatagtgatcgtgattgcctggacgggtccgacgaggcgagttgcccggtgttgacatgcggacccgctagttttcagtgtaactcgtctacgtgcataccacagctctgggcatgtgataatgacccagattgcgaagacgggagtgacgaatggcctcaaagatgtcggggattgtatgtttttcaaggggatagctcaccgtgctctgcattcgaatttcattgcctgtcaggcgagtgtatccattcctcctggcgttgtgacggtgggcctgactgcaaggataagtctgacgaggagaattgtgctgttgccacctgccgacccgatgaatttcaatgctctgatggcaattgtatccatggcagcaggcagtgcgatcgggagtacgactgtaaggatatgagtgatgaggtggggtgtgttaatgtgactctttgcgaaggccccaataagttcaagtgtcattccggcgagtgtataactcttgataaagtttgtaacatggctagggattgtcgtgactggtctgacgaaccaatcaaagaatgtggaacgaatgagtgcctggacaacaatggcggctgctctcacgtctgcaacgatctcaaaatcgggtatgagtgtttgtgtccagatggctttcagctggtcgctcagaggcggtgtgaagatatagacgagtgtcaagaccctgatacctgcagtcagctctgtgtgaatctggaggggggttacaagtgtcaatgtgaagagggattccaactggatcctcacaccaaagcctgcaaagccgtgggatcaatagcctacttgttcttcactaaccgtcacgaagtgcgcaagatgaccctcgacaggtcagaatatacatccctgataccgaacctgaggaatgttgtcgccttagataccgaggtcgcatccaatcggatttattggagcgacctgagtcagaggatgatctgcagcacccagcttgatagagcccacggcgtcagctcatatgataccgtgatcagtagagatattcaagccccggatggactcgcagtggattggattcattcaaacatctattggacagactcagtactggggacggtgtccgtcgccgacacaaaaggcgtgaagcggaagacactgttcagggagaacggatctaagccccgcgccatcgttgttgatcctgtacatgggtttatgtactggacggattggggaacgcccgccaagattaagaaaggaggacttaacggggtggatatatattcccttgtaactgagaatatacagtggccgaatggcatcaccctggatctgttgagtggccgactgtactgggttgattccaagctgcactcaatcagtagcatcgacgttaacgggggaaataggaagaccatcttggaagacgaaaagcgactggcccatcccttcagcctcgctgtgtttgaggataaagtgttttggacagacatcatcaacgaagcaattttttcagcaaacaggctcacaggttcagatgttaatctactggccgaaaatctcttgagtcctgaggacatggttcttttccacaatcttacacagccacgtggcgtgaactggtgtgaaaggacaactctgagcaatggtggatgtcagtatctgtgtttaccagccccacagattaatccccactcccctaagtttacttgcgcgtgtcccgacgggatgctccttgcccgcgatatgcgctcctgcctcacggaagcagaagccgcagtggctacccaagagactagcactgtcaggctcaaggtgagttcaacagcggtgcgaacgcaacacacgactaccaggcctgttccggacacatcgcggttgcctggagcaacaccgggtctgactacagtggaaattgtaaccatgtcccaccaggcactaggtgacgtggcaggtaggggcaatgagaaaaaaccctcctctgttcgcgccctatctatcgttttaccaattgtgttactcgtgttcctgtgtctcggagtgtttctgctatggaagaattggagactcaagaacattaatagtattaattttgacaaccccgtttatcagaaaacaacagaggatgaggtgcacatatgccacaatcaggatgggtattcatacccttctcgacagatggtgtccttagaagacgacgtggca

SEQ ID NO: 111 - DNA, 2580 bp, Artificial Sequence
  Description of Artificial Sequence: Synthetic Transcript Sequence
atgggaccgtggggatggaagctgaggtggactgtggccctgctgctcgcagcagccgggaccgcggtgggcgatcggtgcgaacggaacgaattccagtgtcaagacggaaaatgcatcagctacaagtgggtttgcgatggatcggccgaatgccaggacggatctgatgagtcccaagagacgtgtttgtcggtgacctgcaagagcggggatttctcatgcggaggacgcgtcaataggtgcatcccgcagttttggcggtgtgatggacaggtggattgcgataatgggtcagatgagcagggatgcccgccgaaaacctgctcccaggacgaattcagatgccatgacggtaagtgcatttcgcgccaattcgtctgcgactcggaccgcgactgcctggatggctcagacgaagcctcgtgcccggtgctgacttgcgggcctgcgagcttccaatgtaactccagcacgtgtatcccgcagctgtgggcttgtgacaatgacccagactgcgaggatggatcggacgaatggccgcagcgctgccggggcctttacgtgttccaaggagactctagcccatgctccgcgttcgaattccactgcctgtccggagaatgtatccactcatcttggcggtgcgacggtggaccagattgcaaggacaaatcggacgaggaaaattgcgcggttgccacttgtagaccagatgaatttcaatgctccgacggaaactgcattcatgggagcaggcaatgcgacagggagtacgactgtaaagatatgtcggatgaagtgggctgtgtgaacgtcaccctgtgcgaaggcccgaacaagttcaagtgccactcgggggaatgcatcactctggacaaggtgtgtaacatggcgcgcgactgtcgggattggtcggatgaaccgatcaaggaatgcggtactaacgaatgcctggacaataacggcggatgttcgcacgtgtgtaatgacctgaagatcgggtacgaatgcctgtgcccggacggattccagctggtggcgcagcggcgctgtgaggacatcgatgaatgtcaggacccggacacctgctcgcagctgtgcgtgaatctggagggtggatacaaatgtcagtgcgaggaaggattccaattggatccccatactaaggcctgtaaggccgtggggtctatcgcgtacctctttttcactaatagacatgaagtgcgcaaaatgaccctcgaccgttccgagtatacctcgctcatccctaacctccggaatgtagtggcgctcgacactgaggtggcgtctaaccgaatctattggtccgacctttcccagagaatgatctgttcgacgcaactggacagggcccatggtgtgtcgtcttacgatacggtcatcagccgggacatccaagcgcctgatggattggcagtggattggatccactcgaatatctactggactgattcagtgttgggaaccgtttccgtcgctgacactaaaggcgtgaagagaaagaccctgttccgggagaatggatccaagccacgcgccatcgtcgtggatccggtccatgggttcatgtactggaccgattggggaaccccggccaagatcaaaaagggaggtctgaacggagtggacatctactcgctcgtcaccgagaatattcagtggcctaatgggatcacccttgatctgctctcgggccggctgtactgggtggacagcaagctgcattccatctcgagtatcgatgtgaatggaggcaaccggaaaacgatactggaagatgagaaaagactcgcccacccattctcgctggcggtgttcgaggacaaggtgttttggaccgacatcattaacgaagccattttctccgcaaaccgcctcaccggctccgacgtgaacttgctggcggagaatctgctgtccccggaggatatggtgctgttccacaacctgactcagcctagaggggtgaactggtgcgaacgcaccaccttgtcgaatggcggatgtcaatacctgtgcctcccggccccccaaatcaatcctcattcccctaaattcacgtgcgcgtgcccagatggcatgctgctggcacgcgatatgcgcagctgcctcacggaagcggaggctgctgtggcaactcaagaaacctcaaccgtccggctgaaggtgtctagcacggcagtgcgcactcagcacactactacccgcccggtgccggacacgagccgccttccgggagctaccccgggacttactactgtggaaatcgtgactatgtcgcaccaggcgctgggagacgtggcgggacgcggcaacgagaaaaagccatcctcggtcagagctctctcaatcgtgctgccgatcgtgctgcttgtctttctctgcctcggagtgttcctcctctggaagaattggcgcctgaagaatatcaatagcatcaattttgataatccagtgtaccaaaagactaccgaggacgaagtccatatatgtcacaatcaagacggatactcgtacccgtccagacagatggtgtcactcgaggacgacgtggcc

SEQ ID NO: 112 - DNA, 2580 bp, Artificial Sequence
  Description of Artificial Sequence: Synthetic Transcript Sequence
atgggcccctggggctggaaactgagatggacagtggctctgctgctcgctgccgctgggacagctgtgggagaccgatgtgaaaggaacgagttccagtgtcaggacggtaaatgcattagctataaatgggtgtgtgacggcagtgcagaatgccaagatggtagtgacgagagccaagaaacatgcctctctgtgacttgtaagagtggcgatttttcttgtggagggcgggttaacaggtgcatcccccaattttggaggtgtgatgggcaggtcgactgcgataatggaagcgacgagcaggggtgcccacccaaaacctgctcacaggatgagttccggtgccatgacggcaagtgcatttcccgacagttcgtctgcgacagtgatagagactgtctagatggtagtgatgaagcctcctgtccggtgctcacctgcgggccagctagttttcagtgcaattctagcacatgcatcccacagctatgggcctgcgataatgatcccgattgcgaagatggctcagatgagtggccacaacgctgcagagggctgtatgtattccagggagatagttctccatgttccgcctttgaattccactgcctgtcgggcgagtgtatacactccagctggcggtgtgatggaggccctgactgtaaggataagtctgatgaggagaactgtgctgtcgctacatgcaggcccgatgaatttcagtgctccgacggcaattgtattcacgggtccaggcaatgtgatcgcgaatatgattgcaaagacatgagcgacgaagttggctgtgtaaacgtgacattgtgtgaggggcccaacaaattcaagtgccatagcggcgaatgcattacactggataaggtgtgcaatatggcgcgcgattgccgggattggagcgacgaacctatcaaggagtgtggcacaaatgagtgcctggacaacaacggtgggtgctcccacgtgtgtaacgacttaaagattggttacgagtgtctttgcccggacggattccagttagtggcacagcgacggtgtgaggacatcgacgagtgccaagaccccgacacctgtagtcagctgtgcgtaaatctggaaggtgggtataaatgccaatgtgaagagggctttcagctcgacccacacaccaaagcttgcaaggccgttgggagtatcgcatatctcttttttacaaatagacatgaagtccggaagatgacccttgaccgttccgagtacaccagtctgattcccaacttgcgcaacgtggttgcactggacaccgaggtggctagcaacagaatttactggtctgaccttagtcaaaggatgatctgctccacgcagctggacagggcacacggtgtgagttcatatgacacagtcatctccagggacatccaggcaccagatggactcgccgtcgattggatccatagcaacatctactggactgacagtgttctggggacggtgtccgttgccgatactaagggggtgaaacggaaaactctatttagagagaatggtagtaagccgagagccatcgtcgttgatccagttcatgggtttatgtattggacagattggggaacacctgcaaaaataaagaaaggggggctgaatggggtggacatatactcactggttaccgagaacatccagtggcctaatggcatcaccctggatctactcagtgggcggctctattgggtggattctaagttgcattctataagctcaattgatgtaaacgggggcaaccgcaaaactattctggaagacgagaagcggttggctcatcctttttccctggcagtcttcgaggataaggttttttggacggatatcatcaacgaagcgattttcagcgccaaccgattgactggatctgacgttaacctgctggcggagaaccttctttcccctgaagacatggtgctgtttcataatcttacacaaccccggggggtgaactggtgcgagcgtaccaccctgtctaacggcggctgtcagtacctgtgcttgcccgctccccagataaacccccactccccgaagttcacatgcgcgtgtcctgacgggatgctgctagcccgagacatgcggagctgcctcacagaagcagaggcagcggttgccactcaagagacatctaccgtgagattgaaggtctccagcacggctgtaagaactcagcataccacgactcggcctgtgcccgacacgtctaggctcccaggggcaaccccaggcctgacaaccgtagaaattgtcactatgtcccatcaggccctgggcgacgtggccgggcgcggaaacgaaaagaagccaagctctgtccgggctttgtctatcgtgctccctatcgtgctgctggtcttcctttgtttgggagtattcttgttgtggaaaaattggcggctcaaaaatatcaactctatcaatttcgacaaccctgtgtaccagaaaacaactgaggatgaggtccacatttgtcacaatcaggacggctattcttaccctagtcgacagatggtttccctggaggatgacgtcgcc

SEQ ID NO: 113 - DNA, 2580 bp, Artificial Sequence
  Description of Artificial Sequence: Synthetic Transcript Sequence
atgggaccgtggggttggaagctgagatggaccgtggcgctcttgctggccgccgctggaaccgccgtcggggaccgttgtgaacggaatgaattccaatgtcaagatggtaagtgcatctcatacaagtgggtgtgcgatggttcggccgaatgccaagacggcagcgatgagtcccaggagacttgcctgtcagttacctgtaagtcaggcgacttctcgtgtggaggcagggtgaaccgctgcattccacagttctggcggtgtgacggacaagtggattgcgacaatggatcagacgagcaaggatgcccgccaaagacttgcagccaggacgaatttagatgtcacgacggaaagtgcattagccggcaatttgtctgcgattccgacagagattgcttggatggctccgacgaagcctcatgtcccgtgctcacgtgtgggccagctagcttccagtgcaattcctctacctgtatcccacagctctgggcttgtgataacgacccggattgcgaggatggatccgacgagtggccccaacgctgcagggggctttacgtgttccaaggagactcaagcccatgcagcgctttcgagttccattgcctgtcgggagaatgcatccatagctcatggaggtgcgacggagggccggactgcaaggacaaatctgacgaggaaaactgtgctgtcgccacctgcagacccgacgagttccagtgttccgatggcaactgcatccacggctcgcgccaatgtgatagggaatacgattgtaaggacatgagcgatgaggtcggctgtgtgaacgttaccctgtgcgaaggccctaacaagttcaagtgccactcgggagagtgcatcactctcgacaaggtgtgcaatatggctagagattgtagagactggtctgacgagccgatcaaggaatgcggaaccaacgaatgcctcgataacaatggaggttgttctcacgtctgcaatgacctgaaaatcggttacgaatgcctctgcccagacggattccagctcgtggcccaacgccgttgcgaggatatcgacgaatgtcaagaccctgacacttgctcccagctctgcgtgaaccttgaagggggatacaagtgccagtgcgaagaaggcttccagcttgatcctcataccaaggcttgtaaggccgtaggaagcatcgcgtatctgttcttcactaataggcacgaggtgaggaaaatgactttggaccgatccgagtacacctcgctgattccgaatctccgcaacgtggtcgcgctcgatactgaggtcgcgtcgaaccgcatttactggtcggacctgtcccagcgcatgatctgttcgacccagctggaccgggcccatggtgtgtctagctacgacactgtcattagccgcgacatacaggcgccggacggcctggccgtggactggatccattcaaacatctattggacggatagcgtcctgggtacggtgtcggtcgcagacaccaagggcgtgaaacggaaaacgctgttccgcgagaatggatcaaagccaagagccatcgttgtggacccggttcatgggtttatgtactggaccgactggggaaccccagcgaagatcaagaaaggtggactgaatggagtcgacatctactcgctggtcactgaaaacatccagtggcccaatggcatcaccctggatctcctgtccggacggctgtactgggtcgatagcaaactccactcgatctcatccatagacgtcaatggaggtaatagaaaaaccattcttgaggacgaaaagcggttggctcacccttttagtctggccgtgtttgaagataaagtgttttggactgatatcatcaacgaagcgatcttttcggcaaacaggctgactggttcagacgtaaacctcctcgcggagaacctcctgtcgccggaggacatggtgctgttccacaacctgactcagccgaggggagttaattggtgtgagcgcactaccctgtcgaacggagggtgtcagtacctttgcctcccagcaccacaaatcaacccccactcaccaaagttcacgtgcgcgtgtccggacgggatgttgttggcacgggatatgcgctcgtgtctgactgaagcagaagccgctgtggcaacccaagaaacttcgactgtgcgcttgaaggtcagctccacggcagttcgtacccagcacacgaccacccgcccggtccctgatacttcgaggctgccgggagcaaccccgggactgaccactgtggaaatcgtgaccatgagtcatcaggcgctgggcgatgtggcgggccggggaaacgaaaagaagccgtcgtccgtgagggccctgtccatcgtcttgcccatcgtgctgctcgtgtttttgtgtctcggtgtctttcttctgtggaaaaactggcgcctcaaaaacataaactccattaacttcgacaaccctgtgtatcagaaaactacggaggacgaggtgcacatctgccacaaccaagatggctacagctacccgtcccgccagatggtgtccctggaggacgatgtggcc

SEQ ID NO: 114 - DNA, 2580 bp, Artificial Sequence
  Description of Artificial Sequence: Synthetic Transcript Sequence
atgggaccttgggggtggaaacttcgttggaccgtggccctcctgctcgcggccgccggtaccgccgtcggggatagatgtgaacgcaatgaattccagtgccaggacggtaaatgtatttcgtacaagtgggtctgtgatgggtccgcagaatgtcaggatggttcagacgaaagccaagagacttgcctttcggtcacctgtaaatccggtgatttctcatgtggaggacgtgtgaacagatgcattcctcaattctggcgctgtgatggacaagtggattgtgataacggttccgacgaacaaggttgtcctcctaagacgtgttcgcaggatgagtttaggtgccatgatggaaagtgcatttcgaggcagttcgtgtgtgactcggatagagattgcttggacggatcagatgaggcgtcctgtccagtcctgacttgtggtcccgcatcatttcagtgtaactcctcgacttgtatcccccagctttgggcctgtgacaacgacccagactgcgaagatggttcagatgaatggccacaaaggtgtagaggattgtacgtgttccaaggcgattcctccccgtgctccgcttttgaatttcattgcctttcaggggaatgtattcactcatcatggagatgtgatggagggccggattgtaaggacaagtcagatgaagaaaattgcgctgtcgcgacttgtcgtccagatgaatttcagtgctcggatggaaactgtatacacggatcccgtcaatgtgatagagaatacgattgtaaggatatgtcagatgaagtcggttgtgtcaacgtgaccctttgtgaaggtcctaacaagttcaagtgccacagcggagaatgtattacgctggacaaggtgtgtaacatggcaagagattgtcgcgactggagcgacgaacctattaaggaatgcggtactaatgagtgtcttgacaacaacggaggttgctcgcacgtgtgtaacgatctcaaaatcggttacgaatgtctgtgcccggacggatttcagctcgtggcccaacgccggtgtgaagatattgatgagtgccaggatcctgatacgtgctcccagctttgcgtgaatctggagggcggatacaagtgccaatgtgaggaagggttccaacttgacccccacacgaaggcatgtaaggccgtgggatccatagcatacctgttctttactaatcggcacgaagtgcgtaagatgactttggatcgatcagaatacaccagccttataccaaacctgcgcaacgtggtggcactggacaccgaagttgcctccaaccgtatttactggtccgacctcagccaacgaatgatttgttcaacccaacttgacagggcacatggtgtgtcgtcctatgacacggtgatttcacgcgatattcaggcacccgatgggctcgcagtcgactggatccattcgaatatctattggaccgatagcgtccttgggaccgtgtcggtggctgatactaaaggggtgaagagaaagactctgtttcgagaaaatggatctaagccacgggcaattgtggtcgatccagtgcatgggtttatgtactggaccgactgggggacgccagcgaagatcaaaaaaggcgggctgaacggcgtggatatctactccctggttacggaaaacatccagtggcctaacggtatcaccctggatctgctgagtggacggctttactgggtcgactccaagttgcattcaatttcaagcattgacgtgaacggtgggaatcggaaaaccattcttgaagatgaaaagagacttgcacatccgtttagcttggcagtgtttgaggataaggtgttttggaccgacatcataaacgaagccattttcagtgccaatagattgaccggtagcgacgtcaatctgctggcggaaaatctgctgtccccagaggacatggtgctgtttcataatctcacgcaaccccgaggcgtgaattggtgtgaacgcactacgcttagcaatggaggatgccagtacctgtgtttgcccgctcctcaaatcaaccctcattcgccgaaattcacctgtgcctgtccagacggaatgctccttgccagagatatgcgcagctgcctcaccgaggctgaggctgcagtggcaactcaagaaacttcgaccgttcgactgaaagtttcctccacggctgtgcggactcagcataccactaccaggccagtcccagatacctcaagacttccaggagcaaccccaggactgactactgtggagattgtcacgatgtcacaccaggcacttggtgatgtggctggtagaggcaatgagaagaagccatcttcagtgcgagcactttccattgtcctcccaattgtgttgcttgtttttctttgtctcggagtgtttctgctctggaaaaactggcggctgaagaacatcaatagcataaactttgacaacccagtctaccagaaaactaccgaggatgaggtgcatatttgccacaatcaagatggctattcctacccgtcccgccagatggtcagtctggaagatgacgtcgca

SEQ ID NO: 115 - DNA, 2580 bp, Artificial Sequence
  Description of Artificial Sequence: Synthetic Transcript Sequence
atgggtccctggggctggaaactgcggtggaccgttgccctgctgctagctgcggcaggtacagcagtgggcgaccggtgcgagcgaaatgagtttcaatgtcaagatgggaagtgcatcagctataagtgggtgtgcgatggctccgccgagtgccaggatggcagtgatgagtcacaagaaacatgcctctccgtgacatgtaagtcgggcgattttagctgtggcggtagagtgaacaggtgcatcccccagttttggaggtgcgatggccaggtcgactgcgacaatggcagcgacgaacagggatgtcccccgaagacatgttcccaagacgagtttcggtgccatgacggaaagtgtatctcccggcagttcgtttgtgactccgaccgagattgcctggacggcagtgatgaagcatcttgtcctgtcctgacttgcggcccagccagctttcaatgcaactcatctacatgtatccctcagctctgggcatgcgataatgatccagattgcgaggatgggtccgacgagtggccgcagcgctgccgggggctttacgtgttccagggcgattccagcccgtgctccgcatttgaattccactgtctgtctggggaatgtatacactcatcctggcgctgtgacggcggccctgattgcaaggataagagtgacgaggaaaactgcgcagttgccacttgccgtcctgatgagtttcagtgttctgatggaaactgtattcacggatctaggcagtgcgacagagaatatgattgcaaggatatgagtgacgaagttggctgcgtcaacgtaacactgtgcgaaggtccgaataaattcaagtgccactcaggggaatgcatcaccctggataaggtctgcaacatggcacgcgactgcagggattggagcgatgagcccatcaaggagtgtggcacaaatgaatgtcttgataataatggtggctgcagccacgtctgtaacgatctgaagatcggttacgagtgtctgtgcccagatgggtttcagctggtcgcacagcgaaggtgtgaggacatagatgagtgtcaggatccggacacctgttctcaactctgcgtaaatctggagggtggatacaagtgccagtgcgaggaaggctttcagttggatccacatactaaggcgtgcaaggccgtcggatcgattgcttacctctttttcactaacaggcatgaggttaggaaaatgacgctcgatcgcagtgaatacactagcctgatcccaaacctgaggaacgtcgtagctttggatactgaggttgctagcaatcggatatattggagcgatctctctcagagaatgatttgctctacccagctggacagggcacacggggtctctagctatgacaccgtcataagcagggacatccaagcacctgacgggctcgcagtcgattggatccactctaatatatactggaccgatagcgtgcttgggactgtgagcgtggctgataccaaaggcgtcaagcggaaaactctcttccgagagaatgggtctaagccaagagctattgttgtggatcctgtccacggcttcatgtattggaccgattgggggacgcctgctaagatcaagaagggcgggttaaatggggtggatatctacagtctggtaaccgagaatatccaatggccaaacggcatcaccctggacctgctgtccggaaggttgtactgggttgattcgaaactgcatagtattagtagtatcgacgtaaatggcggtaatcggaagaccatacttgaggacgagaagaggctggcccaccctttctctttggctgtgttcgaggataaggttttttggaccgatattattaacgaagcaattttttccgcaaatcgtttgacaggatccgatgtgaacctgctggcagagaacctgttaagccccgaagatatggtgctattccacaatctgacgcagcccagaggagtgaactggtgcgaaaggacaaccctctccaacgggggatgtcagtatctgtgtctcccagccccgcaaatcaaccctcactccccaaagtttacatgtgcctgccctgacggaatgctcctcgcacgagacatgcgatcttgtctaacagaggcagaagccgctgtggccacacaagaaacatctacagttcgcctgaaggtgagttcaactgctgtccgaactcagcacaccactacaagacctgttccagacacgtctagactcccaggagctactcccgggctaaccactgtcgaaatcgtgaccatgtcccaccaagccctcggggatgtggccgggcgtggaaacgaaaaaaagccttcctccgtgcgggcgctgtctatagtgctgcccattgtgcttctcgttttcctttgcctaggggtgttcttactgtggaagaactggaggcttaaaaatattaacagcatcaacttcgacaatcccgtgtaccagaagactaccgaggatgaggtgcacatctgtcataatcaggatggttacagctaccctagccggcagatggtgtcactggaggacgacgtggcg

SEQ ID NO: 116 - DNA, 2580 bp, Artificial Sequence
  Description of Artificial Sequence: Synthetic Transcript Sequence
atgggaccatggggatggaaactgcgatggactgtcgccctcttgctcgccgcggccggaactgctgtcggggaccggtgtgagcggaacgagtttcagtgtcaggacggcaagtgtataagttataaatgggtatgcgatgggtccgcagaatgccaggacggaagcgacgaatctcaagaaacgtgtctgtccgtaacctgcaagtccggtgacttctcatgcggggggcgcgtgaaccgctgtattccccaattctggagatgcgacggccaggtcgactgcgacaacggctcagatgaacagggatgcccgccgaagacttgctcccaggacgagtttcggtgccacgatggtaaatgcataagccgacagtttgtgtgcgactccgacagagactgcctcgacggatcagatgaggcatcttgtcctgtccttacctgcggtcccgcatcttttcagtgcaactcaagtacatgtatcccccaactgtgggcatgcgacaatgatcctgattgcgaggacggctccgatgagtggccacagcgatgcaggggtctgtacgtttttcaaggcgattcctcaccttgtagcgcatttgagtttcactgcttgagtggagagtgcatacacagctcttggaggtgtgatggcggccctgattgtaaggacaaatctgacgaggaaaattgcgctgttgcaacttgcaggccagacgagttccaatgtagcgacgggaactgtatccacggctctaggcagtgtgaccgagaatacgactgcaaggacatgagtgacgaagttggttgcgtgaacgtaacactctgcgagggccctaacaagttcaagtgccactcaggagaatgcatcacactggacaaagtctgcaatatggcacgggattgtcgggactggagcgatgagcctattaaggagtgtggtacaaatgagtgcctggataacaacggcggttgttctcatgtttgcaatgatctgaaaatcggatatgaatgcctgtgcccagacggctttcagctggtcgcacagcgccggtgtgaggacattgacgaatgtcaggatcccgatacatgctctcagttgtgtgttaatttggaaggcggctacaaatgtcagtgcgaggaaggattccagctcgaccctcatacaaaggcatgcaaagctgtcggatccatcgcatatctgtttttcactaataggcatgaggtccggaagatgactttggaccggagtgagtacacttccctgatccccaatcttcggaatgtggtggctttggacacagaagtcgcctccaatcgcatctattggagcgatcttagtcaacgaatgatatgttctacgcagctcgaccgagcccacggcgtgtcttcctatgataccgtaattagcagagacatccaggcgccagatggcctggcagtggactggattcacagcaatatttattggaccgattctgtactgggaacggtgtctgtggctgacactaagggcgtgaagaggaagaccctgtttcgcgagaatggctctaaacctcgcgccatcgtcgtggacccagtgcacggctttatgtattggacagattgggggaccccagcaaagattaagaagggcgggctgaatggagtggacatctacagcttggtcaccgagaacatacagtggcccaatggaataacattggatttgctgtccggaagactctattgggtggattctaagctccatagcatttctagcattgatgtaaatggcggaaatcgaaagaccatactggaagatgaaaaaaggctggcacacccgttttccctggctgtgttcgaggataaagtgttctggacagacattattaacgaggccatcttcagcgctaacagactgactgggtcagacgttaatctgctcgcagagaatttgctgagcccggaagatatggtcctttttcataatttgacgcagcctagaggtgttaattggtgtgaaagaacaaccctcagtaacggaggctgccaatacttgtgtctgcccgccccccagataaatccccactcaccgaagtttacctgcgcctgcccagacggtatgctcctggcacgcgatatgcgatcctgtcttactgaggccgaagcagccgtagctacccaagaaacatccacagttcggttgaaggtgtccagtacggctgtcagaacccagcataccacaacgaggcctgttcctgacacttcccgcctgccaggagctacgcctggtttgactaccgtcgaaattgtgaccatgagtcaccaagcactgggcgatgttgccggaaggggaaatgaaaagaaaccatcctctgttagggccctgagcatagtgctgccgattgtgctcctcgttttcctgtgcctgggtgtgtttcttctctggaaaaactggcgcctgaaaaatatcaactctatcaacttcgacaaccccgtatatcagaagactacagaagacgaggtgcatatctgtcataaccaagacgggtatagttacccatctagacaaatggtgtctctggaagatgacgtagcc

SEQ ID NO: 117 - DNA, 2580 bp, Artificial Sequence
  Description of Artificial Sequence: Synthetic Transcript Sequence
atgggtccatggggctggaaacttcggtggactgtggccttgctgcttgcagccgcaggaaccgccgtgggagacagatgcgaacgtaatgagtttcagtgccaagatggcaaatgcatctcctataagtgggtgtgtgacggctcggcagagtgtcaggatggcagcgatgagtcacaagaaacgtgtctgtccgtgacctgcaagagcggtgatttttcatgtggaggacgagtcaacagatgtatcccgcaattttggagatgcgatggccaggtagattgtgacaacggctctgatgagcagggttgtccacccaagacctgctcccaggatgagtttagatgtcatgacgggaagtgcatctccaggcaattcgtgtgtgacagcgatcgtgactgcttggacgggtccgacgaggcatcgtgtcctgtgcttacctgtggcccagcttcctttcaatgcaacagcagcacctgcataccgcagctctgggcctgcgataatgatccagattgcgaggacgggtcagatgaatggcctcaacggtgtcgagggctctacgtctttcagggagattcctcgccatgttcggcatttgaatttcattgcctgagcggtgagtgcatacactcgtcatggcgttgcgatggcggaccagattgtaaggataagtcggacgaggaaaactgcgcagtggccacctgccggcccgatgaatttcagtgttcggatggaaactgcatacatggatcgcgccaatgcgatcgtgagtacgactgtaaggacatgtcggacgaggtcggttgtgtgaacgtgaccctttgtgaagggccaaacaagttcaagtgtcactccggagaatgtattactctggataaggtctgcaacatggctagagattgccgcgattggtcagacgaacccattaaagagtgtggcaccaatgagtgcttggacaacaatggcggatgctcccacgtgtgtaatgacctcaagattggctacgagtgcctgtgtccagacggatttcagctcgtggcacagcggagatgtgaggacattgatgaatgtcaagatccagatacttgttctcaattgtgtgtcaatcttgaaggtgggtacaagtgtcaatgtgaagaaggatttcaacttgatcctcacaccaaagcatgcaaggcagtgggttcgatagcctacctgttctttactaacagacacgaggtgcgaaagatgactctggaccgaagcgaatacacctccctcatccctaacctccggaacgtggtcgcgctcgatactgaagtggcatcaaacagaatatactggtctgatcttagccaaaggatgatctgctccacccaactggatcgagctcacggagtgtcatcgtacgatactgtgatttcgcgcgatattcaagcacccgatgggctggcggtggactggatccattcgaatatctactggaccgattccgttctgggaacggtgtcagtggcagacactaagggtgtcaagagaaaaaccctgtttagagagaacggctcgaaacctcgggcaattgtggtggatccagttcatggatttatgtactggactgactggggaactcctgcaaagataaagaagggaggtctgaatggagtggatatctactcactcgtgactgaaaacatccaatggccaaatgggattaccctggatttgctctcaggacgactgtactgggtggactccaagctgcattccatttccagcatcgacgtcaacggaggtaataggaaaaccatactcgaggatgaaaagcggctcgctcatcctttttcgctggctgtctttgaagataaggtgttctggaccgatatcattaatgaagcgatctttagcgccaaccggctgactggatcggacgtgaaccttctggcagaaaacctgctttcgccggaggacatggtgctgttccataatctgacccagccccggggagtgaattggtgcgagcgcactaccctgtcgaatggtggttgtcaatacctgtgcctccctgcacctcaaatcaatccccactcgcctaagtttacctgtgcatgtccagatggaatgctgctggcacgagacatgcgatcgtgtttgacggaagcagaagcagccgtcgcaacgcaggaaaccagcacggtccgactgaaagtctcctctaccgcagtcaggactcaacatactaccactagaccggtgccggacacttcgagacttcccggagcgactcctggtcttaccacggtggaaatcgtgaccatgagccatcaggcactcggagatgttgcaggaaggggtaacgaaaagaagcctagctccgtcagagcgctttcgatcgtgctccctattgtgctgctcgtgttcctttgtcttggggtgtttctgctttggaagaattggcgcctgaaaaacattaacagcataaactttgacaaccctgtgtaccagaaaactactgaggatgaagtccacatatgtcacaatcaggatggttactcctacccttcgcggcagatggtttcactcgaagatgatgtggcg

SEQ ID NO: 118 - DNA, 2580 bp, Artificial Sequence
  Description of Artificial Sequence: Synthetic Transcript Sequence
atgggaccgtggggatggaagctgagatggaccgtcgccctcctgcttgcagcagctggaactgcggtgggtgacagatgtgaacggaatgaattccagtgccaagatggtaagtgcatttcctacaaatgggtgtgcgatggatcggccgagtgtcaagacggatccgatgaatcgcaggaaacttgtcttagcgtcacctgtaagtccggtgacttttcgtgtgggggtcgcgtgaaccggtgtattccacagttctggcggtgtgatggacaagtcgattgcgataacggttcagatgaacagggatgtcctccaaagacctgttcgcaagacgaattccgatgtcacgacggaaaatgcatttcccgccaattcgtgtgtgacagcgatcgggactgtctggacggaagcgatgaggcttcctgtcctgtgctcacctgtggaccagcttccttccagtgtaactcgtcgacctgtatccctcaactgtgggcctgcgataacgatccagactgtgaggatggtagcgatgaatggccacaaaggtgcagaggattgtacgtgtttcaaggcgattcaagtccatgtagcgcgtttgaattccactgcctgtcgggtgaatgtatccattcatcctggcgttgtgatggaggtccagattgtaaggataaatccgatgaggaaaactgcgcggtcgcaacttgcaggccagacgagtttcagtgctcggatggtaactgtatacatggatcaaggcaatgtgatagggaatacgactgtaaggatatgagcgatgaagtgggttgcgtcaatgtaactctgtgtgaagggccaaacaagtttaagtgccactcaggcgaatgcattactctggataaggtctgcaacatggcaagagactgccgggattggtccgacgaacctataaaggaatgtggaactaacgaatgtctggacaataacggaggatgttcccatgtgtgtaacgatctgaagatcggctacgaatgtttgtgtccagacggattccagcttgtggcacaacgccgctgtgaagatatagatgagtgccaggaccccgatacttgttcccaactgtgcgtgaaccttgaaggaggttacaagtgccaatgtgaagaaggtttccaattggaccctcataccaaagcatgcaaggcagttggatcgatcgcatacctcttctttaccaaccgtcatgaagtcaggaaaatgaccttggatcggtccgagtacacctccctgattccgaacctgagaaacgtcgtggcattggataccgaggtggcctcgaaccgcatatactggtcagacctgtcccaacggatgatttgcagcactcaactggaccgggcgcatggggtttcatcctacgatactgtcatttcaagggatatccaagcccccgatggacttgctgtcgattggattcattcgaacatctactggactgactcggtgcttggaaccgtgtcggtcgcagacaccaagggtgtcaaaagaaagaccctttttagggaaaacggatcaaagccacgtgcaatcgtggtggacccggtccatggttttatgtactggaccgactggggaactcctgcaaagattaagaaggggggcctgaacggtgtcgacatttactcgctggtgaccgaaaacatacagtggcctaatggaattacccttgatttgctgtccggtcgcctgtactgggtggatagcaagctccattcgatatcatccatcgacgttaacggtggaaaccgcaagactattctggaggatgaaaaacggcttgctcatccttttagcctggccgtgtttgaagataaagtcttttggactgatatcatcaacgaagcaatcttttcggccaatagacttacggggtcggacgtcaatcttcttgcagaaaacctgctgagcccggaggatatggtgctgtttcataatctcactcaacctagaggggtcaactggtgcgaacgcaccactcttagtaatggtggatgtcagtacctctgcttgccggcaccacaaatcaacccacattcacctaagttcacttgtgcatgtcctgatgggatgctgctggcacgagatatgcgttcctgtctcactgaggcagaggcagctgtggcaacccaggaaacctcgactgtgagacttaaggtttcatccacggcggttcggacccaacataccactactcggccagtgcccgacacttcgcgcctccccggggcaacccctgggctgaccactgtcgaaattgtgactatgtcccatcaggcacttggtgacgtggccggcaggggaaatgaaaagaaaccttcgagcgtgcgtgccctgtccatcgtgctcccaatagtgcttctcgtgtttctttgtctgggagtctttcttctctggaaaaactggagactcaaaaacatcaattcaattaactttgacaaccctgtgtaccaaaagacgactgaagatgaagtgcacatttgtcataaccaagacggatacagctacccatcacgccagatggtcagccttgaagatgatgtggca

SEQ ID NO: 119 - DNA, 2580 bp, Artificial Sequence
  Description of Artificial Sequence: Synthetic Transcript Sequence
atgggaccctgggggtggaagctgcgctggacggtcgcacttctgcttgccgcagcaggcaccgcagtcggcgaccggtgtgaacgtaacgaattccaatgtcaagacgggaagtgcatctcatacaagtgggtgtgtgacggctcggcagagtgccaggacggatcagacgagtcccaggagacttgtctgagcgtgacctgcaaatccggagatttttcatgtggagggcgtgtcaaccgttgtattcctcaattttggagatgcgatggacaagtggattgtgacaatggctcagatgagcaggggtgcccacctaagacgtgcagccaggacgaattcagatgccatgacggaaagtgtatctcgaggcaattcgtctgcgactcggacagagattgtttggatggatcggatgaggccagctgccctgtcttgacttgtggtcccgctagcttccaatgtaactcgtcgacttgcatcccgcagctctgggcgtgtgataacgatcccgattgtgaagatgggagcgacgaatggccacaacgctgtcgtggcctgtacgtctttcagggagacagctcgccatgttccgcctttgaattccattgtctttcgggtgagtgtattcatagctcctggcgatgcgacggagggcctgattgcaaagataaaagcgacgaagagaactgcgccgtggcgacctgtcggccagatgagtttcagtgttcggatggtaattgcatccatggatcacgtcaatgtgaccgggaatacgattgcaaggatatgtccgatgaagtgggatgcgtgaatgtgactctgtgtgaaggccctaacaaattcaaatgtcattcaggagagtgtatcaccttggacaaggtgtgtaatatggctagagattgtcgagattggagcgatgagcccatcaaggaatgtgggactaatgagtgcctcgataacaacggcggctgttcccacgtgtgtaacgatctgaagattggatatgaatgtctttgtcctgacggatttcaactggtggcccaaagacgctgtgaagatattgatgaatgccaagatcccgacacttgttcgcagctgtgtgtgaacctcgaaggtggatacaaatgtcagtgtgaggagggattccaactcgaccctcatactaaggcttgtaaggcagtgggttcaatagcgtatctgtttttcaccaaccggcacgaagtgcggaaaatgactttggatcggagcgaatacactagcctcatcccaaacttgaggaacgtcgtggcattggatacggaggtcgcatccaacagaatttactggagcgatctgtcccagcggatgatctgttcgacccaactggatcgggcacatggagtgtcgtcctacgataccgtgattagcagagatatacaggcaccagacggtctggcagtcgactggattcattccaacatttactggaccgattcggttctgggtactgtgtcggtggcggataccaagggggttaaacgcaagaccctttttagagaaaacggtagcaaacctcgcgcaattgtcgtggaccctgtgcatgggttcatgtattggactgattggggcactccggctaagatcaaaaagggcggtcttaatggagtggacatctactccttggtgactgagaatatacagtggcctaacggtataaccctggatcttctctccggtagactgtactgggtcgactccaagctgcactctatctccagcattgatgttaatggtgggaacaggaaaaccattcttgaagatgaaaagagacttgcccatccattttcactcgcagtatttgaagataaagtcttttggaccgacatcattaacgaagctatcttctccgcaaacaggctgaccgggtccgatgtcaaccttcttgcggaaaacctgctgtccccagaagatatggtgcttttccataaccttacgcaaccaagaggcgtgaactggtgcgaacgaaccaccttgtcaaacggtgggtgccaatacctgtgcctgcctgcgccccaaatcaatccccattcgcctaaattcacttgtgcctgtccagatggaatgcttctggcccgcgatatgagatcatgtctcacggaagctgaagcagctgtcgcaactcaagaaacgtcgactgtgaggctgaaggtcagctcgaccgctgtgaggacgcaacataccaccacccgtccagtgccagatacctcccgactgccaggagcaacgccaggcctcactaccgtcgagattgtgaccatgtctcatcaggcattgggcgacgtggccgggcggggaaatgagaaaaagccctcgtcagtgcgcgctctgtccatcgtgctgcccatagtgcttctggtgtttctttgcctgggagtctttctgctgtggaagaactggagacttaagaacattaactctatcaattttgataaccccgtttatcaaaagacgactgaggacgaagtccacatctgtcataaccaagatggttactcctatccatcacggcaaatggtgtccctggaagatgacgtggca

SEQ ID NO: 120 - DNA, 2580 bp, Artificial Sequence
  Description of Artificial Sequence: Synthetic Transcript Sequence
atgggtccttggggctggaagctgaggtggaccgtggcgctgcttcttgccgctgcaggcaccgcagtgggtgataggtgtgagcggaacgagtttcagtgtcaggatggtaaatgcatttcatacaagtgggtgtgtgacggctcggcagagtgtcaagatggttctgatgaatcgcaggaaacctgtctgtcagtcacctgtaaaagcggagatttttcctgcggaggcagagtcaacagatgtattccgcagttttggcggtgtgacggtcaggtcgattgcgataacggatcggatgagcaaggatgcccacccaaaacgtgtagtcaagatgagttccgttgtcatgatggaaaatgtattagccggcaatttgtctgcgacagtgaccgggattgtctcgatggatccgatgaggcctcgtgccctgtccttacctgcgggccagccagcttccaatgtaactcctcaacttgcattccacaactctgggcttgtgataatgatcccgattgtgaggatggaagtgacgaatggccccaacgctgtagagggctctacgtgttccaaggggatagctccccttgctcggcgtttgaatttcattgtcttagcggagaatgtattcattcgtcctggcgatgtgatgggggtcccgactgtaaggacaaatcggacgaagaaaattgtgcggtggcgacttgtcgcccagatgaattccagtgttcggacggcaactgtatccacggaagccggcagtgtgacagagagtacgactgtaaagatatgtcggacgaagtgggatgcgtcaatgtgaccctttgcgaagggccaaacaaattcaagtgtcattcgggtgaatgtatcactcttgacaaggtgtgtaatatggctcgtgactgcagagactggtccgatgaacctattaaggagtgtggtacgaacgagtgcctcgacaacaatggtggatgctcgcatgtctgtaacgatctcaagataggttacgaatgtctctgtccggacggctttcagttggtcgcacaacgcaggtgtgaggacatcgatgaatgccaagacccagatacctgtagtcagctttgcgtgaatctggaaggtggttacaaatgccagtgcgaggagggatttcaactggacccgcataccaaggcttgtaaggcagtgggatcgattgcatacctgtttttcaccaatcgccatgaagtcaggaaaatgaccctggatcgcagtgaatacacctcccttatccctaacctgcgcaacgtggtggcattggataccgaagtggcaagcaaccgaatctattggtccgacctttcgcaaagaatgatttgctctacccagcttgaccgggcacacggggtgtcaagctacgataccgtgatctcccgtgacatccaggcaccagatggcttggcagtcgactggatacacagcaatatctattggacggattccgtgctcggtaccgtgtcggtggctgatactaagggcgtaaagcgcaagaccctgtttagagaaaacggctccaagcctagagccattgtggtggatcctgtgcacggatttatgtactggaccgattggggtactccggcaaagattaagaaggggggcctgaacggagtggacatttactcccttgtaactgagaacattcagtggcccaatgggataaccctggatctgctgagcggaaggctgtactgggtcgattcgaagctccactcaatttcgagcattgatgtgaacggaggtaataggaaaactatattggaagatgagaagagattggcccatccattttccctggcagtctttgaagataaggttttctggacggacattatcaacgaagcaatcttctcagccaaccggttgactggaagcgatgttaatcttctcgccgaaaaccttttgtcacctgaagatatggtgctgttccataatcttactcaaccaagaggagttaactggtgtgaacgtaccacgttgtccaacggtggctgccaatacctctgccttcctgcgccccagatcaacccacactctccaaagtttacttgcgcttgtcctgatggcatgctgctggccagagatatgcggtcctgtctcactgaagcagaagccgcagtggcaacccaggaaacttctactgttagattgaaggtgtcatcaactgcagtgaggacccagcatactaccacccgccccgtgcctgacacttcacgactgcccggggcgactccaggactgacgaccgtggagatagttaccatgagccaccaagcccttggtgatgtggcaggtagaggaaacgagaagaaaccttcgtcagtacgagcacttagcattgtcctgccaatcgtgcttctcgtgttcctttgcctgggcgtctttctgctctggaagaattggcgtctcaagaacatcaattccattaactttgacaaccctgtctaccaaaaaactactgaggatgaagtgcatatttgccataatcaagatggctactcgtacccttcacgacaaatggttagtcttgaagatgacgtcgca

SEQ ID NO: 121 - DNA, 2580 bp, Artificial Sequence
  Description of Artificial Sequence: Synthetic Transcript Sequence
atgggaccttggggctggaaacttcggtggactgttgccctgctgctggcagccgccggaactgcggtgggggatcgttgtgaacgaaatgagtttcagtgccaggatggcaaatgtatctcatacaagtgggtctgcgacggaagcgcagaatgccaagacggatcagatgaatcccaggaaacgtgcctgtccgtaacctgcaagagcggggacttctcgtgcggaggacgggtaaatcggtgtatcccgcaattctggcgttgtgatggacaggtcgactgcgataacggctccgacgagcagggatgtccgccaaagacttgctcccaggatgagttcagatgccatgacggaaaatgcatctcacgacaatttgtgtgtgactcagacagagattgcctcgacggttccgatgaagcgagctgcccagtcctcacctgtggaccagcatcttttcaatgcaactcgtccacctgcattccacagctttgggcatgcgataatgacccggattgtgaggacggatcggacgaatggccccaacggtgccggggtctgtacgtctttcagggcgattcatcgccctgctccgcgttcgagttccactgcctgtcgggtgagtgcatccactcatcgtggcgctgcgacggaggtccagattgcaaagataagagcgatgaggaaaattgcgcggtcgctacgtgccgccctgacgaattccaatgttccgatggaaactgcattcacggctcccgccagtgcgacagagagtacgattgcaaggatatgtccgatgaggtgggttgcgtgaacgtgactctgtgtgaaggacccaacaaattcaaatgccattccggggaatgcatcaccctggacaaagtttgcaacatggcacgcgattgtagagactggagtgacgaacccattaaagagtgcggtaccaatgaatgcttggataacaacggaggctgctcgcacgtgtgtaatgacctgaaaataggttacgaatgcttgtgccccgacggcttccaactcgtggcccagagacgctgcgaagatatcgacgagtgccaggatccagacacctgttcccagctctgcgtgaacctggaaggaggatacaagtgtcagtgtgaggagggattccagctggatccacacactaaggcgtgcaaggccgtcgggtccatcgcttacctgttcttcaccaacaggcacgaagtgcggaagatgactctcgaccggtccgagtatacgtcgctgatccccaacttgcggaacgtggtggcattggataccgaagtggcaagcaatcggatctactggtcagacctttcccaacgcatgatctgcagcacccagcttgatagggctcacggagtctcatcatacgatactgtgatctccagagacattcaagcaccggacgggctggccgtggactggattcactctaacatctactggactgatagcgtgctggggacggtgtcagtcgcagacaccaaaggggtgaagagaaaaaccctgttccgcgagaatggaagcaagccgcgggcgatcgtggtcgacccggtgcatggcttcatgtactggaccgactggggaactcccgcgaagatcaagaagggaggactgaatggagtcgacatttactcactcgtgaccgagaatattcagtggccaaacggcattaccctggacctgctgtctggccggctttattgggtggatagtaaacttcatagcatcagctccatcgacgtgaatggaggaaataggaaaaccatccttgaggacgagaaacgcctcgcgcatcccttcagccttgcagtgttcgaggataaggtgttttggactgatatcatcaacgaagcgatcttctcggcaaatagattgaccggttccgatgtcaacttgcttgccgagaacctgctgtccccggaagatatggtgctgttccataacctgacccaaccgcggggagtgaattggtgcgagagaaccactctctcgaatgggggctgccagtacttgtgcctcccggccccgcagatcaacccgcactctccaaagttcacttgcgcatgcccagatgggatgctgctcgccagagacatgaggtcgtgccttactgaagccgaagctgcggtggccacccaggaaaccagcactgtgagactcaaggtgtcctcaactgcagtgcgcacccagcatacgaccactcgcccagtcccggacacttcgcggctcccaggcgctaccccgggccttactaccgtggaaatcgtcaccatgtcgcatcaggcgttgggggacgtggcggggcgggggaacgaaaagaagccgtcatcggtgcgcgccctgtccatcgttctgccaatcgtgctgctcgtgtttctgtgtctgggagtgttcctgctctggaagaattggcggctgaagaacatcaattccatcaatttcgataaccccgtgtaccaaaagaccactgaggatgaggtgcacatttgtcacaaccaggacggctactcgtacccttccagacagatggtgtcgctggaggatgacgtggcc

SEQ ID NO: 122 - DNA, 2580 bp, Artificial Sequence
  Description of Artificial Sequence: Synthetic Transcript Sequence
atgggaccttggggatggaagctcaggtggactgtggccctgcttctggcagctgcgggtactgccgtgggcgaccggtgtgaacgcaacgagtttcaatgtcaggatggaaagtgcatctcgtacaagtgggtgtgcgatggatccgcggagtgccaggacgggtcggatgaatcgcaagaaacttgcttgtccgtcacttgtaagtcgggagacttctcctgcggagggagggtcaataggtgcatcccacagttctggcggtgtgacggacaggtggactgcgacaacggatcggatgagcagggctgtcctccaaaaacgtgcagccaagatgagttcagatgtcacgatggaaaatgtatctcccgccagttcgtctgcgactccgaccgggactgtctggatggatctgatgaggcatcttgcccagtgctgacttgcggacctgcctcgtttcagtgcaactcctcgacttgcatcccgcaattgtgggcctgcgataatgatccagactgcgaagatgggagcgacgagtggccgcaaagatgccgggggctctatgttttccaaggagactcatccccgtgcagcgccttcgagttccactgcctgtctggcgaatgcatccattcctcctggcggtgcgatggaggcccggactgcaaagataaatcagacgaagaaaactgcgccgtggccacctgcagaccggacgagttccagtgctcggacggcaactgcatccacggctcgcgccagtgtgaccgtgaatacgactgcaaggacatgagcgacgaggtcggatgcgtgaacgtgactctgtgcgaaggtcccaacaagttcaaatgccattcgggtgagtgtattactctggacaaagtgtgcaatatggcacgcgactgccgagactggagcgacgagccgatcaaggaatgcggcactaacgagtgtctggacaacaacggaggctgctcgcatgtgtgtaacgacttgaaaattggctacgaatgcctgtgtccggatggcttccagctggtggcccaaaggcggtgcgaagatatcgatgaatgtcaggatccggacacgtgtagccagctgtgcgtgaatctggaaggcggatacaaatgccagtgcgaagagggattccaactcgacccacataccaaggcatgcaaagcagtcggatcgatcgcttacctcttcttcactaatcgccatgaggttcggaagatgactctggaccgctcggaatacacttccctgatcccgaacctcaggaacgttgtcgcactggacaccgaagtcgcgtccaaccggatttactggtcagatctgtcacaacggatgatctgcagcactcaactggatagagcacacggagtctcctcgtatgataccgttatcagccgagacatccaagcccctgacggactggccgtggactggatccacagcaacatatactggaccgactcggtgctgggaactgtctcagtcgccgacactaagggagtgaaacgcaagaccttgtttcgcgaaaacggaagcaagccacgcgccatcgtggtggaccctgtccatggtttcatgtactggactgattgggggactccggctaaaatcaaaaaggggggactgaacggagttgatatctattccctcgtgactgaaaacatccagtggccaaacggcattaccctcgatttgctcagcggaaggctgtactgggtcgactcgaaacttcactctatttcctccatcgatgtgaacggaggcaatcgaaagacgatcctggaggacgaaaaacgcctggcccacccattttcacttgctgttttcgaagataaggtgttttggaccgatatcattaacgaggcaatcttttccgctaacagactgactgggtccgatgtgaatctgctcgcggagaacctgctgtcgcctgaggacatggtgctgttccacaacctgacccaacctcgcggcgtgaactggtgcgagagaactactctgtccaacgggggttgtcaatacctgtgtttgccagctcctcagatcaacccacactcacctaagttcacttgtgcatgcccggacgggatgctgctcgcgcgcgatatgagaagctgcctcaccgaggccgaggccgcagtggccactcaggagacttcaaccgtccggctgaaggtgtcaagcactgccgtcaggactcagcacactactacgaggcctgtccctgacacttcccgccttccaggtgctactccgggactcaccaccgtggaaatcgtgacgatgtcgcaccaggctctcggagatgtggctggacgcgggaacgagaagaagccctcgtcagtgcgcgccctgagcatcgtcctgccaatcgtgctgctggtgttcctctgcctgggagtctttctgctctggaagaactggcggctcaaaaacatcaatagcatcaatttcgataatccagtgtaccaaaagaccaccgaggatgaggtgcacatttgccacaaccaggatggatactcctacccgtcccggcagatggtatctctcgaggatgatgtggcc

SEQ ID NO: 123 - DNA, 2580 bp, Artificial Sequence
  Description of Artificial Sequence: Synthetic Transcript Sequence
atggggccgtggggctggaagctgagatggacagttgcccttctgctggccgcagccgggacagcagtcggtgatcgatgtgaacgaaacgagttccagtgtcaagatggtaaatgcatttcctataagtgggtatgcgatggaagtgcggaatgtcaggatgggtctgacgagtcacaggagacctgcctgtcagtaacctgcaagtcaggggactttagttgtggaggaagagtgaaccggtgcatccctcagttttggcgttgtgatggccaggtggattgcgacaacgggtcagacgaacaggggtgcccaccaaagacatgttctcaggatgaattccgttgccacgacggaaaatgtatttcgagacagttcgtttgtgattctgatcgcgattgtttagacggcagtgatgaagcctcatgcccggttcttacttgcgggcctgctagcttccagtgcaacagctcgacatgcatcccccagctctgggcctgtgataatgacccggactgcgaggatggatccgacgaatggccacaaagatgccgtgggctctatgtctttcagggtgattccagcccttgcagtgccttcgagtttcattgtttgtcgggcgagtgcattcacagctcatggcggtgtgacggaggcccagattgtaaggacaaatccgatgaggaaaactgcgctgtcgctacctgcaggcccgacgagtttcaatgctccgatggcaattgcattcatggttcaagacagtgcgacagggaatacgattgtaaggacatgagcgatgaagtgggatgtgttaacgtgaccctgtgtgagggaccaaacaagttcaaatgccattctggagagtgtattacactggataaggtctgtaatatggctagagactgtcgcgactggtctgatgagccaatcaaagagtgtggtacaaatgaatgcctggacaataatggcgggtgcagtcacgtctgcaatgatctcaagattggctatgaatgcctttgtcccgacggatttcaactggtagcacagcgtcggtgtgaagacatcgatgaatgccaggatcctgatacttgtagccagctttgcgtcaaccttgagggaggctataagtgccagtgtgaagaagggttccagttggatccacacaccaaggcatgcaaggcagtggggtcaattgcttacctgttctttactaacaggcatgaagtgcgtaagatgaccctcgatagatctgagtatactagtcttatccctaatttgagaaatgtcgtagccttggacactgaggtcgcgagcaatagaatctattggtccgacttatctcagcggatgatctgctccacacagctggatcgagcccacggcgtgagcagctacgacacagttatcagtcgggacatccaggcccccgatggtttggctgtggactggatccactctaatatctattggacagactccgtactcgggactgtgagtgtggccgacacaaagggagtgaagaggaagaccctgttcagggagaatggctcaaagccaagagccattgtggtggatccagtgcacgggttcatgtactggacagactggggtacgcctgcaaagatcaaaaagggtgggttaaatggggtggatatctactccttagtgacagagaacattcaatggccgaacggcatcactcttgatctcctgagcggccggctctattgggttgattctaagttgcatagtatcagctcgattgatgttaacggtggaaaccggaaaaccatcctggaggacgagaagagactggcgcatccattctccctagcagtattcgaggataaggtgttttggaccgacattataaatgaagctatcttcagtgccaacagactcaccggcagcgatgtgaacctactggcagagaatctcctctctcctgaggacatggtcttatttcataatctcactcagccgagaggcgtgaactggtgcgagaggacaactcttagcaatggcggctgccagtatctatgtttgccagcacctcagattaaccctcattctcctaaattcacgtgcgcttgcccagacggaatgcttctggcccgggatatgcgctcttgtctcacggaggccgaggccgccgtggctacccaggagacgagcactgtaaggctgaaagtgagtagcacggccgttcgaacccagcacacaaccacaagacctgtgcccgataccagccgtttgccgggagcaacacccggactgactaccgtggagatcgtgaccatgagtcaccaggctctgggcgacgtggcaggaaggggaaatgagaagaagccatcttctgtgagagccctctccatagttttacccatcgttctgctggtgtttctgtgtctgggagtgttcttactgtggaagaattggcgacttaaaaatatcaatagcatcaactttgataaccctgtctatcaaaagacgaccgaggacgaggtgcacatctgtcacaatcaggatggatatagctaccctagtagacagatggtgtcactggaggacgacgtcgca

SEQ ID NO: 124 - DNA, 2580 bp, Artificial Sequence
  Description of Artificial Sequence: Synthetic Transcript Sequence
atgggaccatggggatggaaactgcgatggaccgtggcactcctgctggctgcagctggcaccgctgtaggagatcggtgcgaacgcaacgagttccagtgccaggacggaaaatgcatctcgtacaagtgggtgtgcgatggatcagccgaatgtcaagatggttccgatgaatcccaggaaacctgcctgtccgtcacttgcaagtcgggagacttctcctgcggaggcagagtcaaccgctgcatcccgcagttctggaggtgcgacggacaggtcgattgcgacaacgggtccgacgaacagggctgcccacctaagacgtgcagccaagatgagttcagatgccatgatgggaagtgcatctcgcgccagttcgtgtgcgactcggaccgggactgcctggatggctcagatgaggcctcgtgcccagtcctcacctgtggcccagccagctttcagtgcaactcatcgacttgcatcccgcaactgtgggcctgcgataacgacccagactgcgaagatgggtcggacgaatggccccaacgttgcaggggactttacgttttccagggagactcaagcccatgcagcgcgtttgaattccactgtcttagcggtgaatgcatccactcatcgtggagatgcgacggaggtcctgactgcaaagacaagtccgatgaggaaaactgcgccgtggccacgtgtcgcccggacgaattccagtgctcggacggtaattgcattcacggaagccggcaatgcgatcgcgagtacgactgtaaggacatgtcggacgaagttggatgcgtgaacgtcactctgtgtgagggaccaaacaagtttaagtgtcattccggggaatgcatcactctggataaggtgtgcaacatggcacgcgactgcagggactggtccgacgagccgatcaaggaatgcggtactaatgaatgtctcgataacaatggaggttgcagccatgtgtgtaacgacctgaaaatcgggtatgagtgtctgtgccccgacggcttccaactggtggcacagaggcgctgcgaggacatcgatgaatgccaagacccggacacttgctcccaactgtgtgtcaaccttgaaggagggtacaagtgtcagtgcgaagagggatttcagcttgatccgcacactaaggcctgtaaagctgtgggatcaattgcctacctgttctttaccaaccggcacgaggtccgcaaaatgaccttggatcgctcggaatacacctcactgatccctaatctccggaacgtggtcgccctggacactgaggtggcgtcaaaccgcatctactggtctgatttgtcacagaggatgatttgttccacccaactcgatagagcccacggagtctcctcgtacgataccgtgatcagcagagatattcaggccccagatggattggccgtcgactggattcattcgaatatctactggacggactcggtgctgggcactgtgtcagtggcggacaccaagggggtgaagcgcaaaactctcttccgcgagaatggcagcaagccccgggcaattgtcgtggacccggtgcacggcttcatgtactggaccgactggggaactccggcgaaaatcaaaaaggggggcctcaacggagtggacatctactcacttgtgaccgagaacatccaatggcctaatggaattaccctggatctgctttcggggcgcctttactgggtggattcaaagctgcactccatcagctccatcgatgtgaacggcggaaacagaaagaccatcctggaagatgaaaagcggctggcccacccattttcactggctgtctttgaagataaagttttctggaccgacatcatcaacgaggcgatcttctcggcgaacagactgactgggtccgatgtcaatctccttgcagaaaatctgctgtcaccggaggacatggtgctgttccacaatctcacccagccaaggggggtcaattggtgcgagagaactaccctctcaaacggaggatgccagtatttgtgcctgccagccccacagatcaatcctcactcgcccaagttcacctgcgcctgtccagacggcatgctgctcgcccgcgatatgcgcagctgcctcactgaggctgaagccgcggtggcgacgcaagaaacctcgaccgtccggcttaaggtgagctcgaccgccgtgagaactcagcacaccactacccgcccagtgccggacaccagccgcctgccaggcgcgactccgggattgactaccgtggagatcgtgacgatgagccaccaggccctgggagacgtggctgggcgcggaaacgagaagaagccatcgagcgtcagggcgctgtcgatcgtcctgccgatagttctgctggtgttcctttgccttggagtgttcctgctgtggaagaattggagattgaagaatatcaactcaatcaacttcgataacccggtgtatcagaaaactaccgaggacgaagtgcacatttgccacaatcaagacggatactcatacccgtccagacagatggtgtccttggaagatgacgttgcc

SEQ ID NO: 125 - DNA, 2580 bp, Artificial Sequence
  Description of Artificial Sequence: Synthetic Transcript Sequence
atgggcccctggggatggaagttacgatggacggtcgctttacttttggcggctgcaggcacagcagttggcgatcgctgtgaacgtaacgagtttcagtgtcaggatggaaagtgtataagttataaatgggtctgcgatggatccgcggagtgccaggatggatcagacgaatcgcaagagacctgcctgtccgtaacatgtaagagcggcgacttcagttgtgggggacgcgtgaatagatgcatccctcaattctggcggtgtgacggccaggtcgattgcgataatggatccgatgaacaaggatgcccacctaagacatgctcgcaggatgagttccggtgccacgacggcaagtgcataagtcggcagtttgtgtgtgatagtgatagagactgtctggacggcagtgacgaggcatcttgtcctgtacttacttgtgggcccgcgagtttccagtgcaatagcagcacttgcataccccagctctgggcttgcgacaacgatcccgactgcgaggacggcagtgatgagtggccgcagcgatgtcgaggtctttacgtgtttcaaggcgatagtagcccctgttctgcattcgaatttcactgtctgtctggggaatgtatccacagttcctggcggtgcgatggaggacctgactgcaaagacaagtctgacgaggagaactgtgcagtggcgacctgtaggcccgatgagtttcagtgtagcgatggcaactgtattcatggtagcaggcaatgcgatcgggagtacgattgtaaggatatgtctgacgaagtaggctgcgtcaatgtcacgctctgcgagggcccgaataagtttaaatgtcactcaggagaatgcatcactctagacaaagtgtgcaatatggccagggattgccgtgactggtccgatgagcccattaaggagtgcggaacgaatgagtgcctcgacaacaatggcggctgttcacacgtctgcaatgatcttaaaatcggttatgaatgtctctgtccagacggctttcagctagtggcccaaaggcgatgcgaggacatcgatgaatgtcaggatccagatacatgctcccagttatgcgtgaatcttgagggcggctacaaatgtcagtgcgaggaaggcttccagttggatccgcacacaaaggcgtgtaaggccgtgggcagtatcgcttatctctttttcacaaacagacacgaggtgagaaaaatgactctcgatcggagcgaatacactagcctgatcccaaacttgcggaatgtggtggccctggacactgaagtcgcttccaacaggatatactggagcgatctttcacagagaatgatctgttcgacacaactggaccgggctcatggcgtgtcatcatacgacaccgtaatttcccgtgacatccaggccccagacggcttggctgtggactggatccattccaatatttactggacagattctgttctgggcaccgtatcagttgccgacaccaagggcgtgaagcgtaagactctctttcgcgagaacggttctaagccgagggcgatagtagtggacccagtacatggatttatgtactggaccgattggggtactcctgcgaagatcaagaagggcgggctcaacggtgtggacatctactcgctagtgaccgagaacatacagtggcctaatggaatcactctggatttacttagcgggagactctactgggtggactccaagctgcactcaatctcgtctatcgacgtcaatggcgggaatcgcaaaactatcctggaagacgagaaaagactcgcacacccctttagtctggcggtattcgaggacaaggtgttctggaccgacatcatcaacgaggctatcttctcagccaatagactgactggttcagatgttaatctgttggccgagaacctgctgagtcccgaagatatggtgctgttccataatcttactcagcccaggggggtgaactggtgcgaacgcacaaccctttcaaacggcggctgccagtatctgtgcctccctgcacctcagatcaatccccactcccccaaatttacctgcgcctgccctgatgggatgctcctggcacgcgacatgcggtcttgcttgacagaggcagaagctgctgtggccacccaagaaaccagtaccgtacggctcaaggtgagctctacagccgtccgaacccagcacacaactacccgacctgtgccagacacgtccagattgcctggggctaccccaggcttaacaacagtggagattgtgacaatgagccatcaagcactgggcgacgtcgcaggacgtggcaacgaaaagaagcctagtagcgtccgcgctctgtctatagtcttgcctattgtgcttttggtgttcctttgtcttggagtgttcttattgtggaagaactggaggctgaagaatataaattctattaacttcgataacccagtctaccagaagactacagaggatgaggtgcacatctgccataaccaagacgggtacagttatcccagccgtcagatggtgtccctagaggacgacgttgct

SEQ ID NO: 126 - DNA, 2580 bp, Artificial Sequence
  Description of Artificial Sequence: Synthetic Transcript Sequence
atgggaccttggggttggaaactgaggtggactgtggcactgctgctggcagcggctggaacggccgtgggggaccgatgtgagaggaacgaatttcaatgtcaggacggcaaatgcatttcgtacaaatgggtctgtgatggctctgccgagtgtcaagatgggtcagatgagtcgcaggaaacttgtctttcggtcacttgcaagagcggggatttctcatgtggagggcgcgtgaacaggtgtataccacagttctggcgctgtgatggtcaagtggattgtgacaatggttccgatgaacaaggatgccctcctaagacttgcagccaggacgaattccgctgtcatgacggtaagtgtatttcccgacaattcgtgtgcgattccgatcgagactgccttgatggctcagatgaggcctcgtgtcccgtgcttacttgcggacctgcatcatttcagtgcaattcctcaacttgtattccccaactttgggcatgtgataatgaccccgattgtgaggatggatcggacgaatggcctcaacgttgtagaggtttgtacgtgtttcagggagattcatcgccatgctcggcctttgaattccattgtctcagcggagaatgtattcattcttcatggcgatgcgatggggggcctgattgcaaagataagagcgatgaagagaactgtgcagtcgcgacctgtagaccagatgagtttcagtgttccgatggaaattgtatccatgggtcgaggcaatgtgacagagaatacgactgtaaggacatgagcgatgaagtgggttgcgtgaatgtcactctgtgcgaaggtcctaacaagttcaagtgtcattcgggagagtgtattacccttgataaggtctgtaacatggcaagagactgccgagactggtccgatgagcctattaaggaatgcggcacgaatgagtgtcttgataacaatggtggctgttctcacgtctgtaatgacctcaagatcggatacgaatgtctgtgcccagacggatttcagctggtggcacaacgacgctgcgaagatatagatgaatgtcaggatccagatacctgttcgcaactttgcgtgaatcttgaaggaggctacaaatgtcaatgtgaggaaggcttccagctggacccacacactaaggcatgtaaagcagtgggttcaatcgcctacctgttctttaccaaccggcatgaagtgaggaaaatgactcttgacagatctgagtacactagcctgattcctaatctgcgaaacgtggtggcattggataccgaagtggcatcgaatcggatctattggtcggatctcagccaaagaatgatctgtagcacccagcttgacagagcgcatggggtttcgtcgtacgacaccgtcattagccgggacattcaggcacctgatgggctcgcagtggattggatccactccaacatttactggaccgacagcgtcctgggaaccgtctcggtcgccgatactaaaggggtgaagcgtaagactctgtttcgcgagaacggcagcaagccacgcgcaatcgtggtcgacccagtgcatggatttatgtactggactgactggggaacgcctgcaaagattaagaagggcggactcaacggcgtggatatctactccctggtcaccgaaaacatccaatggcctaacggtataactctggaccttctctcaggacggctttactgggtggactccaaactgcattccataagctcaattgatgttaatgggggaaataggaaaaccattctggaggatgaaaaaaggctggcccacccattcagtctcgcagttttcgaagataaggtgttttggactgacataatcaatgaggctatcttttcagctaacaggctgaccgggtctgatgtgaacctgctggcagaaaaccttctgtcaccagaggatatggttctttttcacaacctgactcaaccccgtggcgtcaactggtgtgaaaggactaccctctcaaatggaggttgtcagtacctctgtttgcctgcacctcagattaaccctcatagccctaaattcacctgcgcatgtccagatggaatgctgctcgcgagagatatgagatcatgtctgacggaggccgaggcagccgtcgccacccaggaaacctcaaccgtgcgactgaaagtgtccagcacggccgtgagaacgcagcacactaccactcggcccgtgccagatacctcgagacttcccggcgcaaccccgggtctgaccaccgtggaaatagtcactatgtcgcatcaggctctcggtgacgtcgcgggaagagggaacgaaaagaagccaagctccgtgagagctctttccatcgtgcttcctattgttcttcttgtgtttctgtgtcttggagtgtttttgctttggaagaattggcgcctgaagaacataaacagcattaactttgataatcccgtctaccaaaagaccactgaggacgaggtccacatctgtcacaaccaggatggatacagctatccttcgaggcaaatggtgtcgctggaggacgatgtggca

SEQ ID NO: 127 - DNA, 2580 bp, Artificial Sequence
  Description of Artificial Sequence: Synthetic Transcript Sequence
atgggaccatgggggtggaagcttcgctggaccgtagctctgctcttggccgccgccggcactgctgtgggggatcggtgtgagcgcaacgaattccagtgccaggatgggaaatgtattagctacaaatgggtatgcgatggttcagctgagtgccaagatggctcagacgagtctcaagaaacatgtctgagcgtgacttgtaagtctggtgattttagttgcggggggcgggtaaacagatgtataccacagttctggcggtgtgatggacaggtggactgcgacaacgggagtgacgagcagggctgtcccccgaaaacatgcagtcaggacgagtttcgctgtcacgacgggaagtgtatctcaagacagttcgtatgtgattctgatcgcgattgccttgatggaagtgatgaggcaagctgtcctgtcctgacgtgcgggcctgcaagtttccagtgcaacagttccacatgtattcctcagctctgggcttgtgacaatgaccctgactgtgaagatgggtcagacgagtggcctcagcggtgtcgcggcctgtatgttttccagggcgattcttcaccatgctcagccttcgaattccactgtctgagtggggaatgcatccatagctcttggcggtgtgacggcggcccagactgcaaggataagagcgatgaggagaattgtgcagtcgccacctgcaggcctgacgaatttcagtgtagtgatgggaattgcatccatgggagccgccaatgtgaccgcgaatatgactgcaaagacatgagtgatgaagtaggttgtgtgaatgtgaccctttgtgaggggccgaacaagttcaagtgccattccggggaatgtattacactcgacaaggtctgtaacatggcccgggattgtagagattggtctgatgaaccaatcaaagagtgcggaaccaacgagtgtctggataataacggagggtgtagtcatgtctgcaacgatcttaaaatcgggtacgagtgcctgtgccctgacggcttccagctcgtcgctcagcggcgctgcgaagacatcgatgagtgccaggatcccgacacatgtagccaactctgcgtcaacctggaaggaggatataagtgccagtgtgaggagggcttccagctcgacccccacactaaggcgtgcaaggcagtgggctctatagcatacctgttcttcaccaaccgccatgaggtgcgcaagatgactctggacaggtctgaatatacatctttgattcctaatttgcgaaatgttgtggcccttgacactgaagttgcttccaatcgaatctattggtccgacctgtctcagcggatgatctgctcaactcagcttgacagagctcatggcgtgagcagctacgacactgtgataagtagggatatccaggctccagatggactggccgttgattggatccactcaaatatttactggaccgatagtgtccttgggaccgtcagtgtcgccgataccaaaggcgtgaaaagaaagacactgtttagggagaacgggagtaagccaagggcgatcgttgtggaccccgtgcacgggttcatgtactggacagattggggcactccagctaagatcaaaaagggagggctgaacggagtggacatctacagtctggtgaccgagaatattcagtggcctaatggcattacactggatttgttgtctggacgcttgtattgggtggattcaaaactgcattccatctctagcattgacgtcaacggtgggaataggaagacgattctggaggatgagaaacggctcgcccatcctttctcattggcagtatttgaggataaagtcttctggacagatatcataaatgaggcaatattctccgctaaccgactgactggctctgatgtgaatttgctggccgaaaatttgctgtcaccggaagacatggtcctgttccacaacttgactcaacctcgcggagtgaactggtgtgaacgcactacactcagtaatggcggttgccagtatctttgtctgcccgctccccaaataaatccacatagcccgaagttcacctgcgcatgcccagatgggatgctgctggcacgcgacatgaggtcctgccttacggaggctgaggcagctgtggcaactcaggaaacttctaccgtccgcctgaaggtgtcctccactgctgtacgcacccaacacacaacaacacgcccggtgccggatactagccgcctgccaggcgccactcctggtctcactaccgtcgaaatcgtgactatgtctcaccaggctcttggggacgtggccgggagaggcaacgaaaaaaagccttcaagcgttcgggccttgtccatagtcttgcctatcgtgctcttggtcttcctttgcctgggggtgttcctgctttggaaaaattggcgcctgaagaacattaacagcatcaattttgacaaccccgtataccagaaaaccaccgaagatgaggtgcacatctgccacaatcaggacggctattcatatccgtcccgacagatggtgagtctcgaggatgatgtggcc

SEQ ID NO: 128 - DNA, 2580 bp, Artificial Sequence
  Description of Artificial Sequence: Synthetic Transcript Sequence
atgggaccttggggatggaagctgagatggactgtggcgttgctgctggctgcggcgggcaccgccgtcggggaccgctgcgaacggaacgaattccaatgccaggatgggaagtgcatctcatacaagtgggtctgcgacggctcggcggagtgccaggatggttcggatgaaagccaagagacttgcctctcggtcacttgcaaatccggcgatttctcctgtggcggtcgagtgaaccggtgcatcccccagttctggaggtgtgatggccaagtggattgcgataatgggtcagacgaacaagggtgcccaccgaaaacctgttcgcaggacgaattccggtgccatgacggaaagtgcatctcccggcagttcgtgtgcgatagtgaccgcgattgtctcgacggcagcgatgaagcatcgtgccccgtgctcacttgcgggccagccagcttccagtgcaactcctccacctgcataccgcaactctgggcttgtgacaacgacccggactgcgaagatggatccgacgagtggccgcaaagatgtagaggcctgtacgtgttccaaggagattcatccccgtgctcggcattcgagttccactgtctgtccggagagtgcatccacagcagctggcgctgtgatggaggccctgattgtaaggacaagtctgatgaggagaactgtgcggtcgcgacctgtcgcccggatgaatttcagtgctctgacggcaactgcatccatggatcgcgccaatgcgaccgcgagtacgattgcaaagacatgagcgacgaagtcggatgcgtgaacgtcaccctctgcgaaggtcctaacaaattcaagtgccactcgggagagtgcattactcttgacaaagtctgcaacatggcacgcgactgccgcgactggtccgacgaacccatcaaggagtgcggcacgaatgaatgccttgacaacaacggaggctgttcacatgtgtgcaatgatctcaaaatcgggtatgagtgcttgtgcccggatggattccaactcgtggcccaaaggcggtgtgaggacatcgacgaatgccaggatcccgacacctgtagccagctgtgcgtgaatctcgaaggaggctacaaatgccagtgcgaagagggcttccaacttgatccgcatactaaggcctgcaaagccgtgggctcgatagcctacctgttctttaccaatcggcacgaagtgagaaagatgaccctggacagatccgaatacacttcgctgatcccgaacttgagaaatgtggtggccctggataccgaggtggcctcgaacagaatctactggtcggacctctcccagcggatgatctgctccactcaactggatcgcgcccacggagtcagctcctacgacactgtcatctcccgcgacatccaggcgccagacggactcgccgtcgactggatccattcgaacatctactggaccgattcggtgctgggcactgtgtcggtggcagacaccaagggagtgaaaaggaaaacgctgttcagagaaaatggctcgaagcctcgggccatcgtggtggatccggtgcacggcttcatgtactggactgattggggcactccggcaaaaatcaagaagggcggcctgaacggggtcgatatctacagcctcgtgactgaaaacattcagtggccgaatggaattactctcgatctcctgtcggggcgcctttactgggtggactctaaactgcatagcatctcttctatcgacgtgaacggaggaaatcgcaagactatcctggaagatgagaagaggctcgcccacccgtttagcctcgccgtgtttgaggacaaagtcttttggactgacattatcaacgaggctatcttctcggcaaacaggctgactggtagcgacgtgaatttgctggcagagaatttgctctcgccagaagatatggtgctgttccacaatctcacccagcccagaggagtaaactggtgtgagcggactactctgagcaatggtggatgccaatacctctgcctgccggctcctcagattaatccgcacagcccgaagtttacgtgtgcttgcccagatggaatgctcctggctagagacatgcgctcctgcctcacggaggcagaggccgccgtggcgacccaggaaacctccaccgtgcggctgaaagtgtcctcgaccgcggtgcgcacccagcacactactactcgcccagtgccggatacctcccggctccccggagcgacgccgggcttgaccaccgtcgagattgtgaccatgtcgcaccaagccctcggcgacgtcgcgggtcgcggaaatgaaaagaagccttcatcggtccgggccttgtcaatcgtcctgcctatcgtgcttctcgtgttcttgtgccttggcgtgttcctgctgtggaagaattggcgcctcaaaaacatcaactccatcaacttcgacaacccggtgtaccaaaaaaccactgaggacgaagtccacatctgccataaccaggatggatactcataccccagccgtcaaatggtgtccctggaggacgacgtggca

SEQ ID NO: 129 - DNA, 2580 bp, Artificial Sequence
  Description of Artificial Sequence: Synthetic Transcript Sequence
atgggtccatgggggtggaagctcaggtggacggttgcacttcttctcgcggccgcaggtaccgccgtgggggatagatgtgagcgcaacgaattccagtgccaagacggtaagtgtatctcatacaaatgggtgtgcgacgggagcgcagaatgccaggatggttccgatgaatcccaagaaacttgcctttcggtgacctgcaagagcggagatttttcatgcggaggcagggtgaaccgatgtatcccacaattctggagatgcgatggacaggtggattgtgataacggaagcgacgagcagggttgcccgcccaagacctgctctcaggacgagtttagatgtcatgacggaaagtgcatctcccgacaatttgtgtgcgattcggatagagactgcttggacggctcggatgaagcgtcatgcccagtgctcacctgtggccctgcatccttccagtgtaatagctccacctgcatccctcagctttgggcatgtgacaatgaccccgactgtgaagatggatcggacgaatggccacagagatgtaggggtctttacgtgtttcagggcgatagctccccgtgcagcgccttcgaattccattgcctgtcaggggaatgcatccactcctcctggaggtgtgatggggggcctgattgcaaagacaagtcagatgaggagaactgtgcagtggcaacttgtcggcctgatgagttccagtgcagcgatggcaactgtatccatggctcgagacagtgtgatcgcgaatacgactgcaaagacatgtccgatgaagtgggatgcgtgaatgtgaccctgtgtgaaggaccaaacaagttcaaatgccacagcggtgagtgcataactctggacaaggtctgtaacatggcacgagattgtcgcgattggtcggacgagcccattaaagaatgtggcactaacgagtgtctcgataacaatggaggatgctctcacgtctgtaacgatctgaaaattgggtacgaatgcctctgccccgatggctttcaacttgtggcacagcgccgctgtgaagatatcgatgaatgtcaagatcctgatacctgctcgcaactgtgtgtgaatcttgaagggggttacaagtgtcagtgtgaagagggtttccaacttgatccccatactaaggcctgcaaagcagtgggttccattgcgtatctctttttcactaatcgacatgaagtgcgaaagatgaccttggacagatcagaatacacttccctcatccctaatctgcgtaatgtggtggcactcgatactgaagttgcttcgaacaggatatactggtcggatcttagccaacgaatgatctgctccacccagctcgatcgtgcacacggagtgtcatcctacgacactgtcatttcgagagacattcaggctcccgatggtttggcagtagattggatccatagcaacatttactggactgacagcgtccttggtactgtgtctgttgcagataccaagggagtgaagcggaaaactctgtttagagaaaacggatcaaaacctcgagcaattgtggtggacccagtgcacgggtttatgtactggaccgactggggaactccggccaagattaagaaaggaggcctgaacggcgtcgacatttactcgctcgttacggagaacatccaatggcctaatggaattaccctggatttgttgtcgggacggctgtactgggtggatagtaagctgcactcgatttcgtcaattgatgttaatggcggcaatcgcaagaccattctggaagatgagaagagactggcccatcctttttcactggcagtttttgaggacaaggtcttttggactgatatcataaatgaggcaattttcagcgcaaatcgccttaccggctccgatgttaaccttcttgcagaaaaccttctgtcccctgaggatatggtgctttttcataacttgacccaacctcgcggcgtgaactggtgtgagcgcaccactctgtccaatggcggctgccaatacctttgtctgcccgcgccccagattaaccctcactctcctaagtttacttgcgcatgcccagatgggatgctgcttgcacgcgatatgcgtagctgtcttacggaagctgaggcagctgtggctacgcaagaaacgagcactgtgaggctcaaggtgtcgtcgacggcggtccgcactcagcatactacgacgcgacctgtgcccgacaccagccggcttccgggggcaactccagggctcaccactgtggaaatagtgactatgtcccaccaagccctgggggatgtggcagggcgcggaaacgagaagaagccttcgtcagtgagggcgcttagcatagtgctccccatagtcctgctggtctttctttgtctcggagtctttctcctgtggaaaaactggaggcttaagaatatcaactccataaactttgataatccagtctatcaaaagactaccgaagatgaggtgcatatatgtcataaccaggatggctactcttacccatcccgtcagatggtgtcgctggaggacgacgtggcc

SEQ ID NO: 130 - DNA, 2580 bp, Artificial Sequence
  Description of Artificial Sequence: Synthetic Transcript Sequence
atgggtccgtgggggtggaagctcaggtggaccgttgcattgctgctcgctgcagcagggactgcagtgggagatcgatgtgagcggaacgaattccagtgtcaagatgggaagtgcatatcctacaagtgggtctgcgatggttccgcagaatgtcaagatggttctgacgaaagccaggagacttgtctttctgtgacgtgtaaatctggtgatttctcttgcggtggtagggtcaataggtgtatcccccaattttggaggtgtgacggtcaggttgattgcgataacggcagtgatgagcaaggctgccctcctaaaacatgctcacaagatgaattcaggtgtcacgatggtaaatgtatttctagacagtttgtatgcgattcagaccgtgattgcttggatggcagtgatgaggcgtcatgcccagtgctcacatgtggtcctgcctcttttcagtgtaattcatcaacttgcatccctcaactctgggcatgtgataacgatccagattgcgaagatgggtctgatgagtggcctcagagatgtcgcggcctctacgtgttccagggtgattcctccccctgttccgcttttgaattccattgcctgtctggcgaatgtatccacagcagttggcggtgcgatgggggacccgattgtaaggataagtccgacgaggaaaactgcgcagtggctacctgtagacctgatgagttccaatgctcagatggtaactgtattcacggatcacgccagtgcgatcgagagtacgattgcaaggacatgtccgatgaagtcggttgtgtgaatgtcacactatgtgaaggtcccaacaaatttaagtgtcactcaggtgaatgtatcacattggataaggtctgtaatatggcacgggattgccgtgattggagcgacgagcccatcaaggaatgcggaacgaatgaatgcctcgataataatggtggatgttctcacgtttgtaacgacttgaagatagggtacgaatgtttatgtcccgatggtttccagctggttgctcaaagacgatgtgaagatattgatgagtgtcaagatccagacacttgttctcaattatgtgtcaacctcgagggagggtataaatgtcaatgtgaagagggctttcagctcgatccgcatactaaggcttgtaaggccgtggggagcattgcttatcttttctttaccaaccgtcacgaggttaggaagatgactcttgataggtctgagtatacatcgttaattcctaatcttcgtaatgtcgtggctttggataccgaggtggctagcaatagaatctattggtcagatctctctcagagaatgatttgttccacccaattggatagagcccatggcgtatctagctacgacacagtcatttcaagagatattcaagctccagatggcttagccgtagattggatacattcgaatatttattggactgattcagtactggggactgttagtgtggctgacacaaagggggtaaagcgtaagacattgttccgagagaatggttcaaagccacgcgccatagttgttgaccccgtgcacggttttatgtattggactgactggggtacccctgctaagataaaaaaaggtggtctgaacggagtagatatatactccttggtgactgaaaacatacagtggcctaatggaattactcttgatcttctaagtgggcgtctttattgggtggattcaaagctgcactcgatttcatctatcgatgtgaacggaggaaacaggaagaccattctggaagatgaaaaacggctggcacatcctttttctctggccgtctttgaggataaggtcttttggaccgatataatcaacgaagctatcttttcggcaaatcgacttacaggttcagacgtcaatcttctagctgaaaacctcttgagcccagaggatatggttttgtttcataacctaactcaacctcgcggagtcaattggtgtgagagaacaactctcagcaacgggggttgccaatatctttgtctgccagcacctcaaattaatccacattcaccaaagtttacctgtgcgtgcccggatgggatgcttctggcccgcgatatgaggtcttgtctgaccgaggctgaagcagctgttgctacgcaggagacatcaactgtgcgtctcaaagtgagttcaacagcggttaggactcagcatactacaaccagacccgttcctgatacaagccgactgcctggtgccactccgggactcacaacagtcgaaatagttaccatgagccatcaggccttgggtgatgttgctggtcgtggaaatgaaaaaaagccatcatccgttagagctctgtctatagttttgccgatagtgctccttgtttttttatgtcttggggtgttcctgctgtggaagaactggcgattgaagaacatcaactctataaactttgataaccctgtttatcaaaaaactactgaggatgaggtacatatttgccacaatcaggacggttactcgtatccgtcaaggcaaatggtgagcttggaagacgatgtggcc

SEQ ID NO: 131 - DNA, 2580 bp, Artificial Sequence
  Description of Artificial Sequence: Synthetic Transcript Sequence
atgggtccgtgggggtggaaattgcgttggaccgtcgcgttgctgctggcagcggccggaacggccgtgggagatcgctgcgaacggaacgaattccagtgtcaagacggaaagtgcatcagctacaaatgggtctgcgacgggtcagcagagtgccaggacggaagcgatgagtcccaggaaacctgcctgtcagtgacttgtaagtccggcgatttctcctgcggaggacgcgtgaatagatgcatccctcagttctggagatgcgacggtcaggttgactgcgataacggatccgacgagcagggatgcccccctaagacttgctcacaagatgagttcagatgtcatgatgggaagtgtatctcgcgccaattcgtgtgcgactccgaccgagattgtctggatggatcggacgaggccagctgccccgtgctcacttgtggcccggccagcttccagtgtaattcgagtacctgtatcccgcagctgtgggcatgtgataacgacccggattgtgaagatggaagcgacgaatggcctcaaagatgcagaggactgtacgtgttccagggcgattcctccccttgttcggctttcgagttccactgcctttcgggcgaatgtatccactcctcctggcgctgtgatggggggccggattgcaaagataagtcagacgaggagaactgtgctgtggctacttgccggccagatgaatttcagtgcagcgacggcaattgcatccacggaagccgccaatgcgatagagaatacgactgtaaggacatgagcgacgaggtcggttgcgtgaatgtgactctttgcgaaggaccgaataagtttaagtgtcattcgggtgaatgcattaccctggacaaagtgtgcaatatggctagggattgccgcgactggtccgatgagccgattaaggaatgcggaactaacgaatgcctggataacaacggaggatgctcgcacgtgtgcaacgacctgaagatcggatacgaatgtctgtgcccggatggattccagctcgtggcccagcgccgctgcgaggacatcgacgaatgccaagaccccgatacgtgttcacaactctgcgttaatctggaaggtggatacaagtgccagtgcgaagaaggtttccaactggatcctcacaccaaggcctgtaaagcagtgggatccatcgcctacttgttcttcacgaatcggcacgaagtcaggaagatgaccctggatcgcagcgagtacacttcgctgatccctaacctgcgtaacgtggtggccctcgacactgaggtggcatcgaaccgcatctactggtccgatctgtcacagcggatgatctgtagcactcagctcgaccgcgctcacggggtgtcgagctatgacactgtgatctcgcgcgacatccaggctcctgacggtctggctgtggattggatccattccaacatctactggacggattccgtgctgggcaccgtctccgtcgcagacaccaagggtgtgaaacggaaaaccttgttcagggagaatggatcaaagccgcgcgcgatcgtggttgacccagtgcatgggtttatgtactggactgattggggaactccagccaagatcaagaagggagggctgaacggagtggacatctactcgctggtgacggaaaacatccagtggccgaatgggatcactctcgacctgctgtctggccgattgtactgggtcgactccaagctgcattcgatcagcagcattgatgtaaacggcggaaatcgcaagaccatcctcgaggacgaaaagcgcctggcccatccattctctctcgcagtctttgaagataaagtattctggactgatatcattaacgaggcgatcttttcagctaaccgcctgaccggaagcgatgttaatctgctggcggaaaacctgctgtcgccggaggacatggtgctctttcataacctgactcagccacggggcgtgaattggtgcgaaagaactacgctgagcaacggagggtgccagtacctgtgcttgcccgctccccaaatcaacccacactcaccaaagttcacttgcgcctgcccggacggaatgttgctggcgcgcgatatgaggtcgtgcctgaccgaagcggaggcagccgtggcgacgcaggaaacctccactgtcagactcaaagtctcctcgactgcggtgagaactcagcacaccaccacccgcccagtgccggacacttccaggttgccgggcgccactccaggcttgaccaccgttgagatcgtgaccatgtcccatcaagccttgggagatgttgcgggcaggggaaatgaaaagaagccgtcgtcggtaagagccctctccatcgtgctgccaatcgtgctcctggtgttcctctgcctgggggtgttcctcctgtggaaaaactggcgcctgaagaacatcaacagtatcaacttcgacaacccagtctaccaaaagaccaccgaggacgaggtgcacatttgccacaaccaagacggttactcgtacccgagccggcaaatggtgtcattggaggatgatgtggcg

SEQ ID NO: 132 - DNA, 2580 bp, Artificial Sequence
  Description of Artificial Sequence: Synthetic Transcript Sequence
atgggtccgtggggctggaaattgcggtggacggtcgcattgctccttgctgccgccggaactgccgtgggagataggtgtgagcgcaacgagttccagtgccaggatggaaagtgcatctcgtacaagtgggtctgcgacggttccgcggagtgccaggacgggtcggacgagtctcaggaaacgtgcctctcagtgacgtgcaaatcgggggacttctcgtgcgggggtcgcgtgaaccggtgcatcccgcaattctggcgctgtgatggtcaggtcgactgcgacaatggttccgatgaacaaggctgcccgcctaagacctgctcgcaagatgagttccggtgtcacgatgggaagtgcatcagcagacagttcgtctgcgacagcgacagagactgcctcgacggtagcgatgaagccagctgtcctgtgctgacctgtggaccggcctccttccagtgcaactcgtccacctgtatccctcagctgtgggcgtgcgataatgaccctgattgcgaggacggctccgatgagtggccgcagcggtgccgcgggctgtacgtgttccaaggcgactcgtcgccatgttccgcctttgaattccattgcctgtctggcgaatgcattcatagcagctggcgctgcgacggcggaccggattgcaaggataaatccgacgaagaaaactgcgcggtggccacttgccggccggatgagtttcagtgttcggacggcaactgcatccacggatcgaggcagtgcgacagagaatacgactgcaaggatatgtcagacgaagtgggatgcgtgaacgtgactctctgtgaggggccgaataagtttaagtgccactcgggagaatgtatcaccctggataaagtgtgtaacatggctcgggactgcagagattggtccgacgagccgatcaaggagtgtgggaccaacgagtgcttggacaacaacggagggtgtagccacgtctgcaacgacctgaagattgggtacgagtgtctgtgtccggacggtttccagctggtggcacagcggcggtgcgaagatatagacgaatgtcaggacccggacacgtgctcccaactgtgtgtgaatctggagggaggatacaagtgtcagtgtgaggaaggattccagctggatccccataccaaggcctgtaaggcggtgggatccattgcgtacctgttcttcactaaccgtcatgaggtgcggaagatgaccctcgaccggtcggaatatacctccttgattccgaacttgcggaacgtggtcgccctggatactgaggtcgcctccaaccgcatctattggtcggatctctcacaaagaatgatctgttcgacccagctcgatagagcacacggagtatcgtcttacgacactgtgatcagccgcgacattcaggccccggatggactcgccgtggactggattcatagcaacatctactggaccgactccgtccttggaactgtgtccgtcgccgatactaaaggtgtgaaaagaaagacgttgttccgcgagaatgggagcaagccgcgggctattgtcgtggaccctgtgcacggattcatgtactggactgactggggcaccccagcgaagatcaagaagggaggactgaacggggtggacatatactctctggtgaccgaaaacatccagtggccgaatggaatcactctggacctgctttcgggccggctgtattgggtggatagcaaactgcactctatcagcagcatcgacgtgaacggcggaaacagaaaaacgatccttgaggacgaaaagcggctcgctcaccctttctcgctcgctgtgttcgaggacaaggtgttttggactgacattatcaatgaggcgatctttagcgcgaatcgcctgaccggttccgacgtgaatctgctcgctgaaaatctcctgtccccggaggacatggtgctgtttcataatctcacccaaccccggggagtgaactggtgtgaacgcacgactctctccaacggtggttgccagtacctgtgtctgcctgctcctcagatcaacccgcactcccctaaattcacttgtgcgtgcccagacggaatgctgctcgcgcgggacatgcgctcatgtctcactgaagcagaggcggcggttgcaactcaagaaacctcgactgtgagacttaaggtgtccagcactgcggtgagaacccaacatacgaccactcgaccagtgcctgatacctcccgcctgcccggcgcaaccccaggcctgacgactgtggaaatcgtgactatgtcgcaccaggcgctgggggatgtggcaggccgggggaacgagaagaaaccatcttcggtgcgcgcactgtcaatcgtcctcccaatcgtgcttctggtgttcctgtgcttgggagtgtttctgctgtggaagaattggaggctcaagaatatcaacagtattaacttcgacaacccagtctaccaaaaaaccactgaggacgaagtgcacatctgccacaaccaagacggatactcatacccatcccgccaaatggtttcccttgaagatgacgtggca

SEQ ID NO: 133 - DNA, 2580 bp, Artificial Sequence
  Description of Artificial Sequence: Synthetic Transcript Sequence
atgggaccctggggatggaagttaaggtggaccgtggctcttcttctggcagccgcaggcaccgccgtgggagatcgctgtgagcgtaacgagttccagtgtcaggacggtaaatgcatctcatacaagtgggtttgtgatgggtctgctgagtgtcaggacggatctgatgaatcccaggagacgtgtttaagcgtcacctgcaagtcaggagacttttcttgcggaggtagagtcaatcgctgcatccctcaattttggcgctgcgatggacaggtcgactgtgataacggtagcgacgagcaaggctgtcccccaaagacctgttcccaggacgaattcagatgtcatgacggtaaatgtatatcccgccagttcgtgtgcgatagcgaccgggattgcctggatggcagtgacgaggcctcttgtcctgtactgacatgcggaccagcctcctttcaatgcaactcgagcacttgtatcccacaattgtgggcttgtgacaatgatccggactgtgaagatggcagcgacgaatggccacagagatgcaggggactctacgtcttccagggtgactctagcccctgcagcgcttttgagtttcactgcttatccggcgaatgcatccactctagctggagatgcgacggcggtcccgattgcaaggacaaaagcgatgaggagaactgcgctgtcgcgacctgcaggcctgatgagtttcagtgctctgatgggaattgcattcacgggagcagacagtgcgacagagagtacgactgcaaagacatgtctgatgaagtgggatgcgtcaacgtgacattgtgtgagggaccaaataagttcaaatgccacagtggagagtgcataacacttgataaggtctgcaacatggccagagattgtagggactggtcagatgaaccaattaaagaatgcggcacaaacgagtgcttagataataacggcggatgctcccatgtgtgtaacgacctaaaaattggctacgagtgcctgtgtccggatggtttccagctggtggcgcagcgcagatgcgaagatatcgatgaatgtcaagatccagacacctgctcacagctgtgcgtgaacctggagggaggctataagtgccagtgcgaagaaggcttccaacttgatccacataccaaagcctgcaaagctgttggctcaatagcctacttattttttacaaacaggcatgaggttaggaagatgacgttagacaggagcgagtacacatctctgattccaaacctccggaacgtggtcgccttggacaccgaggtggcctcaaaccgaatctattggagcgatctctcacaacgaatgatttgtagtacccagctggatcgcgcccacggcgtgtcaagctatgatactgtgatcagtcgcgatattcaagcccctgatggtctggcggttgattggatccactctaatatatactggactgatagtgtattgggaaccgtaagcgtggcagacaccaaaggggtgaagaggaaaaccctgtttagggagaatggcagcaaaccgagggctattgtagtggatcccgtccacggcttcatgtactggacagactggggtacacctgccaagatcaaaaagggaggattgaatggggtcgatatctattccctggtcaccgagaacattcaatggcctaacggtatcacactggacctgctgtccggccgactttattgggtggactctaaacttcattccatcagttcgattgatgtgaacgggggcaacagaaaaaccattctggaagacgagaaacgactggcacaccctttttctctggccgtgtttgaagacaaagtgttctggacagatatcatcaatgaagcaattttttccgcaaacagactgacaggctccgacgtcaatctgctcgccgagaacctactcagcccagaagacatggtcctgtttcacaacctgacccagcctaggggggttaactggtgcgagcgcacgaccctctcaaacggaggctgccaatacctgtgccttcccgcaccccaaataaaccctcacagccctaaatttacctgcgcctgcccagatggcatgttgctggcgagggatatgcggtcatgcctgacagaagcagaagctgcagtggcaacacaagagacctccacggtccgcttaaaagtgagctccacggctgtccggacacagcacacaactacaaggcctgtccccgatacctcccgattgcccggagcaaccccaggactgaccacagtggaaatcgtgacaatgagtcaccaggccttgggagatgtcgcgggcagaggcaacgaaaagaaaccaagtagcgtgcgcgctctctcaattgtgctgcctatagtgctccttgtgtttctttgcctcggagtgtttctgctgtggaaaaattggaggttaaagaacattaatagtatcaattttgacaatccagtataccaaaagacgaccgaagacgaagtgcacatctgtcacaatcaagacgggtattcttacccttctaggcaaatggtcagcctggaggatgacgtggca

SEQ ID NO: 134 - DNA, 2580 bp, Artificial Sequence
  Description of Artificial Sequence: Synthetic Transcript Sequence
atgggcccttggggttggaagctccgatggactgttgccttgcttctggctgccgcgggtaccgccgtgggcgatcggtgcgaacgaaacgagttccagtgtcaggacggcaagtgtattagttataagtgggtttgcgatggctctgcagaatgtcaggatggttcggatgagtcgcaggagacttgcctgtccgttacctgcaaaagtggggacttcagttgtggcgggagggtcaatcgctgcattccccaattctggaggtgtgatggtcaggttgactgtgataacggaagcgatgagcagggatgcccaccgaagacctgttctcaagatgagtttcgttgtcacgatggaaagtgcatctcacgacagttcgtttgcgattcggatcgtgattgcttggacgggagcgatgaagcctcgtgccccgtactgacgtgcgggccagcttcttttcagtgcaactcctcaacatgtataccgcagttgtgggcctgcgacaacgatccagattgcgaagatggcagtgatgagtggccccagagatgtcgaggcctatacgttttccaaggtgactcaagtccgtgctctgctttcgagttccactgcttgtccggggagtgcattcatagctcgtggcgatgtgacggtggtccggactgtaaagacaagtccgatgaggagaattgcgctgttgccacatgtcgtcctgacgagttccaatgcagtgatgggaactgcatacatggttctcgacagtgtgatcgagaatatgattgcaaggatatgtccgacgaagttggctgtgtcaatgtcacgttgtgtgaaggtccgaacaagtttaagtgccactcgggcgagtgtataaccctggacaaagtctgcaacatggcccgtgactgtcgtgattggagtgacgagccaattaaggaatgcggaacaaatgagtgtctcgacaacaacggtggctgcagtcatgtgtgcaatgatcttaagataggatatgaatgcctatgcccagatggatttcagctggttgcgcagagaagatgtgaagacatagatgaatgccaagacccggatacgtgtagccagttgtgtgtgaaccttgaggggggctataagtgtcagtgtgaggagggattccagctcgatccccatacgaaggcctgcaaggcggttggatcgatagcctaccttttcttcaccaaccgccacgaggtgcgcaaaatgactttggataggtctgaatatactagcctcattccaaacttgcgcaacgtcgtagccctggacaccgaggtcgcctcgaatcggatctactggtctgacttgtcccagagaatgatctgcagcacgcagctagatcgggcccacggtgtctcgagttatgataccgtgatctcgcgcgacatacaggcacccgatggattggccgtcgattggatccactccaatatctactggacggattcggtgctgggtaccgtgagtgtggccgacaccaagggcgtgaagcggaagacactattccgagaaaatgggtccaagccacgcgccatcgtggttgaccctgttcacggttttatgtattggacggactggggtacgcctgccaaaattaaaaaaggagggttgaacggtgtggacatctattctctcgttacggagaatattcagtggccaaatggaataacactggacctcctgagtggtcgcctttactgggttgatagcaagctgcatagcataagcagtatcgatgtcaacggaggcaataggaaaactattctggaggatgaaaagcgcttggcgcatcctttctccctagcggtgtttgaagataaggttttttggactgacattatcaacgaagccattttttccgctaaccggctaactggctctgatgtaaacttgcttgcggagaacctcctgtcgcccgaagatatggttttgttccacaacctcacgcaacctaggggagtcaattggtgtgaacgaaccactctgtccaatgggggttgtcagtatctctgcctgccggctccgcagatcaacccacacagtcctaaatttacttgcgcctgtccagacggcatgctcctggcaagggatatgaggtcatgtctaaccgaagcggaagcggccgtcgctacccaggagacatcgacagtccggctaaaggtttctagcacagccgtgagaacccaacacactaccactcggccagtccctgacacttccaggctccccggtgctacccccggcctgaccactgttgagattgtcaccatgagccaccaagccctcggtgatgtggccggccgcggaaatgaaaagaagcctagctctgtccgcgcgcttagtatagtcttgcctattgtcttgttggtcttcctctgccttggcgtatttctgctttggaagaactggagactaaaaaacataaattcaattaactttgataatccagtctatcaaaaaacaactgaggacgaggtccatatctgtcacaatcaagacggctactcctacccttctcggcagatggtttcgttagaggatgacgtggct

SEQ ID NO: 135 - DNA, 2580 bp, Artificial Sequence
  Description of Artificial Sequence: Synthetic Transcript Sequence
atgggtccgtggggttggaaattacgatggacggtagcgctattactagcggcggcgggtacggcggtaggtgatcgatgtgaacgaaatgaatttcaatgtcaagatggtaaatgtatatcgtataaatgggtatgtgatggttcggcggaatgtcaagatggttcggatgaatcgcaagaaacgtgtttatcggtaacgtgtaaatcgggtgatttttcgtgtggtggtcgtgttaatcgttgtataccgcaattttggcgttgtgatggtcaagtagattgtgataatggttcggatgaacaaggttgtccgccgaaaacgtgttcgcaagatgaatttcgatgtcatgatggtaaatgtatatcgcgtcaatttgtatgtgattcggatcgtgattgtttagatggttcggatgaagcgtcgtgtccggtactaacgtgtggtccggcgtcgtttcaatgtaattcgtcgacgtgtataccgcaactatgggcgtgtgataatgatccggattgtgaagatggttcggatgaatggccgcaacgatgtcgtggtttatatgtttttcaaggtgattcgtcgccgtgttcggcgtttgaatttcattgtctatcgggtgaatgtatacattcgtcgtggcgatgtgatggtggtccggattgtaaagataaatcggatgaagaaaattgtgcggttgcgacgtgtcgaccggatgaatttcaatgttcggatggtaattgtatacatggttcgcgacaatgtgatcgtgaatatgattgtaaagatatgtcggatgaagttggttgtgttaatgtaacgttatgtgaaggtccgaataaatttaaatgtcattcgggtgaatgtataacgttagataaagtatgtaatatggcgcgagattgtcgtgattggtcggatgaaccgataaaagaatgtggtacgaatgaatgtctagataataatggtggttgttcgcatgtatgtaatgatctaaaaataggttatgaatgtttatgtccggatggttttcaattagttgcgcaacgtcgatgtgaagatatagatgaatgtcaagatccggatacgtgttcgcaactatgtgtaaatttagaaggtggttataaatgtcaatgtgaagaaggttttcaactagatccgcatacgaaagcgtgtaaagcggttggttcgatagcgtatttattttttacgaatcgacatgaagttcgtaaaatgacgttagatcgttcggaatatacgtcgctaataccgaatttacgaaatgttgtagcgttagatacggaagtagcgtcgaatcgtatatattggtcggatctatcgcaacgaatgatatgttcgacgcaattagatcgtgcgcatggtgtatcgtcgtatgatacggttatatcgcgtgatatacaagcgccggatggtttagcggtagattggatacattcgaatatatattggacggattcggtattaggtacggtatcggttgcggatacgaaaggtgtaaaacgtaaaacgttatttcgagaaaatggttcgaaaccgcgtgcgatagtagtagatccggttcatggttttatgtattggacggattggggtacgccggcgaaaataaaaaaaggtggtctaaatggtgttgatatatattcgttagtaacggaaaatatacaatggccgaatggtataacgttagatttactatcgggtcgtctatattgggttgattcgaaactacattcgatatcgtcgatagatgttaatggtggtaatcgtaaaacgatactagaagatgaaaaacgactagcgcatccgttttcgctagcggtatttgaagataaagtattttggacggatataataaatgaagcgatattttcggcgaatcgtttaacgggttcggatgttaatttattagcggaaaatttattatcgccggaagatatggtattatttcataatctaacgcaaccgcgaggtgtaaattggtgtgaacgtacgacgttatcgaatggtggttgtcaatatctatgtttaccggcgccgcaaataaatccgcattcgccgaaatttacgtgtgcgtgtccggatggtatgttactagcgcgtgatatgcgttcgtgtttaacggaagcggaagcggcggtagcgacgcaagaaacgtcgacggtacgtttaaaagtatcgtcgacggcggttcgtacgcaacatacgacgacgcgaccggtaccggatacgtcgcgattaccgggtgcgacgccgggtttaacgacggtagaaatagtaacgatgtcgcatcaagcgctaggtgatgtagcgggtcgtggtaatgaaaaaaaaccgtcgtcggtacgtgcgttatcgatagttttaccgatagtattattagtatttttatgtttaggtgtttttttactatggaaaaattggcgtctaaaaaatataaattcgataaattttgataatccggtatatcaaaaaacgacggaagatgaagtacatatatgtcataatcaagatggttattcgtatccgtcgcgtcaaatggtatcgttagaagatgatgttgcg

SEQ ID NO: 136 - DNA, 2580 bp, Artificial Sequence
  Description of Artificial Sequence: Synthetic Transcript Sequence
atgggcccatgggggtggaaactgagatggactgtggccctgctgctcgcagctgctgggaccgccgtgggcgacagatgcgaaaggaacgagttccagtgccaagatggaaaatgtataagctataaatgggtgtgtgatggctctgcagagtgccaggacggctctgacgagagccaggagacctgtctatctgttacctgcaaaagtggcgacttctcttgtggaggccgggtgaatcggtgtatcccacagttctggaggtgtgatggacaagttgactgtgataacggatctgatgagcaagggtgcccacctaaaacctgttctcaggacgagtttagatgccacgacgggaagtgtatatcacggcagtttgtatgcgacagcgacagagactgcctggatgggagtgatgaagccagctgccctgttctaacctgtggcccagcatctttccaatgcaattcctcaacttgcatacctcagttgtgggcttgtgacaacgacccagattgcgaagacggctccgacgaatggccacagcggtgtcgcgggctgtatgttttccagggcgacagttccccttgtagcgctttcgagttccactgtctgtccggggaatgtatccacagttcctggcgatgcgatggggggccagattgtaaggataaaagcgatgaagagaattgtgcagtcgcaacatgccgccctgacgagtttcagtgtagcgacgggaactgcattcatggatctcgacagtgcgatcgtgaatacgattgcaaggacatgagcgatgaggttggatgcgtgaacgtcactctgtgtgaaggtccaaataagttcaagtgccattctggcgaatgtatcaccctggataaggtgtgtaacatggccagagattgccgtgattggtccgacgagccgataaaggagtgtgggaccaacgaatgtttggataacaatggaggctgttctcatgtgtgcaacgatctgaagatagggtacgagtgtctgtgtccagatgggttccagttagttgcacagaggcgctgtgaagatatagatgagtgccaggaccctgacacatgttcacagctatgcgtgaatctcgaggggggatataagtgtcagtgtgaggagggcttccagctggacccacataccaaggcctgtaaagctgtgggcagcatcgcatacctattttttaccaaccggcacgaggttcgtaaaatgacactggaccgatctgagtatacttcactcattccaaatcttaggaatgtcgtggctctggacaccgaggtggcttcaaatcgcatctactggtccgacttgtcacagcgcatgatatgcagcacacagctcgacagagctcatggggtttcctcttacgataccgtgatcagccgggatatacaggccccagatgggctagctgtggattggatccattccaacatttactggaccgacagcgtgctgggcaccgtgagtgtggccgacacaaaaggcgtgaagaggaaaactctcttcagggaaaacgggtccaagcctagagcaattgtggtggatccagtccacggattcatgtattggactgattggggtactcctgctaaaattaagaagggtggactaaacggggtggacatatattccctagttacagagaacatacagtggccaaatggcataaccctggatctgcttagcgggagactgtattgggttgatagtaaactccattccatctctagtatagatgtaaacggcgggaataggaagactatcctagaggacgagaagaggctggcacatccattctcactggcagtctttgaggataaggtcttctggactgatataatcaacgaggctatctttagtgcaaacagactaaccggcagtgatgttaacctgctcgccgaaaacctgctctcccctgaagacatggtcctattccacaacttaacccagccccgcggggtgaactggtgtgaacggacaacactcagtaacgggggctgccagtatctgtgtctcccggccccacaaattaaccctcactctcctaagttcacctgcgcatgtccagatgggatgctcctggctagggatatgcgtagctgcctgacagaggccgaagctgcagtcgccacccaggaaacctccacagtgcggctcaaagtgagtagtacagccgtgagaacacaacacactaccactcggcctgtcccagacacctcccggcttcccggcgccaccccagggctgacaacagttgagatagtgacaatgagtcaccaggcccttggagacgttgccggacgaggcaacgagaagaagcctagcagtgtccgagcactcagtatagtcctgccaatcgttctgctggtgttcctatgtctaggcgtcttcctgctatggaagaattggcgcctgaaaaatattaacagcataaattttgacaaccctgtttatcagaagactacagaagatgaagttcatatctgccacaatcaggacggctatagctacccaagtagacagatggtgtcactagaggacgacgtcgcc

SEQ ID NO: 137 - DNA, 2580 bp, Artificial Sequence
  Description of Artificial Sequence: Synthetic Transcript Sequence
atgggtccgtgggggtggaagctgcgctggaccgtggccctgctgctggcggccgctggaactgctgtgggtgaccggtgcgaacgcaatgaattccaatgccaggacggaaaatgcatctcatacaagtgggtctgcgatgggtcagcggaatgccaagatggatcggacgaatcccaggagacgtgcctctctgtcacgtgcaagtcaggcgacttctcgtgtggcggacgggtcaatagatgcattccgcagttctggcgctgcgacggacaggtggattgcgacaacggttccgatgaacagggatgcccacctaagacgtgctcccaagatgaattcagatgtcacgatggaaaatgcattagccggcagttcgtgtgcgacagcgatagagattgcttggatggctccgacgaagcctcctgtcctgtgctgacctgtggccctgcctccttccagtgcaacagctctacttgcatcccacagctttgggcctgcgacaacgacccggattgcgaggacgggtcggacgagtggccgcaaaggtgccgggggctttacgtttttcaaggtgattcctcgccttgctcagcctttgagttccattgcttgtcaggagagtgcattcactcctcctggaggtgtgacggagggccggactgcaaagataagtcagacgaagaaaattgcgcagtcgcgacctgcagacctgatgaattccagtgctcagacggcaattgcatccacggatcgcggcaatgcgacagagagtacgactgcaaggacatgagcgacgaagtcggctgcgtgaacgtgaccctgtgtgaaggaccgaacaagttcaagtgccacagtggtgaatgtatcactctggacaaagtctgtaacatggcacgcgactgccgcgattggtcggatgagccaatcaaagagtgcggaaccaacgaatgcctggacaacaacggaggctgctcccacgtgtgcaacgacctgaagatcggttacgaatgcttgtgccccgatggattccaactcgtggcacagcgcagatgcgaggacatcgatgaatgccaagaccccgacacctgctcgcagctgtgcgtgaacctcgaaggggggtacaagtgccagtgtgaagaaggctttcagctggaccctcacactaaagcatgcaaagccgtgggatcaatcgcctacctcttcttcaccaatcgccatgaggtgcggaaaatgactctggaccggagcgaatacacctcactcattccgaatctcagaaatgtggtggccttggacaccgaggttgcctcaaacaggatctactggtctgacctgtctcaacggatgatctgctcgactcagttggaccgcgcgcacggtgtctcaagctacgacactgtcatcagtcgggacatccaggcgccggacggactggcggtcgactggatccattccaacatctattggactgactctgttctcggcactgtctccgtggctgacactaaaggagtgaaacggaaaaccctgttcagagagaacggctcgaagcccagagccattgtcgtggatccggtgcatggattcatgtactggaccgattggggcactcctgcgaagatcaagaagggaggactgaacggggtggatatctacagcctggtcaccgaaaacatccaatggccgaatgggattaccctggacctgctgtcagggagactgtactgggtggattcgaaacttcattccatcagctctatcgacgtgaacggcggcaaccgcaagacgatcttggaagatgaaaagcgcctggcccacccgttctccctcgccgtgttcgaggacaaggttttctggacggacatcattaatgaagcaatcttctcggctaacagactcaccgggagcgatgtgaacctcctcgcggagaacctcctgtctccggaagatatggtgctcttccacaacctgactcagccgcgcggagtgaactggtgtgagcgcactaccctttcgaacgggggctgccagtatctttgtctcccagccccccaaatcaatcctcacagcccgaagttcacttgcgcctgtcccgacggaatgctgcttgctagagatatgcgaagctgcctgactgaagcagaagccgcagtggccactcaggagactagcactgtgcgcctgaaggtgtcgtccactgccgtgcgcacccagcacacgactactcggccggtgccggatacgtcgagattgcctggcgccaccccgggtctgactactgtcgagatcgtgaccatgagccatcaggcgctgggagacgtcgctggtcgcggtaatgagaaaaagccaagctcggtgcgggctctgtcgatagttctcccaattgtgcttctggttttcctctgcctcggagtgttcttgctctggaagaactggaggctcaagaatatcaattccataaacttcgacaatcctgtttaccagaaaaccactgaagatgaggtccacatctgccataatcaggacggctattcgtacccgtcaagacaaatggtgtctctggaggatgatgtcgcc

SEQ ID NO: 138 - DNA, 2580 bp, Artificial Sequence
  Description of Artificial Sequence: Synthetic Transcript Sequence
atgggaccctggggctggaagctcagatggaccgtggccctgctcctggcagcggccgggaccgcagtgggtgatcgctgtgagagaaatgaatttcaatgccaggacggaaagtgtatctcgtacaaatgggtgtgtgacggaagcgctgagtgtcaggatggctcagacgaaagccaagaaacctgtctcagcgtcacctgtaagtcgggtgatttttcctgtggcgggcgcgtgaaccgatgcatacctcaattttggagatgtgatggacaggtggactgtgacaatggatcggatgagcaaggatgccctccaaagacttgttcccaagacgagttccgctgtcatgatggaaagtgtatttcccgacagtttgtctgcgactcagatcgggattgcctcgatggatcagacgaagcatcatgccctgtgcttacttgtggtcctgcatccttccaatgtaactcttccacgtgcattcctcagttgtgggcctgtgacaatgaccctgactgtgaggacggctcagacgagtggccacaacgctgtagagggctttacgtgtttcaaggtgactcgtccccctgctcagcctttgaatttcactgtcttagcggggaatgtatccattcatcctggcggtgcgacggaggtcctgactgtaaggataagtccgacgaggaaaactgcgcagtggccacctgcagaccggacgaatttcagtgttcagacggaaattgtattcacggttccaggcaatgtgatagggaatatgattgtaaggatatgtccgatgaagtcggctgtgtcaatgtcaccctttgtgaaggtccaaacaagttcaaatgtcattccggcgaatgtatcacccttgataaagtctgcaatatggcacgagactgtagagattggtcggacgaacccattaaagagtgtggaactaacgaatgcctcgacaataacggcggatgttcccacgtgtgcaacgacctgaagattggctatgagtgtctgtgtccggatggttttcaactcgtcgcgcagcgcagatgtgaggatatcgacgaatgtcaagatccggatacttgcagccaactgtgtgtcaacctggagggaggatacaagtgtcagtgcgaggaaggtttccaactggatccacacactaaggcttgtaaggcagtcggatcaattgcgtaccttttcttcaccaatcgccatgaagtgaggaagatgactttggaccgatcggaatacacctccctcatccctaatctgcggaatgtggtggcacttgatactgaagtggcgagtaacaggatatactggtccgacctctcgcagcggatgatatgcagcacccaactcgaccgggcacatggtgtgtcgtcgtacgatactgtgatatccagagacatccaagcgccggacggactcgccgtcgattggatccatagcaatatctactggaccgattctgtgctgggaacggtgtccgtggcagacacgaagggcgtgaagcgcaaaactcttttccgagagaatggcagcaagcctcgggcaatcgtggtcgaccctgtgcatggattcatgtactggactgactggggcactccagcaaagatcaaaaagggtggtcttaatggggtggatatctacagcctcgtgactgaaaacattcagtggcctaatggtataaccctcgacctcctttccggccgactgtactgggtcgactcgaagctgcacagcatctcctcaatcgatgtgaatggaggtaaccgtaagaccattcttgaggatgagaagcgactggcacacccttttagcctcgcagtattcgaagataaggtcttttggaccgacattatcaatgaagcaatcttttccgccaacaggctgaccggatcagacgtcaaccttcttgccgaaaacctcctgtccccagaggatatggtgctttttcataaccttactcaaccgcggggtgtgaattggtgtgagagaacgactttgtcaaacggcggttgccagtacctctgtctgccggcccctcagattaacccgcactcgccgaagtttacctgtgcatgtcctgatggcatgctcctcgcacgggatatgcgctcctgcctgaccgaagctgaagctgctgtggccacccaagagactagcactgtgaggcttaaggtttcgagcacggccgtccgcactcaacacactactactagaccggtgcctgatacgtcgcggcttccaggggcaacccccggtctgactactgtcgagattgtgactatgtcacatcaagcactgggcgatgtggcaggtcgtggcaacgaaaagaagccaagctcggtccgggcactctccatagtgctgccaattgtcctgcttgtgttcctttgccttggggtctttctgctgtggaaaaactggagattgaaaaacattaactctattaactttgataaccccgtttatcaaaagaccaccgaggatgaggtccacatttgtcacaaccaggatggttactcatacccctcacggcaaatggtgtcattggaggacgatgtggcc

SEQ ID NO: 139 - DNA, 2580 bp, Artificial Sequence
  Description of Artificial Sequence: Synthetic Transcript Sequence
atgggtccttgggggtggaagctgcgctggactgtcgccttgttgctcgccgcggcgggcactgccgtgggtgaccggtgtgagaggaacgagtttcagtgtcaagatggaaagtgcattagctacaaatgggtgtgcgatggatcagccgaatgtcaagacggatccgacgaatctcaggaaacttgtctctccgtcacgtgtaagtcgggagacttttcatgcggaggcagagtgaatcgatgtatacctcaattttggcgctgcgatggtcaggtggactgcgataatgggtccgatgaacaaggatgtccgcctaagacttgctcgcaagatgagttccggtgtcatgatggcaaatgtatttcaaggcaatttgtctgtgattcggacagggattgtctcgatgggtcggatgaagcaagctgtcccgtgttgacctgtggtcctgcatcgtttcagtgtaattcgtcaacgtgcattcctcaactgtgggcatgcgataatgatcctgactgtgaggatggatccgatgaatggccacagaggtgccgtggactgtatgtgttccaaggagattcctcaccttgctccgcattcgagtttcactgtctctcgggcgagtgtatccattcctcctggcgttgtgatggtggcccagactgcaaagataagtcagacgaagagaattgtgcagtggcaacttgtcgtcccgacgaatttcagtgtagcgacggtaactgtattcacggaagcagacagtgcgatcgcgagtacgattgcaaagacatgagcgatgaagtgggctgtgtgaacgtgactttgtgtgagggccctaacaagtttaagtgccattccggagaatgtattactcttgacaaggtctgtaatatggcgagagattgtcgcgactggtcggatgagcctattaaggaatgtggtaccaacgaatgtttggataacaacggtggttgttcgcatgtgtgcaacgacttgaaaattggatatgaatgcctttgtccggatgggtttcaactcgtggcccaaaggaggtgtgaagatattgatgagtgtcaggatcccgacacttgcagccagctttgcgtgaaccttgaaggggggtacaagtgccagtgtgaggaaggatttcaacttgacccacataccaaggcatgtaaagcagtgggttcaatagcttacttgttcttcaccaatcggcatgaagtgcggaagatgacgctggatcggtcagaatacacttcgctgattccaaatttgaggaatgtggtggcgcttgacactgaggtggcatctaatcggatctactggtccgacctgtcccagcggatgatctgctccactcagctggatagagcacatggtgtctcctcgtacgatactgttatctcacgggatattcaagcacctgatggacttgccgtggattggatacatagcaacatctattggaccgactcggtgctgggcacggtttcagtggcagacactaaaggggtgaagcggaaaactctgttccgtgaaaacggaagcaagcccagggcaatagtcgtcgatccggtgcacgggtttatgtactggaccgattgggggactccagcaaagattaagaaaggaggactcaatggcgtggacatctactccctggtgaccgaaaacatacaatggccaaacggaatcactcttgatctgcttagcggccgactgtactgggtcgattccaagctccacagcatttcttcgatcgacgtcaacggaggtaaccgcaaaaccatccttgaggacgaaaagagacttgcgcatcctttctcccttgcagtgtttgaagataaggtgttttggactgatatcattaacgaggctatcttttcagctaaccgcctgactggatcagatgtcaatctgctcgcggagaatttgctttcaccagaagatatggtcctgtttcacaaccttacccagcctagaggcgtgaactggtgcgagcgcactactctgagcaacggggggtgccaatacctgtgtttgcccgcacctcagatcaatccccacagcccgaaattcacttgcgcatgccctgatggaatgcttttggccagagatatgagaagctgtctgacggaagccgaggccgcagtcgcaactcaagaaactagcaccgttcgactgaaggtttcttccactgcagtgagaacccagcataccaccacccgaccggtgccagacacttcccgactgccgggtgccactccggggctcaccactgtggaaatcgtgaccatgtcgcaccaagcgctgggagacgtcgctggtagggggaacgaaaagaagccgtcgtcggtcagagcactgtcgattgtccttccaatagtgcttcttgtgttcctctgtctgggagtgttcttgctctggaagaactggagactgaagaacattaactcaattaactttgacaatcccgtgtaccagaaaaccaccgaagatgaagttcatatttgtcataaccaggatggatactcatacccatcccgccaaatggtgtcccttgaagatgacgtcgca

SEQ ID NO: 140 - DNA, 2580 bp, Artificial Sequence
  Description of Artificial Sequence: Synthetic Transcript Sequence
atgggaccttggggttggaaattgcgctggacagtggcgcttctgctggctgctgccggaacagcagttggagatcgatgtgaacgcaacgagtttcagtgtcaggatggcaagtgcatcagctataaatgggtgtgtgacgggtctgcagagtgtcaggacggctcagatgaatcacaggagacttgcctgtccgtgacatgtaaaagtggagacttctcatgtgggggtagagtcaatcggtgtatcccccagttttggagatgtgatgggcaggtcgattgcgataatgggtcagatgaacaaggctgcccccccaaaacctgttctcaggacgagtttcgatgtcatgacgggaaatgtatttcaagacagtttgtgtgtgactctgaccgagactgtttggacggatccgacgaggccagctgtccagtattaacctgcggccccgcttcatttcagtgcaactcaagtacgtgcatcccccaactatgggcctgtgacaatgacccagattgtgaagatggcagtgacgaatggccacagcggtgccgaggcctgtatgtcttccaaggcgatagttccccttgctcggcctttgagtttcactgtctatccggagaatgtatccactccagttggagatgtgatggaggccccgattgtaaagataagagtgacgaagagaactgtgcggtcgcaacatgccggccagacgagttccagtgctccgacgggaattgcatacacggatcacggcaatgcgacagagaatatgactgcaaggacatgagtgatgaggtaggctgcgtaaacgttaccctgtgtgaaggacccaataaattcaagtgtcatagcggggaatgcattacgctggacaaagtttgtaacatggcccgcgactgtcgtgattggtccgacgagcctataaaagaatgcggtaccaacgagtgcctcgacaataatggagggtgtagccatgtctgcaatgatctaaagattgggtacgagtgcctgtgtccagatggattccaactggtcgcccaacggaggtgcgaggatattgatgagtgtcaggacccagatacctgctcacagctctgtgttaatttggaaggtggctataaatgtcagtgcgaagaggggttccagttggatccccatacaaaggcctgcaaagcagtcggatccattgcctatctgtttttcactaatagacatgaggttcggaaaatgactctcgaccgtagcgaatacacctctctcatcccaaatctccgaaatgttgtagccctggacaccgaggtggcaagtaatcgtatctactggtccgatctgagccagcgaatgatctgcagcacccagcttgacagggcacatggcgtgtcctcatacgacactgtgattagccgagatatacaggcacctgatggtcttgcggtagactggatccattccaacatatattggacggactccgttttgggcacagtatccgtggccgatacaaagggagtaaaacgtaagacactctttcgggaaaacggatcaaaaccccgagcgatcgtggtggaccccgtgcacggatttatgtattggacggactggggcacccctgctaagattaagaagggcgggctgaatggggttgatatctattctctggtaacggagaatatccagtggccaaacggaataaccttggacttgcttagtggacgcctttactgggtggattctaaattgcactccatctcatcaatcgacgtgaatggaggcaatcggaagactattttggaggatgagaagcggctggcccatccgttttctttggctgtgttcgaggacaaggtgttttggacagacattattaacgaggccatttttagcgccaatcgcctaacgggtagtgacgtaaacctgctggcagagaatctgttatccccagaggatatggtcctgtttcataatttgacacaaccaagaggcgtgaactggtgcgaacggaccacactaagcaacggggggtgccaatacctgtgcctccctgcccctcagattaatcctcactctccaaagttcacctgtgcctgcccagacggaatgttgctggctcgagatatgaggtcttgtctaactgaggccgaagccgctgttgcgactcaggaaaccagtactgtccgcctgaaagtgagtagtactgcggtgcgtacacagcatacaacaacacgcccggttcccgatacctccagactgcccggggccacccctggcttgactactgttgaaatcgtcaccatgtcacatcaggccctcggtgacgtggctggccgcgggaatgaaaaaaagcctagttctgtgagagctttgagcattgtccttcctattgtgctgctggtttttctttgtttaggtgtgttcctgctgtggaagaattggcggcttaagaacataaatagcataaacttcgataaccccgtctaccagaagaccacagaagacgaagtacatatttgccacaaccaagacggatattcatacccttccaggcaaatggtctccctggaagacgacgtggcc

SEQ ID NO: 141 - DNA, 2580 bp, Artificial Sequence
  Description of Artificial Sequence: Synthetic Transcript Sequence
atggggccttggggatggaaacttaggtggactgtcgcgctgttgctcgctgcagctggaacagcggtgggagacagatgcgaaagaaatgaattccagtgccaggatgggaagtgcatcagttacaaatgggtgtgcgatggatcggccgagtgccaagatgggtctgatgaaagtcaggagacatgtctgtccgtgacttgtaaaagtggagattttagttgcggggggcgggtaaataggtgcatcccacagttctggaggtgtgacgggcaggtcgattgcgataatggaagtgatgagcaggggtgcccgcccaaaacttgttcccaggatgaatttcgatgtcatgatggaaaatgtatatctagacagtttgtgtgcgattccgaccgggattgcctggatggatcagacgaagcgtcctgtcccgtcttgacttgtgggcccgcgtcgtttcagtgtaactctagtacatgtatcccccagctctgggcatgtgataacgatccagactgcgaagacggatccgatgaatggccacagaggtgtaggggactctatgtgtttcagggggatagttctccttgctcagccttcgaattccattgcttatcaggagaatgtatacactcttcgtggaggtgtgacggagggccagattgtaaagataaatccgacgaagagaactgcgccgtagctacttgccgccccgatgaattccaatgctccgacgggaattgcatacacgggtctcgacagtgcgatcgggaatatgattgcaaggatatgtccgatgaggtcggatgtgtgaatgttactctgtgcgaagggcccaataaatttaaatgtcactccggggaatgtattacactcgataaggtctgcaacatggctcgcgattgtagggattggagtgatgaacccatcaaggaatgtgggactaacgaatgtctagataacaatggggggtgttcacacgtttgcaatgatcttaaaatcggatatgaatgtttatgtcccgatggattccagctcgtcgctcagcgacgctgcgaagacatagatgagtgtcaggatcctgatacttgctctcagctttgcgtaaatctcgaaggggggtataaatgtcagtgcgaagaggggttccagctggatccccatacaaaagcgtgcaaagcagtggggtcgatcgcctacctgttctttactaaccggcatgaagtcagaaagatgactctggatagatctgaatacacttctcttatccctaatctgagaaacgtcgtggctcttgatactgaagttgccagtaatcgaatctactggtccgatctttcccagaggatgatatgcagtactcagctggacagggcccatggggtatcttcttacgatacagtgattagtcgagatatccaggcacccgatgggctagcggttgattggattcactctaatatttattggactgattctgtcctgggaacagtttctgtggccgacacaaaaggggtgaaacgaaaaactctatttagggaaaatggatcgaagccacgggctatcgtggtcgaccccgtgcacgggtttatgtattggacagattggggaacacccgccaaaataaagaaaggagggctgaacggggttgatatatattccctcgtgactgaaaacatccagtggcctaacggaataactctggatctgttaagtggaagactctactgggttgactccaaactgcactccatatccagtatcgatgtcaatggagggaatagaaaaactattttagaagatgagaaaagactagcacatcccttctccctagccgtgtttgaagacaaagtcttctggactgacatcatcaacgaagctatcttttctgcaaaccgactcactgggagtgatgtaaacctcctagccgagaacttgctatccccagaagacatggttttattccataacctaactcagccaagaggggtaaattggtgcgaacgcacaactctctctaatggagggtgtcagtacctttgcttacccgctccacagatcaacccccattctcctaaattcacatgtgcctgtcctgatgggatgctgctcgcgcgcgatatgaggtcttgtcttactgaagcagaagctgcggtagctactcaggaaacatcgactgttagactcaaggtctcctccacggccgtccggacacagcacactacaacacggccagtacccgatacttccagacttcccggggccacaccagggctgactactgttgaaatagttacgatgtcccatcaggcccttggggatgtcgctggaagggggaacgaaaagaaaccctcaagtgtcagggcgctatctatcgtactacctatagtgctgttagtctttttatgtctgggggtgtttctgctgtggaaaaattggcggctaaaaaatataaattccattaattttgataaccctgtgtaccagaaaacaacagaagatgaagtccatatctgtcataatcaggatgggtattcatatccctcacgccagatggtgtctctggaggatgacgtggcc

SEQ ID NO: 142 - DNA, 2580 bp, Artificial Sequence
  Description of Artificial Sequence: Synthetic Transcript Sequence
atgggaccatggggctggaagctcagatggaccgtcgccttactgctggccgcagccggcacagcagtgggcgaccgctgcgagaggaatgaatttcagtgtcaggacggaaagtgtatctcgtacaaatgggtatgcgacgggtctgcagagtgccaggatggttcagatgagtcccaggaaacatgtttatccgtcacatgcaaatccggagacttctcatgtggcggccgtgtgaatcgctgcatacctcagttttggcgctgcgatggccaagtggactgtgacaatgggtctgatgagcaagggtgccctccgaagacgtgctctcaagatgagttcaggtgtcacgatggcaagtgcatctccaggcagttcgtgtgcgattccgaccgggattgtctggacggatccgacgaggcgtcttgcccagtgctaacctgtgggcccgcgtcattccagtgcaactcttccacctgcatccctcagctctgggcttgtgacaacgaccccgactgcgaggacgggagcgacgagtggcctcaacggtgcagaggattgtatgttttccagggggattcatccccttgctcagcttttgaattccattgcctctccggcgagtgcatccacagctcatggcgttgtgacgggggtcccgattgcaaagataaatcagacgaggagaattgtgccgtggctacctgcagacctgatgagttccagtgtagtgatggaaactgtattcacggaagcagacaatgtgatcgtgaatatgattgcaaggacatgagcgacgaggtaggatgtgtgaacgtgacgctctgcgaggggccaaataagttcaagtgccattccggagaatgtatcacactggacaaagtctgtaacatggcccgggactgtcgggactggagcgacgagcctattaaggagtgcggcaccaatgaatgtctggacaacaacggaggatgttcccacgtgtgtaatgaccttaagatcggatatgaatgcctgtgtccggacggtttccagttggtggctcagcgcaggtgtgaggacatagatgaatgtcaggatcccgatacttgcagccagttgtgtgtgaatctcgagggcgggtataaatgccaatgcgaagaagggttccagttagacccgcacacaaaagcttgtaaggccgtgggctctattgcatacctcttttttaccaacagacacgaggtaaggaagatgactctggacagaagtgaatacacctctctgatccccaacttgagaaacgtagtggccttggatacagaagttgcctcaaatcggatctactggagtgatctaagccagcggatgatctgctcgacgcagctagatagagcccatggcgtatccagctatgatactgtcatcagtcgagacatccaggccccagacgggctagccgtcgattggatccattccaatatctattggaccgatagcgtgttgggaacagttagcgttgccgacacaaaaggggtgaagaggaagaccctctttcgcgaaaatggttccaagccccgtgctatcgtcgtcgacccagtgcacggcttcatgtactggactgattgggggactccagccaagataaaaaaagggggcctgaatggagtggacatttacagcctcgttactgaaaacatccagtggccaaacgggattacactggatcttctgtcaggaaggctttattgggttgactcaaagctgcactctatcagttcaatcgatgtgaacggaggaaaccgaaagacaatcttagaagatgagaagaggctggcgcacccgttttccctggccgtgttcgaggacaaggtcttctggacagacatcatcaatgaagctattttctccgctaaccgcctgaccggatccgacgtcaatttgctggctgagaacctgttgtctccagaggacatggtactgtttcataatctaacccaacctcggggcgtcaattggtgcgaaaggactaccctaagtaacggaggctgtcagtatctgtgcctacccgctcctcagattaaccctcattctccgaaattcacctgcgcctgccctgatgggatgctgctcgcacgcgacatgcggagttgtctcacagaggccgaagccgcggtagctacccaagaaacatcaacagtgaggctgaaggtgtcttccaccgccgtgcgaacccaacatactacgactcgacccgttcccgacacatcccggctcccgggagcaaccccgggactgacaacagtggaaatcgtcactatgagtcaccaggcactgggcgacgtggctggacgcggcaatgagaagaaaccctcttccgtgagagccctgtccatagttttacctatcgtgctgttagttttcctctgccttggtgtgtttctcctgtggaagaactggcgcctaaaaaacatcaattccataaactttgataatcccgtgtaccagaaaactactgaggatgaagtgcacatctgccacaaccaggacgggtacagctacccgagccgccagatggtcagcctagaggacgacgtagca

SEQ ID NO: 143 - DNA, 2580 bp, Artificial Sequence
  Description of Artificial Sequence: Synthetic Transcript Sequence
atgggcccttgggggtggaagttgagatggacagtggcactcctcttggctgctgccggcacggccgtcggcgaccgctgtgaaaggaacgagttccaatgtcaagatgggaaatgcatctcatacaaatgggtgtgcgatggatctgcggagtgtcaagatggctccgatgagagccaggagacttgcctgagtgttacatgcaagtctggcgacttcagctgcggcggtagggtgaataggtgcatcccacaattctggaggtgtgatggccaggtcgactgcgataatggtagtgatgagcaggggtgtccacccaagacctgttcccaagacgagtttaggtgccacgacggcaaatgtatctctcgacagtttgtgtgcgactccgatcgggactgtctcgacgggtctgatgaggcctcttgccctgtgctgacctgtgggccagcttcttttcagtgtaactcgtccacctgcattccgcagctgtgggcatgcgataatgaccctgactgtgaggacggctctgatgagtggccccagcggtgtcggggactatacgtcttccagggtgattcttcaccttgtagcgccttcgagttccactgtctgtccggagaatgcattcactcctcctggaggtgtgacggaggccccgattgcaaggacaagtcagatgaggagaactgtgctgtggccacttgccgccctgatgaatttcagtgctctgatggtaattgtattcatgggtccaggcagtgcgatagggagtacgactgtaaagacatgagcgacgaagtcggctgcgtgaacgtgacactgtgcgaaggaccgaataagttcaagtgccactcaggcgagtgcattacattagataaggtttgtaatatggcccgcgattgccgcgactggtccgatgagccgatcaaagagtgcgggactaatgagtgcttggacaacaatggtggctgtagccacgtatgcaatgatcttaaaattggatatgaatgtttgtgtccagatgggttccaactggtcgcgcagaggagatgcgaggatatcgatgagtgtcaggatcccgacacctgtagtcagttatgcgttaacctggaaggtggctataagtgtcagtgtgaggagggctttcagttagatccgcacacgaaagcctgcaaagccgtcggaagcattgcctatctctttttcacaaatagacacgaagtgagaaagatgacgctagacaggtctgagtacacctcattgattcccaacctacgcaatgttgtggccctggataccgaagttgcctccaatcggatttactggagtgacttgtcacaacgaatgatatgttccacccagctcgacagagcgcacggcgtgagttcttatgacacggttatctcaagagacatccaggctcccgatgggctggctgtcgactggatccattcgaacatttactggaccgattcagtactggggactgtaagtgtggctgatacaaaaggagttaaacgcaaaaccttgtttcgggagaacggctcaaagcctcgcgctatagtggtggatcctgtgcacggattcatgtattggactgactgggggactcccgctaagattaaaaagggaggactgaatggagttgacatatatagtctggtcaccgaaaatattcaatggccaaatggaattactctggacctcctgtccggtcggttgtactgggtcgactccaagctacattccatctcatccatcgacgtgaatggaggcaatcgtaaaacaattttggaagacgagaaacggttggcacatcctttctcgctcgcggtttttgaggacaaagtgttctggacagacatcatcaacgaggcaatctttagcgccaatagacttaccggcagcgacgttaatcttttggccgagaatctactgtctccagaggatatggtgctatttcataatcttacccagccacgcggggtcaattggtgtgaaaggacaaccctgtccaatgggggatgtcagtacttgtgcctgccagcacctcaaatcaatcctcacagtcccaaattcacttgtgcttgtccagacgggatgctcctcgcaagggacatgcgcagctgcctgacagaagcagaagccgcagtcgccacccaggagacctccactgtgagacttaaagtaagtagcaccgccgtgcgcacccagcatacgaccacgcggcccgtccccgacaccagtaggctccccggcgctacgcctggactgaccaccgttgagatagtgaccatgtctcatcaggccttgggggacgttgccggaaggggtaatgagaagaagccttcatcagtccgcgccctgagcattgtgttaccaattgttctgctggtcttcttatgtctcggagtgttcctcctgtggaagaactggcggctgaaaaacataaattccattaacttcgataacccggtctaccagaagacaactgaggatgaggtgcatatctgccacaaccaagacggctacagttaccccagccgccagatggtgtctttggaagacgacgttgct

SEQ ID NO: 144 - DNA, 2580 bp, Artificial Sequence; identical to SEQ ID NO: 142
  Description of Artificial Sequence: Synthetic Transcript Sequence

SEQ ID NO: 145 - DNA, 2580 bp, Artificial Sequence
  Description of Artificial Sequence: Synthetic Transcript Sequence
atgggcccctggggatggaagctgcggtggaccgtcgcgttactgcttgctgcagccgggactgcagtgggcgaccgatgtgaaagaaatgagttccagtgtcaggatggaaaatgcatcagctataagtgggtctgtgatggatccgctgaatgccaggacgggtccgatgagtcccaagaaacttgcctctcagtcacctgcaagagtggtgacttttcatgtgggggcagggtcaacagatgtatcccacagttctggaggtgcgacggccaggtggactgcgataatggcagtgacgagcagggatgcccccccaaaacttgctctcaagacgaatttaggtgccacgacgggaaatgcataagccggcagttcgtgtgtgatagcgaccgagactgtcttgacggatccgacgaggcatcttgccccgtcttgacatgtggacccgcctctttccagtgtaactcctccacatgtataccccaactgtgggcctgtgacaatgacccagattgcgaagacggttctgatgaatggccgcagcggtgcaggggactatacgtctttcagggagacagctctccatgcagcgcttttgaattccactgccttagtggcgagtgcattcattccagttggcgatgtgatgggggccctgattgcaaagacaaatcagacgaggagaactgcgccgtagcaacatgcaggcccgatgaattccagtgctccgatgggaactgcattcatggaagccgacagtgtgatcgtgaatacgattgtaaggatatgtctgacgaggtgggttgcgtgaacgtgactctatgcgagggccctaataagtttaagtgccattccggagaatgtattactttagacaaggtttgtaatatggcgcgcgattgcagggactggtcggacgagccaatcaaagaatgtggcactaatgaatgcctcgataataatgggggatgctcccatgtgtgtaacgacctgaaaatcggatatgaatgtctgtgccccgatggattccagctggtcgcccaaaggagatgcgaggacattgacgaatgtcaagaccctgacacctgttcccagctctgtgtcaatcttgagggcggctacaagtgccagtgcgaggaaggcttccagcttgaccctcatacaaaagcatgcaaagctgttggaagtatagcatacctgttttttacaaatcgacacgaggtaaggaagatgaccctcgaccgatccgagtatacctctctgattccaaacctgaggaacgtcgtagccttggataccgaagttgcgagtaataggatctattggagcgacctctcacagaggatgatttgctcaactcagcttgacagggctcacggcgtcagcagttatgacacagtgataagcagggatatccaggcaccggacggtttggccgtggactggattcatagcaatatttattggacagactctgtgctgggaacagtttctgtggccgatacaaagggcgtgaagcgcaaaacccttttccgagagaacggctcaaagccaagagccattgtggtggaccctgttcacgggtttatgtactggacggactgggggacccccgctaagattaagaagggaggcctcaacggggtggatatctattctctggtgacagaaaacatacagtggcccaacggaatcaccctggacttgctcagtgggaggctgtattgggttgattccaaactccatagcattagttctatcgacgtcaacggagggaatcgaaaaacaatcttggaagacgaaaagagactagctcatcccttttccctggccgtcttcgaggataaggtgttctggactgacattatcaatgaggccatattttccgcgaatcgattgaccggtagtgatgtcaacctcctcgccgaaaacctcctatctccagaagacatggttctatttcataatttgacgcagccccggggggttaattggtgcgagcggactaccctgtccaacggtggatgtcagtatctgtgcttacccgctccccagatcaatccacacagcccaaagttcacctgcgcgtgtccagatggtatgctactggccagggacatgagatcttgccttactgaggccgaagctgcggtggctacgcaggaaacatccaccgtgaggctgaaggtctcgtcaacagccgtgcgaacacaacataccacgaccaggcctgtgcccgacacatcaagactgccaggtgcaacccccggactgacaaccgtggaaattgtaaccatgagtcatcaggccctcggcgacgtggccggacgaggaaacgaaaagaagccctcctctgttcgggccctttctatagtgctgcccattgtcctgctggtgtttctctgcttaggagtatttctcctctggaagaattggagacttaaaaatataaactcaatcaatttcgataaccccgtttatcagaagacgaccgaagatgaggtgcatatttgccacaatcaggacggctattcgtacccctcaaggcagatggtctccctggaggacgatgtcgcc

SEQ ID NO: 146 - DNA, 2580 bp, Artificial Sequence
  Description of Artificial Sequence: Synthetic Transcript Sequence
atggggccttggggttggaagctgcggtggacagttgcactgctgctggccgctgctggaacggctgtgggagacagatgtgagcgtaatgagttccagtgccaggatggaaagtgcatcagctacaagtgggtgtgcgacggctctgcagaatgccaagatggaagcgatgagtcacaggaaacttgcctctccgtaacatgcaagtcaggtgatttttcctgtggcggccgagtcaatcggtgtatcccccagttctggcgatgcgacggccaagtggattgtgacaatggctctgatgagcaaggctgccccccaaaaacctgcagtcaggatgagtttcgatgccatgacgggaagtgcattagtagacagttcgtgtgcgactccgatcgggattgtcttgatggcagcgatgaagcctcctgcccggtcttaacctgtggccctgcctcattccagtgtaactccagcacgtgcattccccagctgtgggcatgtgataacgacccagattgcgaagacggatctgatgagtggccccagcggtgtcgggggctctacgtgtttcaaggggattcatcaccatgcagcgccttcgagttccattgcctgagtggtgaatgtatccactcctcgtggcgctgtgatggtggtcctgattgtaaggacaagagcgatgaggaaaactgcgccgtggctacctgtaggcccgatgagttccagtgcagtgatggcaattgcatccacggcagcagacagtgcgaccgggagtatgactgcaaagatatgtctgatgaggtgggatgtgttaacgtcaccctctgcgagggtcccaacaaattcaaatgtcacagtggcgagtgcatcaccctggataaggtgtgcaacatggcccgtgactgccgcgattggagcgacgagccaattaaggaatgtggaacaaatgagtgtctggacaataacgggggatgctctcacgtgtgcaacgacttgaagattggttatgaatgtttgtgtccggatgggttccaacttgtagcccaaagaaggtgtgaagacatcgatgaatgccaagatccggatacgtgttcccagctgtgtgttaatcttgagggaggttataagtgccagtgcgaggaagggttccagctcgacccacacaccaaagcatgcaaagccgtcggcagtatcgcatacctgtttttcactaaccgccacgaggtgcggaaaatgacccttgacaggagcgagtacacctccctgattccaaacctcagaaatgtagtcgctctggacactgaggtcgcatccaatcgcatctactggtcagacctcagccagagaatgatatgtagcactcagctggaccgagcacacggagtctcctcttacgacaccgtgatcagtagagatattcaggcacctgacggtctggccgtggattggatccattcaaatatttactggaccgactccgtgctcggtacagtgtcggtcgcggacaccaagggagttaagcgtaaaacgctttttcgggagaacgggtccaaaccccgcgcaattgtcgtggacccggttcacggattcatgtattggaccgattggggcactcctgcaaaaattaaaaaagggggtctgaacggagtcgacatatattcacttgtgaccgagaacattcaatggccaaatggtattactctcgatctgcttagcggccgcctctattgggtggactcaaagctgcattctatcagtagcatcgatgttaatggcggaaatcgcaagacaatactggaggatgagaaaaggctggcacatccattttctctcgctgtttttgaggacaaagtgttctggaccgatatcatcaatgaggccatcttctccgccaaccgcttaaccgggtccgacgtaaacttgctggcggaaaatctgctgtcaccagaagacatggtacttttccacaatctgacgcagccccgcggtgttaattggtgtgagcgtaccaccctgagtaatggaggctgccagtatctatgcctcccagcgccccagattaatccacactctccaaaattcacatgtgcttgtcccgacgggatgctcctggccagagacatgcggagctgtctcaccgaggcagaagccgccgtcgctactcaggaaacgagcacagttaggcttaaggtctcctccacagccgtgaggacccagcacacgacaactcgccctgtgcccgatacatcgcgcttacctggcgcaacccccggcctcaccacggtggaaatcgtcacaatgagccaccaggcactgggtgacgtagcaggtcgaggaaacgagaagaagcctagcagcgtgagggcactgtcgattgtcctccctattgtcctgctcgtcttcttgtgtctgggagttttcctgctctggaagaactggaggctgaagaacattaatagtataaacttcgacaaccctgtttatcagaagaccacagaggatgaggtgcacatctgccacaaccaagacgggtattcttacccgtcacgccaaatggtctcactcgaagatgatgttgct

SEQ ID NO: 147 - DNA, 2580 bp, Artificial Sequence
  Description of Artificial Sequence: Synthetic Transcript Sequence
atgggtccctggggttggaagttgcggtggactgtcgcactgctcctcgccgcggcagggaccgccgtgggagatagatgtgagagaaacgaatttcagtgtcaagatgggaagtgtatctcatacaaatgggtctgcgatggatcggcagagtgccaggatggttcagatgaatcccaagaaacctgtctgagcgtcacttgtaagtcgggagacttttcgtgtgggggaagggtgaataggtgcattccccaattctggcgttgtgatgggcaggtcgactgcgacaacgggtcggatgaacaaggttgcccacctaagacgtgttcgcaagatgagttcagatgccacgacggaaaatgtattagccgtcagtttgtttgtgattcggacagagactgtctggatggatctgacgaggcctcctgtcctgtgcttacttgtggacctgctagcttccaatgtaatagcagcacttgtattccgcagctttgggcatgcgacaacgaccctgactgtgaggatggttccgacgagtggccacagcggtgtagaggactctatgtgtttcaaggcgactcgtcgccttgctcggcatttgagtttcactgtttgtccggggaatgtatccactcctcgtggagatgcgatggaggtccggattgtaaggataagagcgatgaggaaaactgtgctgtcgcaacttgtcgacctgatgagtttcaatgttccgatggaaactgtatacacggctcaagacagtgcgaccgagaatatgattgtaaggacatgtcagacgaagtcggatgcgtcaacgtgaccctttgcgaaggaccaaacaaattcaaatgccattcaggagaatgtatcaccctggacaaggtctgtaacatggcgcgggattgtagagactggtcagatgagcccattaaggagtgtggcacgaacgaatgtttggacaataatggtgggtgcagccatgtgtgtaatgatctgaaaattgggtacgaatgcctttgtccagatggattccaactggtggcgcaaagacgttgtgaagatatcgacgaatgccaagatccggacacttgttcacagctgtgtgtgaatttggaaggcggctacaagtgtcagtgcgaggagggatttcaacttgatccccatacgaaggcatgcaaggcagtgggttccatagcatacctgttctttacgaacaggcatgaagttaggaagatgaccctggacaggtcagagtacacctctctcatcccaaaccttcgaaatgtggtggcacttgacaccgaagtggcctcgaatcgaatttactggtcggacctttcgcaaagaatgatctgtagcactcagctcgatagagcacacggagtctcgtcgtacgatactgttatctcgcgtgatattcaagcaccagatggtctggcagtggactggatacatagcaacatttactggaccgattcggtgctgggaaccgtctcagtggccgatactaagggtgtcaagagaaagaccctgttccgggaaaatggttcgaaaccgcgcgcaattgtggtggatcccgtgcatggctttatgtactggactgactggggtactccagccaagatcaaaaagggtggtctgaatggcgtggacatatactccctggtgacggagaatatacaatggcctaacgggatcaccttggacttgctttcgggtcggttgtactgggtggattctaagttgcactccatttcatctatcgatgttaacggaggaaaccggaaaacgattcttgaagatgaaaagcgactcgcgcatcctttttccctcgcggtgtttgaagataaggtgttttggaccgacattatcaacgaagctatcttttcggcgaacaggcttaccggctcagacgtgaaccttctggccgagaatcttctctcccccgaggacatggtcctgtttcacaacctgacccagccgcggggagtcaattggtgtgaaaggaccaccctttccaacggtggttgccaatacctttgcctgcctgcacctcagattaacccccatagccccaagttcacgtgcgcctgccctgacggaatgctcttggcaagagacatgcggtcctgtctcactgaagcagaggctgcagttgcgactcaggaaacctcaaccgtgagactgaaagtgagctccactgccgtccggacccaacataccaccacgcgcccagtgcctgatacctctcgcctgcctggtgccactcctggccttactacggtcgaaattgttactatgtcccatcaggccctcggggatgtggcaggtcgtggcaacgaaaagaagccatcctccgtgcgagcattgtccatagtgctgcctattgtgctgcttgtttttctctgccttggagtgttcctcttgtggaaaaactggcggctgaaaaacattaactctatcaacttcgataatcccgtgtaccaaaagaccactgaagatgaagtccatatatgccataatcaagatgggtactcgtacccaagcagacaaatggtgagccttgaggatgacgtcgca

SEQ ID NO: 148 - DNA, 2580 bp, Artificial Sequence
  Description of Artificial Sequence: Synthetic Transcript Sequence
atgggcccctgggggtggaagctccgatggaccgtggccctactgctggcggccgcaggaacggcagtgggtgatcggtgtgagcggaacgaattccagtgtcaggacggcaaatgcatctcgtataaatgggtttgcgacggcagtgcagaatgccaggacggctcagacgagtctcaggagacctgtctttcagtgacttgcaaaagcggggactttagttgcggcggacgtgtcaacaggtgcattccacagttttggcgctgcgatggtcaggttgactgcgacaacgggtctgacgaacaggggtgcccccctaagacgtgttcgcaggacgagttccggtgtcacgacggaaagtgtatctcccggcagtttgtgtgtgactctgatcgggactgtctagacgggtccgacgaagcatcctgtccagtgcttacttgcggtccagcctcatttcaatgcaactcctctacctgtataccccagttatgggcttgcgacaacgatcctgactgcgaggacggctccgacgagtggccacagcgctgcagggggctttacgtattccagggagattcaagtccatgttccgcgttcgaatttcattgtcttagcggggaatgcattcactcctcatggagatgtgacggcggccccgattgcaaggataagtctgacgaagagaattgcgccgtggcaacatgcaggcctgatgaattccagtgctccgatggaaattgcatacatggcagccggcagtgtgatcgggagtatgactgcaaagacatgtctgacgaagttggatgcgtgaatgtgacgctatgtgagggcccgaacaagttcaaatgtcacagcggagagtgtataaccctcgacaaagtttgtaatatggccagggactgccgtgattggtctgatgagccaatcaaggagtgtgggacgaacgagtgcctggacaataacggtggttgttcacacgtgtgtaacgatctcaaaatcggttacgagtgtctgtgtccagacggcttccagctagtggctcagcggcgttgcgaagacatcgacgaatgtcaagatccggacacgtgttctcaactatgtgtgaatctcgagggagggtataagtgtcagtgcgaagagggttttcagcttgacccgcatacaaaggcctgcaaagctgtaggatctatagcttaccttttcttcactaatcgccatgaggtgcgcaaaatgacccttgacaggagtgagtacacatccctcattcccaacctgagaaacgttgtggcactggacacagaggtggcaagcaacagaatatactggtctgacctctctcagcgcatgatctgcagcacgcaacttgatagagctcacggagtgtcatcttatgacacagtgataagccgggacatccaggccccagacgggttagccgtggattggatccactctaatatctactggacggactctgttcttggcacagtcagcgtcgctgatactaaaggtgttaagagaaaaaccttgtttcgggaaaacgggtcgaaacctcgcgccatcgtggtcgatccagtgcacggttttatgtactggactgattggggaaccccagccaaaattaaaaaagggggcctcaatggggtcgacatctacagtttggtcaccgagaacatccagtggcctaacggtattacgcttgacctccttagcggcagattgtactgggtagattccaagttacatagcatcagcagtatcgacgtaaatggtggaaatcgtaaaacgattctggaggacgaaaaaagactggctcatcccttttctctagctgtctttgaggacaaggttttctggaccgatatcattaacgaggccatcttttcagccaacagactcacgggttccgacgtcaacttactagcagagaacctgttgagcccagaggacatggtgctgtttcacaatcttacacagcctagaggggttaattggtgcgagaggaccaccctgtccaatgggggctgtcagtatctctgcctgccagccccccagatcaacccccactcccctaagttcacatgcgcatgtcctgatggtatgctgctggcccgtgatatgcgctcgtgcctgacagaggccgaagctgccgttgccacgcaggagacatctaccgttaggctcaaggtctctagcaccgccgtgcgaacccagcatactactacacgacctgtgccagatacatcacgacttcctggggcgacccctggcctgaccacggtcgagattgtcaccatgagtcaccaagccctgggagatgtagctgggcgcggtaacgaaaagaagccttccagtgttcgcgccttgtcaatcgtgttgcctatagtcctcctcgttttcctgtgcttgggcgttttcctgctgtggaaaaattggcgactcaaaaatattaactctatcaatttcgacaaccctgtgtaccagaaaacaactgaagatgaagtgcacatctgccacaatcaggacgggtacagctaccctagccgacaaatggtaagcttggaggacgacgtggct

SEQ ID NO: 149 - DNA, 2580 bp, Artificial Sequence
  Description of Artificial Sequence: Synthetic Transcript Sequence
atgggaccgtggggatggaagctcagatggaccgtcgcgctgctccttgccgcagcgggaaccgccgtgggcgaccggtgcgagcgtaatgagttccagtgtcaagacggtaagtgtatcagttacaaatgggtgtgcgacgggtcggctgagtgccaggatgggtcagacgagtcccaggagacgtgcctgtccgtgacctgcaaaagcggagatttttcgtgcggtgggagagtgaacaggtgcataccgcaattctggcggtgcgacggacaagttgattgcgacaacggctcagatgaacagggatgtccgcctaagacgtgctcacaagacgagttccggtgtcatgacggaaagtgcatctcgaggcaattcgtgtgtgactcagatagggactgcctcgacggctcggatgaagcgtcgtgcccagtgctgacttgtggcccggcctcgtttcagtgcaactcgtctacttgcataccccagctttgggcatgcgacaacgacccggattgcgaggatggatcggatgagtggcctcagagatgccggggactttacgtgttccagggcgactcatccccatgctcggccttcgagttccattgtctgtctggagaatgcatccactcttcgtggcgatgcgatgggggaccggattgtaaggacaaaagcgacgaggagaattgcgcggtcgcgacttgccggccggacgagttccaatgctcggacggaaattgcatccatggctcccgccagtgtgaccgcgagtacgattgcaaggacatgagcgatgaagtgggatgcgtgaacgtcaccctgtgcgaaggcccgaacaaattcaaatgccactccggagaatgtatcaccctggataaagtgtgcaacatggcgcgcgactgcagagattggtctgatgaaccaatcaaggaatgcggcaccaatgagtgcctggataataacggtggatgctcccatgtgtgtaatgacctgaagatcgggtatgaatgtctctgtcctgatggctttcaactggtggcccaacggaggtgtgaagatatcgacgaatgccaggacccagatacttgcagccagttgtgtgtcaatctggaaggaggatacaagtgccagtgcgaagaaggattccaactggacccacacacgaaggcatgtaaggccgtcgggtcgatcgcctacctgttttttaccaaccgacatgaagtgcggaagatgacccttgaccggagcgaatacacctcgctgatccccaatcttcggaatgtggtggccttggatacggaagttgcctcaaaccggatctactggtcagacctctcacagcggatgatctgcagcacccagctcgaccgcgcgcacggcgtctccagctacgatactgtgatctcgcgcgacatacaggctccggacggactggccgtcgattggattcattcgaatatctactggactgactcagtgctgggaacggtttccgtggccgatacgaagggtgtcaagagaaaaaccctctttcgggagaatggctcgaaaccgcgggccattgtcgtggatccggtgcatggtttcatgtactggacggactggggcacccctgcaaagatcaaaaaaggcggactcaatggagtggatatctactcgttggtgacggaaaacatccagtggccgaacggaatcaccctggacctgctttccgggaggctgtactgggtcgatagcaaactgcattcaatctcatcgattgacgtgaacggagggaaccggaagactatcctcgaagatgaaaagcgcctggcccacccgttctcgctcgccgtgtttgaggacaaagtgttctggaccgacatcattaacgaggcaatcttctcagctaatcggctgactggatcggacgtgaatctcttggcagagaacctgttgtccccagaggacatggtgctgttccacaatctcacgcaaccgcgcggcgtgaactggtgcgaacggaccactctgtcaaatggaggctgtcaatatctttgcctgcctgccccgcagattaacccacattccccgaagttcacttgcgcatgtccggacggtatgctcctggcccgggacatgaggtcctgcctgacggaggctgaggccgccgtcgcgacccaagaaacctcaaccgtgcgcctgaaggtgagcagcaccgcggtccgcactcagcacacgactaccagacccgttcctgatacttcccgcctcccaggagctactccgggcctcaccaccgtcgaaatcgtcaccatgtcccaccaggctctgggagacgtcgcaggacgaggaaatgaaaagaagccatcgtccgtgagggcacttagcatcgtcctgcccatcgtcctgctggtgtttctgtgcctcggagtgtttctgctctggaagaactggcgcctgaagaacatcaatagtataaactttgacaacccggtctaccagaagaccactgaagacgaagtgcacatctgccacaatcaggacggatacagctacccatcgcggcagatggtgtccctcgaggacgacgtggcc

SEQ ID NO: 150 - DNA, 2580 bp, Artificial Sequence
  Description of Artificial Sequence: Synthetic Transcript Sequence
atgggaccttggggatggaagctgcgctggactgtggccctcctgcttgcagcggccggcaccgccgtaggggatagatgcgagcgcaacgaattccagtgtcaggacggcaagtgtatttcgtacaagtgggtgtgcgatggaagtgccgaatgtcaggatggatccgacgaatcacaagaaacttgtctgagcgtgacttgtaagagcggcgacttctcgtgtggcggacgagtgaaccgatgcatccctcaattttggagatgtgacggccaagtggactgcgataacggaagcgacgagcaaggttgtccgcctaaaacctgtagtcaagatgagtttcgttgccatgacggcaagtgcattagcaggcaatttgtgtgtgactcggatcgagactgtctcgatggttcggatgaggctagctgcccagtgcttacctgcggaccggccagctttcagtgtaactcctccacttgtattccccaactttgggcatgtgataacgatcccgattgcgaggacgggtcggacgagtggccacagcgatgcagaggactttacgtctttcagggagactcatcgccctgtagcgcatttgaatttcattgtttgagcggtgaatgtatccactcctcctggcgctgcgacggcggtccggactgtaaagataagtcggatgaagagaactgtgccgtcgcaacttgtcgccccgacgaattccaatgctccgacggtaattgtattcatggctcgcgacaatgcgatcgggagtatgattgtaaggatatgtccgacgaagttggatgtgtgaacgtgactctgtgcgagggacctaataagtttaagtgtcactcaggagaatgtataaccttggataaggtttgtaacatggcacgtgactgcagagattggtcggacgaacccataaaggaatgtgggactaacgaatgcctggacaacaacggaggctgctcccatgtgtgtaatgacctgaagatagggtacgagtgcttgtgtccggatggttttcagcttgtggcacagcgccgttgtgaagatattgatgaatgtcaagatccagacacttgttcgcaactctgtgttaaccttgaaggtggctacaagtgccagtgcgaagaaggcttccagctggatcctcataccaaggcgtgcaaggctgtgggcagcattgcatatctgttctttactaatcggcatgaagtccgcaaaatgactctggatcgatcggaatacacctccctgatacctaacttgcgcaatgtcgtggccctggataccgaggtggcgtcgaaccgcatttactggtcggacctgtcccaacgcatgatctgctcgacccagttggaccgagcgcatggtgtctcctcatacgacacggtcatctcgcgtgacatccaagcccccgatgggctcgcagtggattggattcacagcaacatatactggaccgattcagtccttggaaccgtgtccgtggccgacactaagggggtgaagcgtaaaaccttgtttagggagaacggttcgaaacccagagcaatagtcgttgacccagtccacggttttatgtactggaccgactggggtactccagcgaagatcaaaaagggaggactgaacggagtggacatttactcacttgtgaccgaaaacatccaatggccaaacggaattaccctggacctccttagcggacgtctctactgggtggattccaagctgcatagcatttcaagcatcgatgtgaacggcggtaaccgcaagactattctggaagatgaaaagcgtttggcacacccgttttcccttgccgtgtttgaagataaagtgttttggaccgatatcattaacgaagcaatcttttccgccaaccgactgactggaagcgacgtgaacctcctggcggaaaacctcctgtctccagaagatatggtcctttttcataacttgacgcaacctagaggtgtgaactggtgtgaaaggaccaccctgtctaacggtggatgtcagtacctgtgtctccccgcaccacagattaatccacattcccctaagtttacctgcgcatgtcctgatggaatgctgcttgctcgcgatatgaggagctgtcttaccgaggctgaggcagcagtggcgactcaggaaacctcaaccgtgcgactcaaggtcagcagcactgcagtccggactcaacataccaccacgcggccagtgccagacacttcgagacttccgggagcaactccaggacttaccactgtggagatcgtgaccatgtcacaccaggcactcggtgatgtggcaggacgcggaaatgagaagaagcccagctcagttagggcactttcaatcgtgctgcctattgtgctcctcgtgttcctttgtcttggagtgttccttctctggaagaattggagactcaagaacattaactccatcaactttgataaccccgtctaccaaaagaccaccgaagatgaagtgcacatctgtcataaccaagatggctactcctaccctagcagacagatggtgagcctcgaagatgacgtggcc

SEQ ID NO: 151 - DNA, 2580 bp, Artificial Sequence
  Description of Artificial Sequence: Synthetic Transcript Sequence
atgggaccatgggggtggaagctgaggtggaccgtggctctgctgcttgccgctgccggaacagctgtgggagatagatgcgagagaaatgagtttcagtgccaggacgggaagtgtatttcgtacaaatgggtgtgcgatggcagtgccgagtgtcaggatggttccgatgagagccaggagacctgcctttcggttacctgtaaatctggtgatttcagctgcggaggcagggtaaatcgctgcatcccccagttttggcggtgcgacggtcaggttgattgcgacaacgggagtgacgagcaggggtgtccccccaaaacttgctcgcaggacgaatttagatgccacgacggaaagtgcattagtaggcagttcgtgtgtgatagcgatagagactgtctggatggaagcgacgaggcttcatgtcccgtcctgacatgcggccccgcatctttccagtgcaatagtagcacttgtatccctcagctgtgggcctgtgacaatgacccagattgcgaggacggctctgatgagtggccacaacggtgtcgaggattgtatgttttccagggcgattccagcccctgcagtgccttcgaatttcattgtctgtccggggagtgcatccattcttcatggagatgtgacgggggtcctgactgcaaggacaaatctgatgaggaaaattgcgcagttgcaacctgccgtcctgacgaattccagtgcagtgatggtaactgcatacacggctcgcgccagtgcgatagagaatacgattgcaaggacatgtctgatgaggttggatgtgtgaacgttaccctgtgtgagggccccaacaagtttaaatgccatagtggcgaatgcatcaccctggacaaggtctgtaatatggcccgtgactgccgggactggagcgacgaacctattaaagagtgtgggactaacgaatgtcttgataataacgggggatgctcacatgtgtgcaatgatctgaagattggctatgagtgtctttgtcccgatggctttcagctagtcgcacagaggcgatgtgaggacatcgatgaatgtcaggaccccgacacgtgttcacagctgtgcgtcaatctggagggcgggtataaatgccagtgtgaggaaggatttcagctggatccccacacaaaagcatgtaaagcagtgggcagcatagcctacctgttttttacaaatagacacgaggtccggaagatgactctggataggtctgaatataccagtctaattccaaatctcagaaacgtcgtcgccttggacacggaagtggcatccaacaggatatattggagcgacttatcacagagaatgatctgctctactcagctcgatcgggcccacggagtctccagttacgacacggtcatctccagagacattcaagccccagatggccttgctgtcgactggatacactcgaacatttactggaccgactctgtgttagggaccgtcagcgtcgctgacacgaagggggtaaagcgaaagactctgttccgcgagaatggaagcaagccccgggctatcgtggtggaccctgtccatgggtttatgtattggacagattggggaaccccagctaagataaaaaagggagggctgaatggcgttgatatttatagcctggtcactgagaacatccagtggcctaacggaatcacccttgacctgctgagcggaaggctgtattgggttgacagcaagcttcactctatcagcagcattgacgtgaacggcggtaatcgaaaaacaatcctggaggacgagaagcggctggcccaccccttcagtctggcagtgttcgaggataaggtgttctggacagacatcatcaacgaagcaatattcagcgctaatcggttgaccgggagcgacgtgaatctgctggccgagaatctactgagtcccgaggatatggtgctgttccataacctcacccagcctcgaggagtaaactggtgcgaaagaacgacgttgagtaatggcggatgccagtacctttgcctccccgccccacagattaatccccacagtccaaagtttacgtgtgcttgcccagacggcatgctcctcgctcgggatatgaggagctgtctcacggaggccgaagcagctgtggccacacaagagacctccacagtgcgcctgaaggtgtcctccactgcggtcaggacacagcacactactacccgcccagtgccagatacttcgcgacttcccggtgctaccccgggactgactaccgttgaaatcgttaccatgagtcaccaggcacttggagatgtagccggccgcggaaacgagaagaagcccagtagtgtccgagctttatccattgttcttccaattgtgttactcgtatttctgtgtctgggcgtattcctgctgtggaagaactggcgcctgaaaaatattaatagcatcaattttgataatcccgtgtaccagaaaactacagaggacgaggtacacatctgccacaatcaagacggatactcctatccatctaggcaaatggtgagtcttgaggatgatgtggcc

SEQ ID NO: 152 - DNA, 2580 bp, Artificial Sequence
  Description of Artificial Sequence: Synthetic Transcript Sequence
atggggccttgggggtggaagttgcgttggactgtggccctactcctggcggccgcaggcactgctgtgggggataggtgcgagcgcaacgaatttcagtgccaggatggaaaatgtatttcttacaagtgggtctgtgacgggagtgccgaatgtcaggatggctccgacgagtcccaagagacgtgtctaagcgtgacctgcaagagcggcgattttagctgtgggggaagagtaaatcgctgcataccacaattctggagatgcgatggccaggtggactgtgacaacggcagcgatgaacaagggtgcccccccaagacatgcagccaggacgagttccgatgtcacgacgggaagtgcatttcccgacaattcgtatgcgatagtgaccgggactgcctggatggaagtgacgaggcttcatgccctgtccttacctgcggacctgctagcttccagtgcaatagtagtacctgcatcccacagctgtgggcgtgcgacaacgaccctgactgtgaggacggctccgacgaatggccacagcggtgtcgaggcctgtacgtctttcagggggatagttctccctgttctgcgtttgaatttcattgcctaagcggagagtgtatacacagttcttggcgctgcgatggcggccctgactgtaaggacaaaagcgacgaggagaactgtgccgtggctacctgtcgccccgatgaatttcagtgttctgatgggaactgtatccatggcagtcgccaatgtgatcgagagtatgactgtaaggacatgagcgacgaagtcgggtgcgtgaatgtgactctctgcgagggccctaataagttcaagtgccactctggcgaatgtataacactagataaggtttgtaacatggccagagactgtagagattggtcagatgagcctatcaaagagtgcggcacaaatgagtgtctggacaataatggaggttgtagtcatgtatgtaacgacttgaagatcgggtatgaatgcctgtgccctgatggcttccagctggtcgctcaaaggcggtgtgaagacattgatgagtgtcaggacccggacacttgtagtcagctctgcgtaaaccttgagggtggctacaaatgccagtgtgaggaggggttccagttagacccacacacaaaagcttgtaaggccgttggcagcatcgcttatttgtttttcacaaatcgacacgaagtccgaaagatgactcttgaccggagtgaatatacttcacttatcccgaatctcaggaacgtagtggcactggatactgaggtggccagcaatcgtatctactggagtgatctctcccaacgtatgatttgttccactcagctagatcgcgctcatggcgtgtcttcatatgacactgtgatttcaagggacatccaggctccagatggcctggcagttgattggatccactctaatatatattggacagattcagtactgggcacagtgtcagttgccgacacaaagggggtgaagcgcaagactctgtttcgtgagaatggatctaagcctagggctattgttgttgacccagttcacggcttcatgtactggaccgactggggcacacctgccaaaattaagaagggcggtttaaatggagtggacatctatagcctggtcacggagaacattcagtggcccaacggaataaccctcgatctgctgtctggacgactttattgggtggacagcaaactgcacagcatctcatccatcgatgtgaacggaggaaacaggaaaactattcttgaggatgagaaacgtctggcacacccattctcactggctgtgtttgaggataaggtgttctggactgacataataaatgaagctatattttccgcaaatagactaaccggctctgacgtcaatctactggcggaaaatctgttgagtcccgaggatatggttctgttccacaatctgacgcagccgaggggggtaaattggtgtgaacgcacaactctctccaatggaggatgtcagtacctctgtctgcccgcccctcagatcaatccccatagccctaagtttacatgcgcatgtcccgatgggatgttgctggcccgggatatgagaagctgcctgactgaggctgaggccgccgtcgccactcaggagacctccaccgtgaggctaaaagtcagtagcacggccgtgaggacacagcacaccacaacacgccctgttcctgatacctctcgcttacctggagcgacaccaggcctgactaccgtagagattgtgacgatgtctcaccaggccctaggtgacgtggcgggcagaggtaacgaaaagaagccctcctccgtcagagccctatccattgtattgcctatcgtcctgttagtgtttctgtgcctcggagtgttcctgctgtggaaaaattggagactgaagaacatcaatagcattaatttcgataatcctgtttatcagaaaaccacggaggatgaggtgcacatttgtcacaaccaggacggttattcatatccatcccggcaaatggtcagtttggaggatgacgtcgcc

SEQ ID NO: 153 - DNA, 2580 bp, Artificial Sequence
  Description of Artificial Sequence: Synthetic Transcript Sequence
atgggtccctggggctggaagctgcgatggaccgtagcactgttgttagccgccgctggcactgctgtcggtgaccgctgtgagagaaatgagttccaatgtcaggacggcaagtgtatctcctacaaatgggtgtgcgacgggagcgcggaatgccaggacggctccgatgagtcccaggagacctgtctttcagtcacctgcaagtccggcgacttttcatgtggtggccgggtgaaccgatgtatccctcagttctggcgatgcgacggccaggtggattgcgataatggctccgatgaacagggctgtcccccaaagacgtgctcgcaggacgaatttcgatgtcatgacggcaagtgcatcagccgccagtttgtgtgcgactccgatagagattgtctcgacggatctgacgaggcatcttgccccgttctgacctgcggtcccgcctcatttcagtgtaatagctcgacttgtattccccagctttgggcctgtgataatgacccggactgtgaagatgggagcgacgaatggccgcaacggtgccgcggcttgtatgtctttcagggcgatagctccccctgcagcgctttcgagtttcattgtctgagcggagagtgcatccattctagttggaggtgtgatgggggacctgattgcaaggataagtccgacgaagagaactgtgccgtggccacatgtagaccagacgaatttcagtgttctgacggaaattgtatacacggatcccggcaatgtgatcgcgagtatgattgcaaggatatgtcagatgaagttggatgcgtgaacgttaccctttgcgaaggaccaaacaagttcaagtgtcattctggcgagtgtattacactggataaggtatgtaacatggctagagactgtcgtgactggtccgacgagccaataaaagaatgtgggacaaatgaatgtctcgataataacggcggctgctcccacgtgtgtaacgaccttaagataggctacgagtgcctgtgccctgatggcttccagctggtcgcacagagacgctgcgaggatatagacgagtgtcaggacccagacacatgttcccaactgtgtgtgaacctggaaggaggatacaagtgccagtgcgaggaaggatttcaactggatccgcacaccaaagcctgtaaggccgttggaagcatcgcatatctgttttttactaatcggcacgaggtaagaaaaatgaccctggataggtcagaatacacgtcattgatacctaatctgaggaatgtggttgcactcgataccgaagtggcttctaaccgcatctactggagcgacctctctcagcgaatgatttgttccacccagttggatagagcccacggggtgagcagttacgataccgtgatcagtcgggacatacaagcccctgatggcctagcagtcgattggatacattccaatatatattggacagatagcgtgcttggcactgtgtctgttgctgatacaaagggcgtgaagcggaagacactattcagagagaacgggtctaaaccaagagctattgtggtggaccctgttcacggattcatgtattggaccgactggggaaccccagccaagatcaaaaaaggagggcttaatggagtagacatttatagccttgtgactgaaaacattcagtggccaaatgggatcactttagacttactctccggtcgcctgtattgggtggactctaaactacatagcatcagctcaatcgatgtgaatggcggaaacagaaagaccatcctggaagacgaaaagaggctggcacatcctttcagcctggccgtttttgaggataaagttttttggaccgacattatcaacgaagcaatctttagtgccaatcggctcactggctctgacgtaaacctcttggctgagaacctcctctcgccagaagatatggtccttttccataatctgactcagccaagaggggtgaactggtgtgaacgcactactttgtcgaacgggggctgtcagtatctgtgtttgccagctccacagattaatcctcattccccgaaatttacctgcgcatgcccggacggcatgttactggcccgagatatgaggtcatgtcttaccgaggctgaggccgccgtggctacacaggaaacctcaacagttcgactgaaagtgtccagtaccgccgtaaggacacaacacactacaacgcggccggtgccggatacctcaagactgcccggcgccacccctggcctcaccacagtcgagattgtgactatgtcccaccaagccttgggcgacgtcgcaggacgcgggaacgagaaaaagcctagctcggttagggccctcagcatcgtgcttccaatagtcttgcttgtgttcttgtgtctgggtgttttcctgctgtggaaaaattggaggcttaagaatatcaactccatcaattttgataaccccgtctaccaaaagactaccgaagatgaagtgcacatctgccacaaccaagatggctactcttatccatcgcgccagatggtgtcacttgaggatgacgttgct

SEQ ID NO: 154 - DNA, 2580 bp, Artificial Sequence
  Description of Artificial Sequence: Synthetic Transcript Sequence
atgggaccatggggatggaaattaagatggacagtagcattattattagctgctgcaggaactgcagtgggagacagatgtgaacgtaatgaatttcaatgtcaagatggtaaatgtattagttataaatgggtttgtgatggaagtgcagaatgtcaagatggaagtgatgaatcccaagagacttgtttatctgttacttgcaaaagtggtgattttagttgtggaggaagagttaatagatgtattccacaattctggcgttgtgatggacaagttgactgtgataatgggagcgatgaacagggatgtccaccaaagacttgttcacaagacgaattcagatgtcatgatggaaaatgtattagtagacaatttgtttgtgattcagatagagattgtcttgatggttctgatgaagcatcttgtccagtattaacctgtggaccagcctcattccaatgtaattcaagtacttgtattccacaactttgggcatgtgataatgatccagattgtgaagatggaagtgatgaatggccacaacgttgtagaggactttatgtatttcaaggtgactcttcaccatgttctgctttcgaatttcattgtttatctggagaatgtattcattctagttggagatgtgatggtggtccagattgtaaggataaaagtgatgaagaaaattgtgctgttgctacatgtagaccagatgagtttcaatgttcagatggaaattgtattcatggatcacgacaatgcgatagagaatatgattgtaaagacatgtcagatgaagttggatgtgttaatgttacattgtgtgaagggccaaataaatttaagtgtcattctggagaatgtattactttagacaaagtatgtaatatggctagagattgtagagattggtcagatgaacctataaaagaatgtggaacaaatgaatgtttagataataacggtggttgttcacatgtttgtaatgatttaaagattggatatgaatgtctttgtccagatggttttcaacttgtagctcaaagaaggtgtgaagatattgatgaatgtcaagatccagatacatgtagtcaactttgtgttaatttagaaggaggttataaatgtcaatgtgaagaaggttttcaacttgatccacatacaaaagcatgtaaggcagtaggttccattgcatatttgttctttactaatagacatgaagttagaaaaatgaccttggatagaagtgaatatacaagtcttatcccaaatttacgaaatgtggttgcattagatacagaagtagccagtaatagaatttattggtctgatttaagtcaaagaatgatatgttctactcaacttgatagagcacatggagtttcttcatatgatactgttatttctcgtgatatacaagctccagacggacttgcagttgactggattcattcaaacatttactggacagattcagttttaggaacagtttctgttgcagacactaaaggagtgaaaagaaaaactttattcagagaaaatggttctaaaccaagggcaattgttgttgatcctgttcatggattcatgtattggactgactggggaacacctgcaaaaattaaaaagggtggacttaatggtgttgatatctattcattagttacagagaatattcaatggcctaatggaattactttagatcttctttctggaagattatattgggttgattcaaaacttcattctattagttcaattgatgttaatggtggtaatagaaagacaatattagaagatgaaaaaaggcttgcacatccattttcacttgctgtgtttgaagataaagttttttggacagatattataaatgaagcaatatttagtgctaatagattaactggaagtgatgttaatttacttgccgaaaatcttttgtcaccagaagacatggtattgtttcataatttaactcaaccaagaggagtaaattggtgtgaacgtacaactctcagtaatggaggatgtcaatatctttgtcttccagcaccacaaattaatccacattctccaaagtttacttgtgcttgtccagatggaatgcttttagccagagatatgagaagttgtttaactgaagctgaagcagcagttgctacgcaagaaactagtactgttagattgaaagtaagttcaactgcagttcgaacacaacatacaactacaagaccagttccagatactagtagacttccaggtgctactccaggtcttacaacagttgaaattgtcactatgagtcatcaagcattaggagatgtagctggaagaggaaatgaaaaaaaaccatcatccgttagagctctttctattgttctcccaatagttttacttgtttttctttgtcttggagtttttttattatggaaaaattggcgtcttaagaatattaattcaattaattttgataatccagtttatcaaaagacaactgaagatgaggttcatatttgtcataatcaagatggatattcttatccaagtagacaaatggtatcacttgaagatgatgttgct

SEQ ID NO: 155 - DNA, 2580 bp, Artificial Sequence
  Description of Artificial Sequence: Synthetic Transcript Sequence
atggggccatggggctggaagctgcgatggactgtggctctactgttagctgctgcaggcactgctgtcggggatcggtgcgagcgcaacgagttccagtgtcaggatggcaagtgcatcagctataagtgggtgtgcgatgggagcgcggaatgtcaagacggaagtgatgaatcacaagaaacatgcctctccgtgacttgtaagtcaggtgacttctcctgtgggggaagggtcaacagatgtatccctcagttctggaggtgtgacggccaggtggactgtgacaacggaagcgacgaacagggctgcccgcctaaaacttgtagccaagatgagtttcgctgtcacgacggcaaatgcatttccagacagtttgtctgcgattcagatcgagattgtctggacggctctgacgaggcatcctgtcctgttctcacctgtggccctgcctcgttccagtgtaactcttctacctgtatccctcagctctgggcttgtgacaacgatcccgattgtgaggatggatcagacgaatggcctcaacgttgtcggggcctctacgtttttcagggggactcatcaccgtgcagtgcttttgagtttcactgcctgtccggagagtgcatccactcatcctggcggtgcgatggaggtcctgattgcaaggacaaaagcgacgaggagaattgtgccgtagcaacctgccgcccggacgagttccagtgcagtgacggaaactgcatacatggatcaaggcagtgcgatcgtgaatacgattgtaaagacatgagcgacgaggtcggatgcgtcaacgtcaccctttgtgaagggcccaacaagttcaaatgccactccggggagtgcattactcttgacaaggtctgcaacatggccagggactgtcgtgactggtcagacgaacctataaaggagtgtgggaccaacgagtgcctggataacaacggcggctgctcccacgtgtgcaacgacctaaagattggctacgagtgcctatgccccgacgggttccagttggttgctcagcggcgatgtgaagacattgatgagtgccaagacccggacacttgtagtcaactgtgtgtgaatcttgagggaggttacaagtgccaatgtgaagaggggtttcaactggatccacacacaaaggcttgcaaagccgtaggcagtatcgcctatttattttttactaaccggcatgaagtgcgcaaaatgactcttgaccgcagcgagtatactagccttatccctaatcttcgtaacgttgtcgcactggacacggaagtggcctcaaaccgaatctattggtccgacttgtctcaacggatgatttgtagtacacagctggacagagcacacggcgtgagcagttacgatactgttatttctcgcgacatacaagctcctgacggtctggccgtcgactggattcactccaatatctactggactgacagtgtactcggtaccgtgtccgtagcagacactaagggagtgaagcgtaagacactctttagggaaaatgggtcaaagccacgggccatcgttgtggatcctgtccatgggtttatgtattggaccgattggggaactcctgccaaaatcaagaaggggggcctgaacggggtggacatttattcgttggttactgagaatattcagtggcctaacgggattacccttgacctgctgagtggacggctttactgggtggactccaagctgcactctatttcatctattgacgtgaacggcgggaatcggaagaccatcctggaagacgaaaagagacttgcacaccccttctccctggcagtgttcgaggacaaggtgttctggaccgatattatcaacgaagcaattttttcagcaaacagactgacagggtctgatgtgaatctgctggccgaaaatctgctgtcaccggaggatatggtcctgttccacaatcttacacagccacggggcgtgaactggtgcgaacgcacgacattgtccaacggcgggtgtcagtatctttgtctacctgctccacagattaacccccactcgccaaaatttacttgcgcatgccctgacgggatgcttctcgcaagggatatgcggtcttgcttgactgaggcggaagcagccgtcgccacccaggagactagtactgttaggcttaaggtcagcagcactgccgtgagaactcagcacacaaccaccagaccagtccccgacacctcaagactccccggagccaccccaggactaactaccgtggagatcgtgaccatgagccaccaagcgctaggggatgtggccggtcgcgggaacgaaaagaagccttccagcgtgcgagcgctcagtattgtgttaccgattgtcttgctggtgttcctatgtcttggggtgttcctcctgtggaaaaattggagattgaagaacataaatagtattaacttcgataatcctgtgtaccaaaagaccaccgaagatgaggtccacatttgtcataatcaagatggctacagctatccttcacgccagatggtgagtctggaggatgacgtagct

SEQ ID NO: 156 - DNA, 2580 bp, Artificial Sequence
  Description of Artificial Sequence: Synthetic Transcript Sequence
atggggccctggggctggaagctcagatggaccgtagccctacttttagctgctgcaggcacagcagtgggtgaccgctgcgagcggaatgaattccagtgtcaagatggtaagtgcatctcttataaatgggtgtgtgatgggtctgcagagtgtcaggacggcagcgatgagtcacaggagacatgcctcagtgtgacatgcaagagcggggatttcagttgtggcggtagagttaacagatgtattccccaattttggcgctgtgacggccaggtggactgcgacaacgggtctgacgagcagggttgtccacccaagacgtgctcgcaggatgaatttcggtgccacgacggcaaatgtatttcaaggcagtttgtgtgcgatagtgaccgagattgcctcgacggcagtgacgaggcctcctgcccagttctgacatgtggccccgccagtttccagtgcaactcgtctacatgcatccctcagttatgggcctgcgataatgacccagactgcgaagatggatccgatgagtggccccagcggtgtcggggtctctatgtcttccagggcgatagcagcccttgtagcgctttcgagttccactgtctgtctggagagtgtatacactcctcctggagatgcgatggcggccccgactgtaaagacaagtcagatgaggagaactgtgcggtggccacctgcaggccagatgagttccaatgcagcgatggcaattgcatccacggaagtcgccagtgcgaccgggagtacgattgcaaggacatgtccgacgaagttgggtgcgtcaacgttacactgtgtgagggacccaacaaatttaagtgtcattctggtgagtgcatcacactggataaagtctgtaacatggcgagagactgcagggattggagtgatgagcctattaaagagtgtggaacgaatgagtgcctggacaataatgggggctgttctcacgtgtgcaacgatctcaagatagggtatgagtgcctctgtccagatgggttccaactggtcgcccagcgccgatgtgaggatatcgacgaatgtcaggatccagacacctgttcacagctatgcgttaacctggagggtggatacaagtgccagtgcgaagaaggttttcagctggatcctcataccaaagcgtgtaaggcagttggcagtattgcctatctgttcttcaccaatcggcatgaggtcaggaagatgactcttgaccgcagcgagtacacttccctgattccaaatttgagaaatgtggtagcactcgacacagaggtagcatctaacaggatctactggagcgacttatcccaacggatgatctgcagcacccagctggatcgggctcacggcgtttcatcttacgatactgtgataagccgggatattcaagccccagacggactggccgtggactggattcacagtaacatttactggacagactcggtactggggactgtctccgtggcggataccaagggtgtcaagcgaaagactctgtttcgtgaaaatggatcgaaaccacgcgccatcgtggtggacccagtgcacggattcatgtattggacagactggggcaccccagccaagataaagaaaggtggacttaatggcgtggatatttactctctggttactgagaacatccagtggcccaacgggataaccctggaccttttatccggtcggttatactgggtggacagtaagctccacagcatctcttccattgacgttaatggagggaatagaaagacaatcctggaagacgagaagaggctcgcacaccccttttctctcgcagtgttcgaggataaggtcttctggacagacattataaacgaggcgattttctcagcgaaccggctcactggctcagacgtcaacctcctggccgaaaacttgctatctcctgaggacatggtgctgtttcacaatttgacccagccacggggtgtgaactggtgcgagcgcaccacccttagcaacggggggtgccagtatctttgccttcctgcacctcagatcaatcctcactccccaaagtttacgtgtgcctgccccgatggcatgctgctggccagagatatgcgttcatgcctgacagaagcagaggccgccgtcgccacacaggagacgtcgaccgtcaggttaaaagtctccagcacagcagttaggacacagcataccactacccgacccgtgcctgacacttcccggcttccgggggctactccggggcttactaccgtggaaatcgtgacaatgtcacatcaggcgctcggcgacgttgccgggagagggaacgagaagaaacccagtagtgttcgagctctgtcgatcgtgctaccgatcgtccttctcgtcttcctctgtctgggcgttttccttctgtggaagaactggcgactgaagaatattaacagtattaacttcgataatccggtttatcagaagacaacagaggatgaggtgcatatttgtcacaatcaggacggatatagctacccttctcgccaaatggtgtctttggaagatgatgtggcg

SEQ ID NO: 157 - DNA, 2580 bp, Artificial Sequence
  Description of Artificial Sequence: Synthetic Transcript Sequence
atgggtccatggggctggaaacttagatggaccgtcgccctgttattggctgcagccgggacagcggtgggtgacaggtgcgagagaaatgaatttcaatgtcaggatggtaaatgtatctcttacaagtgggtttgcgatggaagcgctgagtgtcaagacggtagcgacgaatcacaagaaacatgtttgtctgtaacctgcaagtcgggcgatttctcctgtgggggtagggtaaaccgatgcattcctcagttctggcggtgcgatggccaggtggattgcgacaacgggagtgatgagcagggatgtccccctaagacctgctcacaagatgagtttcggtgccacgacgggaaatgcatctcccggcagttcgtgtgcgactcggatcgggactgcctggatggcagcgatgaagccagttgccctgtactgacttgtgggccggcctcattccagtgtaatagttccacctgcatcccccagttgtgggcgtgcgacaacgacccagactgtgaagatggctccgatgaatggcctcagcggtgtcgcgggctctacgtcttccagggagatagctcaccttgctccgcattcgaatttcactgcctttccggcgaatgcattcatagttcttggaggtgcgatggaggcccagattgcaaggataagtccgatgaagagaactgcgctgtggccacatgtaggccggacgagttccagtgtagtgacggtaactgcattcacggctcccgtcagtgtgaccgagagtatgactgcaaggatatgagcgacgaagtgggctgcgtgaacgttactttatgtgagggacccaataaattcaaatgccattctggggaatgtataaccctggacaaggtttgtaacatggctcgagactgcagagattggtcagacgaacccatcaaggagtgcgggactaatgagtgcttagataataacggaggctgcagccacgtctgcaatgacctgaaaattgggtatgaatgtttatgccccgatggattccagttggtcgcacagcgtagatgtgaagatattgatgaatgtcaggatccagatacatgtagccaactgtgtgtgaacttggaaggtggatacaagtgccagtgcgaggagggattccagttagacccccacaccaaggcctgtaaagccgtaggcagcattgcctatctgttcttcaccaaccgccacgaagtgagaaagatgaccttggatcggagcgaatacacctctctgattccaaatttgcgtaacgtggtagctctcgacactgaagtcgcctcaaataggatttactggtctgatctgtctcagaggatgatttgtagtacgcagttggaccgtgcccacggagtcagtagctacgacaccgtgatctcgcgagatatccaggctccagatgggttggcagttgactggatccattccaacatttactggaccgacagtgtgttggggaccgtttcagtggctgataccaagggggtgaagcggaagacactttttagggagaatggatccaagccccgcgctattgttgtggaccccgttcacggctttatgtattggactgattggggcaccccagccaaaatcaagaaaggaggcctgaacggcgtggacatttactccctcgtcaccgaaaatatccagtggcccaatgggatcaccctggatctgctgtctggtcggctgtactgggtcgattccaaactgcattctatatcctcaatcgatgtgaatggaggtaacaggaagacgatcctggaagacgagaaacgcttggctcaccccttcagcctggccgtttttgaagacaaggtgttctggactgacataatcaacgaagcgattttcagcgctaataggctaactggatccgatgttaacctgttagcagaaaacttgctctcccccgaagatatggttctgttccacaatctcacacagcccagaggcgtgaattggtgcgaacgtacgacgctgtccaatggggggtgccagtatttgtgcctgcctgccccacagatcaacccccattcgccaaagttcacctgtgcctgtccagacggtatgctcctggcccgggacatgcgctcctgccttaccgaggccgaggcggccgttgcaacacaggaaacatccacagtgaggcttaaggtttcttcaaccgcagtaaggacccaacacacaacaactaggccagtccctgatacaagtcgcctgccgggcgctactcccggtctgaccacggtcgaaattgtgaccatgtcacatcaggcccttggcgacgtcgctggtcgcgggaatgagaagaagccgagctcagtacgcgctttgtcaatcgtcctccctatcgtgctgctcgttttcctgtgcctaggtgtgtttctcctctggaagaattggcgactcaagaacataaacagtataaacttcgataatccagtatatcagaaaacgacggaggatgaagtgcatatctgccacaatcaagatggatactcttatcccagcagacagatggtgagtctggaggacgatgttgct

SEQ ID NO: 158 - DNA, 2580 bp, Artificial Sequence
  Description of Artificial Sequence: Synthetic Transcript Sequence
atgggcccttggggatggaaactcagatggaccgtggccctcttgctcgctgcagcagggaccgctgtcggagaccgatgcgagcggaacgaatttcaatgccaggatggcaaatgtatttcatacaagtgggtgtgcgacggtagcgccgagtgccaggatgggagtgatgagagccaggagacatgcctgtcagtcacctgtaagagtggcgacttttcctgcggcgggagggtgaaccgctgtattccgcagttttggcggtgtgatggacaagtggattgcgacaacggctcagacgaacagggatgtcctccaaagacatgctctcaggatgagtttcgatgtcacgacggaaaatgcatttccaggcagtttgtgtgtgactctgacagggactgcctggacgggagcgatgaggcttcctgtcccgtgctcacctgcgggccagcatctttccagtgcaacagtagcacttgtatccctcagctttgggcctgtgataatgacccagactgcgaggacggctctgacgagtggccccagagatgcaggggattgtacgtcttccagggcgacagcagcccttgcagcgcatttgaattccactgtctcagcggcgaatgtatacacagctcctggaggtgcgatgggggacctgactgtaaggacaagtccgacgaagagaattgcgcagtagccacatgtcgccctgacgagttccagtgctccgacggaaactgtatccacgggtcccggcagtgtgatagagagtatgattgcaaagatatgtctgacgaggtaggatgtgttaacgtcaccctctgcgaggggccgaataagttcaagtgccacagtggtgagtgtatcactttggataaggtctgtaacatggcccgggattgcagggactggtcagatgaacctattaaggaatgcggtactaatgagtgtctggacaataatggcggttgttctcacgtgtgtaatgacttgaagatcgggtacgaatgcctctgcccagacgggttccagctcgtcgcccagaggcgatgtgaggacattgacgaatgccaagatccagacacgtgttctcagctttgcgtaaacttggagggtgggtacaagtgtcagtgcgaagaagggtttcaactcgatccacacaccaaggcatgtaaggccgtggggtccattgcgtacctgtttttcaccaataggcatgaagtgcggaaaatgactctggaccgctctgaatacacctctttgatccccaacctcaggaacgtggtcgccctggatacagaggtagctagtaatcgcatttactggtcagatctgtctcagcgcatgatctgctctacccaactggacagggcacatggagtcagttcttatgacacggtgatctctagagatatacaggccccagacgggttggccgttgactggattcattccaatatctactggacagatagcgtgctgggtacagtttctgtggccgatacaaagggcgtcaagagaaaaaccctctttagagaaaacggcagcaagccacgggcgatagtggtcgatcccgtccacggctttatgtactggacagattgggggacccccgccaagattaagaagggggggttgaatggagtcgacatatacagcctggtcaccgaaaacattcaatggcctaacgggatcacactcgacctgctgagcgggcgcttgtattgggtggattctaagcttcacagcatctcttcaatagacgtcaacggcggtaaccgcaagaccatactggaagatgaaaaacgactggcgcatccgttctcacttgcagtgttcgaagacaaggtgttctggacagacatcattaacgaggcgattttttcagccaacagattgaccggttccgacgtgaacctgctggcagaaaatctgctcagccctgaagatatggtgcttttccacaatctcacacagcccaggggagtgaattggtgtgaacgcaccactctttctaatggtggttgtcagtatctgtgtcttccagcacctcagatcaatcctcatagccctaagtttacgtgtgcatgtccggatggcatgttgctcgcgcgagatatgcgatcctgtctgaccgaagccgaggctgctgtggctactcaggagacgtccaccgtcagactcaaggtgtcttccaccgctgtgcgcactcaacacactaccactcggcctgtacccgatacgagccgcttgcccggggctactcccggacttaccactgtggagatagtgacgatgagccaccaagctctgggcgacgtggctggcagaggtaacgagaagaaaccgtcctcagtccgggccctctccatcgtgctgcctatcgtgctgcttgtgtttctttgcctcggagtgtttctcctttggaaaaactggaggctgaaaaacattaactccatcaacttcgacaatccagtgtaccagaaaaccaccgaagatgaagttcacatctgtcacaatcaggacgggtattcataccccagccgccaaatggtttcccttgaagacgatgtggca

SEQ ID NO: 159 - DNA, 2580 bp, Artificial Sequence
  Description of Artificial Sequence: Synthetic Transcript Sequence
atggggccatggggatggaagctgcgctggaccgtggcgctgctcctggctgccgcaggaaccgccgtgggagacagatgcgaaagaaacgagttccaatgccaggatggtaaatgtatctcgtacaagtgggtttgcgatgggtcagccgagtgtcaggacggatcggatgagtcgcaggaaacctgcctgtcagtgacgtgtaagtccggagacttctcctgtggaggaagagtcaatagatgcatcccacagttttggcggtgcgatggtcaggtagattgcgacaatggaagcgacgagcagggatgcccgcccaagacctgtagccaggacgaattcagatgtcacgacggtaagtgtatttcccgacagtttgtctgtgattccgaccgcgactgtcttgatggatcagatgaagcgtcgtgccccgttctgacttgtggacctgcctcgttccagtgcaatagctcaacctgcatccctcaactctgggcatgcgacaatgatcctgattgcgaagatggatcagacgagtggcctcagcgctgccggggactctacgtgttccagggagattcgtcaccctgctcagctttcgagtttcactgcctgtcgggagaatgtatccatagctcttggcggtgtgacggcgggcctgattgtaaggacaagtcggacgaagaaaattgcgccgtggcgacttgcaggccggatgaattccaatgtagcgatggcaactgcattcacggatcccgccaatgcgaccgcgagtacgactgcaaagacatgtccgacgaagtcggatgcgtcaacgttactctgtgcgaagggccaaataagtttaagtgtcactctggagaatgcatcaccctggataaagtgtgcaacatggcgcgcgactgtcgcgactggtcggacgagccgatcaaggagtgcggaactaacgagtgtctggataacaatggaggttgcagccacgtgtgcaacgatttgaagatcggctatgaatgcctgtgcccggacggcttccagctcgtggcacagcgacggtgcgaggacatcgacgagtgccaggaccctgacacttgttcccagctgtgcgtgaatctcgaaggagggtacaagtgccagtgcgaggaaggattccagctggatcctcataccaaggcgtgcaaggccgtcggatcaatcgcgtacctgtttttcactaacagacacgaagtgcgcaaaatgaccctggaccgttcggagtacacctccctgatcccaaacctgagaaacgtggtggcactcgacaccgaagtcgcctcgaacaggatttactggtcggacttgagccaacgcatgatctgttcgactcagctggatcgcgcgcatggagtgagctcctacgataccgtgatctcccgcgacatccaggcgcccgacggactggcggtcgactggatccatagcaacatttactggactgattctgtgttgggtactgtgagcgttgccgatactaagggagtgaagcgcaagaccttgttccgggaaaacggatcaaagcccagggcaatcgtggtcgaccctgtgcatggattcatgtattggaccgactggggcaccccagcgaaaatcaaaaaaggagggttgaatggagtggatatctatagcctggtgactgaaaacatccaatggcccaacggaattacccttgacttgctctcaggcaggctctactgggtggattccaagctgcactcaatctcgagcatcgacgtgaacggcgggaacaggaaaacgattctggaagatgagaagagactggcccacccattctcgctggccgttttcgaggacaaggtgttctggaccgacatcatcaatgaagcaatcttctccgcaaacaggctgaccggatcagatgtgaacctcctggcagagaacctcctttcaccggaagatatggtgctcttccataacctgactcaaccgagaggagtcaattggtgcgaaagaactacgctgagcaacggcgggtgccagtacttgtgtctcccggcacctcagattaatccgcatagccctaaattcacttgcgcctgcccagatgggatgctgctggcacgggacatgcgctcctgcctgactgaggccgaagccgccgttgccacccaggaaacgagcacggtgaggcttaaggtgtcaagcactgcagtcagaacccaacacaccactactagaccagtgccggatacctcgagactgccgggcgctacccccggactcactaccgtggaaattgtgacgatgtcccaccaagccctgggggacgtggcgggaagaggcaacgagaaaaagccatcctcggtgcgggctcttagcattgttctgccgatcgtcctcctggtgtttctgtgcctgggcgtgtttctgctttggaagaactggaggctcaaaaacatcaattcgatcaatttcgataatcccgtgtatcagaaaactacggaggacgaggtgcacatctgtcacaaccaagatggatactcatacccttcccgccagatggtgtcgctggaggacgatgttgcg

SEQ ID NO: 160 - DNA, 2580 bp, Artificial Sequence
  Description of Artificial Sequence: Synthetic Transcript Sequence
atgggtccctggggatggaagctaagatggaccgtagcgttgctgctggctgcagcagggactgctgtgggcgatcggtgtgagcgcaatgagttccagtgccaggatggcaagtgcatttcgtataaatgggtttgtgatggttcagcagaatgtcaggacggatccgacgagtctcaagaaacttgtctgagcgtgacatgtaagagtggtgacttctcatgcggaggccgggtgaacaggtgcataccccagttttggaggtgcgacggccaagttgactgcgacaacggaagtgacgaacaggggtgtccacccaagacatgctcacaggatgagttccgatgtcacgatggcaagtgtatttcccgacagttcgtgtgcgacagtgatagggactgcctggacgggtctgatgaagccagctgtcctgtgctgacttgtgggccagcttcctttcagtgtaactcaagcacttgtatcccccaattatgggcctgcgataacgatcctgattgtgaggatggaagcgatgagtggcctcagagatgtcggggcctctacgtcttccaaggagattccagtccatgtagcgcatttgagtttcactgcttgtctggcgaatgcatccacagctcatggcggtgtgacggaggacccgattgcaaggacaaatcggatgaagagaactgcgcagtggccacttgtagacctgatgagtttcagtgtagcgacggcaattgtatacacggaagtagacagtgtgatcgggagtacgactgcaaggacatgtcagatgaagtaggatgtgtcaacgtgacactctgcgagggtcccaataaatttaagtgccattccggagagtgtattacactggacaaggtttgtaacatggcacgagattgtcgggactggtccgatgaacctatcaaggaatgcggtaccaatgaatgcctggataataacggtggctgtagccatgtgtgcaacgacctaaaaattggctacgagtgcctctgcccagacggattccagcttgttgcacagcgtcggtgtgaagacatcgacgaatgtcaggatcccgacacatgctcgcaactgtgcgtgaacctcgagggaggatataagtgccagtgtgaagagggcttccaactggatccacacaccaaggcctgcaaagctgtggggtctattgcctacctgtttttcaccaatcgccacgaagtacggaaaatgacgcttgaccgatctgagtacacctccctaattcctaacctccggaacgtggtggcgctcgataccgaggttgcttctaataggatctattggtccgacctttcacaaaggatgatctgctctacacaattggatagggcccacggcgtatcttcctatgatacagtgattagccgtgacattcaggcccctgacggcctcgccgtagattggattcattccaacatatactggaccgactctgtcctaggcaccgtgagcgtggcagacaccaagggagtgaaaagaaaaaccctgtttagggaaaatggcagcaagccaagggctatagttgtggaccctgttcacggtttcatgtactggacagattgggggacacctgcaaagatcaagaaaggtggtctgaatggggtggacatttatagcttggtaactgagaatatccagtggcctaatgggataactttagatctgctgtccggtagattgtattgggtggacagtaaattgcattctatttccagcatcgacgttaatggcggaaaccggaagaccattttagaggacgagaaacgcctcgcacatcccttcagtctggccgtattcgaggataaggtcttttggaccgacattattaatgaagccatcttctcagctaacagactgactgggagcgacgtcaatctgctagctgagaatctgctcagtccagaagatatggtgctctttcataaccttacacagcctagaggtgtgaattggtgcgagcgaacaaccctctctaatggagggtgccagtacctatgcctgccagccccccagattaatcctcactctcctaagtttacttgtgcttgtccggatggaatgttgctcgcacgtgatatgcgctcttgtctgactgaggcggaggcggctgtcgccacacaggaaacctcaaccgttcgccttaaggtgtcaagtactgctgtaagaacccagcacacaaccactaggccagtgcctgacaccagcagattgcccggggccactcccgggttgacaacagttgagatcgtaacgatgagccaccaggccctcggggatgtcgcggggaggggcaatgagaagaagccatcctcagttagggctctcagcatcgttctgcctatagtcctattggtgtttttgtgcttaggggttttcctcctgtggaaaaactggaggttgaaaaatatcaacagtataaatttcgacaatcctgtgtatcagaagactacagaagacgaagtgcatatttgccacaaccaggacgggtattcctatccatcccgccagatggtgagcctcgaggacgatgtggct

SEQ ID NO: 161 - DNA, 2580 bp, Artificial Sequence
  Description of Artificial Sequence: Synthetic Transcript Sequence
atgggaccatggggttggaaactaagatggacagtcgccttactgctcgcggccgcgggcaccgcggttggtgacaggtgtgaaaggaatgagtttcagtgccaggacggaaagtgcatcagctacaaatgggtctgcgatgggagtgctgagtgccaggatggcagtgacgaatctcaggagacatgcctgtctgtgacctgtaaatccggtgatttctcctgcggcggcagagtgaatcgatgtatacctcaattctggagatgcgatggtcaggttgactgcgataacggtagcgacgagcaggggtgtcctccgaagacttgttcccaggatgaattcagatgtcatgatggcaaatgtatttcacgacaattcgtgtgtgattccgatagagattgcctggacggatctgacgaggcttcttgtcccgtgttgacttgcgggcctgcaagttttcagtgtaattcttcgacttgcatccctcagctatgggcctgtgataacgatcctgactgcgaggacggtagcgatgaatggccccagcgatgccgaggcttatacgtctttcagggggattcaagcccctgttcagcattcgagtttcattgtctgagtggagagtgtatccattcgtcttggaggtgcgacggaggccccgactgtaaggacaagagcgacgaggaaaactgcgcagtcgccacttgtcgccctgatgaattccagtgctctgacggcaactgtatccatggtagcagacaatgcgaccgcgagtacgattgtaaggacatgagcgatgaggttgggtgtgtgaatgtaactctttgtgagggtccaaataaatttaagtgtcattcaggcgaatgcattacactggacaaagtgtgtaatatggcgagggattgtcgtgattggtccgatgagccgatcaaggagtgtggaacaaacgagtgcctggataataacggggggtgttcacatgtgtgtaatgatctgaaaattggatacgaatgcctctgccccgacggatttcagctcgtggcccaaagaaggtgcgaggatatcgatgagtgtcaggacccagatacgtgttctcagttatgcgtgaatctggagggcggttataaatgccagtgcgaggagggtttccagctggatccccacacaaaggcttgtaaggccgtgggcagcatagcctatctcttctttacaaatcgacatgaggtgcgaaagatgacgcttgataggtcagagtatacttcactgattcccaatctccggaacgtggttgccttagacacagaggtggcaagtaaccgtatttactggagtgatctcagccagcggatgatttgttcaacccagctcgatcgcgcccacggtgttagttcttacgacacagtgatctctcgggatatccaggcccctgatggattggccgttgactggattcactccaacatctattggaccgacagtgtactgggcacagtgtccgttgcagatactaagggagtgaaaagaaaaaccctatttagagagaacggaagtaagccccgagccattgtcgttgatccggtgcacggctttatgtattggacagactggggaacccccgcaaagatcaagaagggcggcctcaatggtgtggacatctattccctagtgactgagaatattcagtggcccaatgggatcacactggacctactgagcggccggctgtactgggtggacagtaaactccattcaatctcctcaatagatgtgaatggtggtaacaggaaaactatattagaggacgaaaagcggttggcccaccccttctccctggctgtatttgaggataaggtattctggactgacattatcaacgaagcaattttcagtgccaaccgcctcacggggagcgatgttaacctcctagctgaaaatctccttagcccagaagatatggtgcttttccacaacctcacccagccccgaggtgtaaactggtgtgagcgcaccacactgagcaatggtggctgccaatatctctgcctgcctgcaccccaaattaacccgcattctcctaagttcacctgcgcgtgtccggacggcatgctgctggcaagggacatgaggagctgtctgacggaggcggaagcagcagtggctactcaagagacaagcaccgttcgattaaaagtgtccagcacagcagtcagaactcagcatactacaacccggccagttcccgacacaagcagactgccaggcgccacaccagggctaactactgtagagattgtgacaatgagtcaccaggctctcggcgacgtcgctggcagaggtaacgaaaagaaaccatccagtgtgcgggcactgtctatcgtgctgcctattgtgctgctcgtgttcctgtgtctcggagtttttctgctatggaagaactggaggctgaaaaacatcaactccataaactttgacaatccagtgtaccaaaagaccactgaagacgaagtgcatatctgtcacaatcaagatggctatagctacccaagccggcagatggtgtccctggaagatgacgtcgcg

SEQ ID NO: 162 - DNA, 2580 bp, Artificial Sequence
  Description of Artificial Sequence: Synthetic Transcript Sequence
atgggtccatggggctggaagctgcggtggaccgtcgccttgctgctggccgcagccgggactgccgtgggggatcggtgtgagcgcaacgaattccaatgtcaggatggcaagtgtatttcttacaaatgggtgtgcgacgggtccgccgagtgccaagacggttccgacgagtcccaggagacctgtttaagtgtgacctgcaaatctggcgacttttcctgtgggggtcgagtaaacagatgtatccctcagttctggaggtgtgacgggcaggtcgattgtgacaacggatctgacgagcagggatgtccccccaagacctgtagtcaggacgagtttaggtgtcatgatggtaaatgcatctcaagacagtttgtttgcgacagtgacagggactgtcttgacggttcagacgaagccagttgtcccgtgttgacgtgcggtcctgccagcttccagtgcaatagcagcacctgtatccctcagctgtgggcctgtgataacgacccggactgtgaggatggctctgatgaatggccgcaacgatgccgaggactgtacgtgtttcaaggcgattctagtccctgcagtgcattcgaattccattgcctgagcggggaatgcatacattcctcttggcgttgcgacggtgggccagactgcaaagacaagagtgatgaggagaattgtgccgtggcaacctgtagacccgatgaatttcagtgctccgacggaaattgtatccacggaagccgacagtgtgatcgagagtacgactgcaaggacatgtcagacgaagtagggtgtgtaaacgtgaccctctgtgaagggcctaataagttcaaatgccacagcggtgagtgtatcacgctggataaggtgtgtaacatggcgagagactgtagggactggtcagatgagccaattaaggaatgtggtacaaatgaatgtctggacaataacgggggttgttcccacgtctgcaacgacctcaagattggttatgagtgcctgtgtcctgacggctttcaactggtggcccagcggcgatgtgaagatatagatgaatgtcaggaccctgacacatgtagccagctgtgtgttaatcttgaaggcggctataagtgtcagtgcgaagaagggtttcagcttgatcctcatacaaaggcttgtaaggccgtcggaagtatcgcctacctgttttttactaacaggcatgaagtcaggaaaatgacactcgatcgttcagagtacactagtctgatccccaatcttagaaatgtagttgccttagacactgaagtggccagtaacagaatctactggagcgatttaagccagcgtatgatttgcagtacccagttagacagggcccatggagtgagtagctatgatacagtgatatctagggacattcaggcccctgatggactggccgtggactggatccattcaaacatctactggacagactcagtcttgggtaccgtctcggtggccgatactaaaggggtgaaaaggaagacactgttccgggagaacggttctaagccacgtgccatcgtggtcgatccagtacacgggttcatgtattggacagattggggtacaccagctaaaatcaagaagggtggcttgaatggtgtggatatctacagcctggtgacagaaaatattcagtggcctaacggaattactcttgacctgttatctggtaggctttactgggtggactccaaactccattctatttcgagcatcgatgtgaacggcggcaatcgcaaaactattctggaggacgagaagcgactcgcccatccttttagtctggccgtgtttgaggataaggtgttctggactgatatcattaatgaggctatcttcagcgccaatcgtctgaccgggtcagacgtaaacctcctcgcagagaacctgttgtctcctgaggacatggtgctgttccataacctgacacagccccgaggcgttaattggtgtgagcgaacaactctgtctaatggaggctgccagtatctttgccttcctgccccgcaaatcaacccccatagccccaagtttacatgcgcttgtcctgatggcatgctgctggctagggatatgcgaagctgcttgacagaggctgaggccgcagtggctacacaggaaaccagtacagtgcgattgaaggtttcctctactgccgtacgcactcagcacaccaccacacgacccgtcccagacacatctcgacttccaggagccactccggggcttaccaccgttgagatagtgaccatgagtcatcaagccttaggagatgtagctggcagagggaacgaaaagaaacccagcagtgtacgagccctgtccatcgttctcccaattgtactacttgtgttcctttgcctgggcgtgtttcttctttggaaaaactggagactgaaaaatatcaactccattaatttcgacaaccccgtgtatcaaaagacaaccgaggatgaggtgcacatctgccacaaccaagatggctactcctatccatccagacagatggtgtctctagaagacgacgtagct

SEQ ID NO: 163 - DNA, 2580 bp, Artificial Sequence
  Description of Artificial Sequence: Synthetic Transcript Sequence
atgggaccgtggggatggaagctccgctggaccgtggctctgctcctcgcagcggccggaacggctgtcggagacaggtgcgagcgcaatgaattccaatgtcaggatggaaaatgcatatcctacaaatgggtgtgtgacggttctgcggaatgccaagacggatccgacgagtcccaagaaacttgcttgagcgtgacctgcaaatcaggtgatttctcgtgcgggggacgcgtcaacagatgcatccctcagttctggcgctgcgatggacaagtcgattgtgacaacggttcagacgaacaaggatgccctcctaagacgtgctcccaggacgaattccgctgccacgatggtaagtgcataagcaggcaattcgtgtgcgatagcgacagggattgcttggatggatccgatgaagcgtcctgcccggtcctgacttgcggcccggccagctttcagtgcaactcgtcgacctgtatcccacaactgtgggcctgcgacaatgaccccgactgcgaggatggctcggacgagtggcctcagagatgccggggcctgtacgtgttccaaggcgatagctcaccgtgttctgccttcgagttccactgcttgtcgggagagtgcatccactcctcgtggcgctgcgacggcggaccggattgcaaggacaagagcgacgaagaaaactgcgccgtcgcgacgtgccgtccggacgagttccagtgctcagacggcaattgcatccatgggtcccgtcagtgcgatcgggaatacgactgcaaagatatgagcgacgaggtcggatgcgtgaacgtgactctgtgtgaaggaccgaacaagttcaagtgccattctggagaatgcattaccctggataaagtgtgcaacatggcacgcgattgccgggactggtccgatgagcctatcaaagaatgcggaactaacgagtgtctggataacaacgggggatgttcacatgtgtgtaatgatctgaaaatcggatacgagtgcctctgcccggatggtttccagcttgtggctcagcgcaggtgcgaagatatcgatgaatgccaggatccggacacgtgttctcagctctgcgtgaatctggaaggcggctacaagtgccaatgcgaagagggattccagctggacccgcatactaaggcctgcaaggccgtgggttcgatcgcctacctgttcttcaccaaccggcatgaagtccggaagatgacgctggatcgaagcgaatacacctcgcttattccgaatctgagaaatgtcgtggccttggatactgaggtcgcctcaaaccggatctactggtcggacctcagccagcgcatgatctgttccactcaattggaccgggcccacggcgtcagcagctacgacactgtcatttccagggatatccaagccccggacggactcgccgtcgattggatccattcgaatatctactggacggactcagtgctgggcactgtgtccgtcgcagacaccaagggtgtgaaacgcaagaccctgttccgggaaaacgggtcaaagccgcgcgcgatcgtcgtggacccggtccatggattcatgtactggactgattggggcacccccgcaaagatcaaaaagggaggactgaacggggtggatatctattcactggtgaccgaaaacatccagtggcccaatggtatcacgctggatctgctgtcagggaggctgtactgggtggactcgaagctccactccatctcgtcgattgatgtgaatggcgggaaccgcaaaactattctcgaagatgagaagcgcctggcgcatccattctcgctggccgtgtttgaggacaaggtgttctggaccgacattatcaacgaagccattttctcggcaaaccggctgactggatccgatgttaacctcttggccgaaaatctgctgtcacccgaggacatggtcctctttcacaatttgacccaaccacggggagtcaattggtgcgaaaggaccacgctgtccaacggcgggtgccaatacctctgcctgccagcgcctcagatcaaccctcacagcccgaagtttacttgcgcctgtccagacgggatgctgctggcacgggatatgagatcgtgcctgaccgaggccgaggcggccgtggcaacccaagaaactagcaccgtgaggttgaaggtgtcatctaccgcggtgcggacgcagcacaccactactagaccggtgccagatacctccaggctccctggtgcaaccccaggactgactaccgtggaaattgttaccatgtcccaccaggcactgggcgacgtagctggaagaggaaacgaaaagaagccgtcatcggtgagggctctcagtatcgtcctgcccatagtgttgctggtgtttctgtgcttgggtgtgttcctgctttggaagaattggcgcctcaagaacatcaattcaatcaatttcgataacccagtctaccaaaagacgaccgaggacgaggtgcacatctgtcataatcaagacgggtactcatatccatcgagacagatggtgtccctggaggacgacgtggcc

SEQ ID NO: 164 - DNA, 2580 bp, Artificial Sequence
  Description of Artificial Sequence: Synthetic Transcript Sequence
atgggaccctgggggtggaaactgagatggacggtggcgcttctcctagctgcggctgggacagcagtcggagatcggtgtgagcgaaacgagtttcagtgtcaggatgggaaatgcattagttataaatgggtatgcgatgggtctgcagaatgccaggacgggtcagatgagtctcaggagacttgtctttcagtcacttgtaagtctggggacttttcatgcggaggaagagtcaaccgatgtataccacagttctggagatgtgatggacaagtggactgtgataacggatctgatgaacaagggtgtccacctaaaacatgcagtcaggatgaatttcggtgtcacgatgggaagtgtataagtagacagttcgtctgtgattcagatagagactgtcttgatggatcagatgaagcttcttgccccgtactcacatgcgggccagcctcctttcagtgtaattcctctacatgtattcctcagctctgggcatgcgataacgacccagattgcgaagatggatctgatgagtggcctcaacgctgccggggactctacgtatttcagggggattcaagtccttgttccgcctttgaatttcactgtctttctggagaatgcatccacagtagttggaggtgtgatggggggcccgattgtaaggataaatccgacgaagaaaattgcgctgtagctacttgtcgcccagacgaattccagtgttctgacggaaattgcatccatggaagtcggcaatgtgatagagaatacgattgcaaagacatgtccgatgaagttgggtgcgtaaatgttacactttgtgaagggcctaataaatttaagtgtcactctggggagtgtattacacttgataaagtatgcaatatggctcgggactgcagagattggtctgatgagccaattaaagaatgtgggactaacgagtgcctggataacaatggaggatgttctcatgtgtgcaatgatctgaaaattggatatgaatgcctttgtcccgacgggtttcagctcgtggcccagaggcgctgtgaggacatcgatgagtgtcaagatcccgacacatgttcacagctctgcgtcaatttagaaggggggtacaaatgccagtgtgaagaagggttccagcttgatccacatactaaagcctgtaaagctgtagggtctatagcctatcttttctttacaaacaggcatgaagttagaaaaatgactctggatagaagtgaatatacttctctaattcccaatcttaggaatgtcgtagcactagatactgaagtggcctctaacagaatctattggtctgacctaagtcaaagaatgatctgctccactcagttagaccgggcacatggggtgtcctcttatgatacagtcatctctcgggatatccaggcgccagatgggcttgccgtcgactggattcacagtaacatttattggacagattcagtactgggaactgtatctgttgcagatacaaaaggggtcaagagaaaaacactgttcagggagaatggatctaagcctcgggcaatagtggtcgatcccgtacatggatttatgtattggacagattggggaactcctgcgaaaattaaaaaaggaggattaaacggagtcgatatatattcactagtgactgaaaacatccagtggcccaatgggattacacttgatctcctttctggacggctgtattgggtagatagtaaattacattctatctcatcaatcgacgtcaatggggggaaccggaagactatactagaagatgaaaaacgcctcgcacaccccttttcattagcggtttttgaagataaagtcttttggacagatattataaacgaagctatattctccgccaatcggctcacaggaagtgacgtcaatctcctcgccgagaatcttctgtccccagaagatatggtgctattccataatttaacacagcctaggggagtgaactggtgcgaaaggactactctttcaaatggagggtgtcagtatttatgccttccagcccctcagattaatcctcactctcctaagttcacatgtgcttgccccgatggaatgctgctggcccgggatatgagatcttgcctcacagaagctgaagctgccgttgccacacaggagactagtactgtaaggctgaaagtgtcctctactgcagtgagaactcagcatacgactactcgccccgtccctgatacttctaggctgcccggagcaacacccggactcacaacagtggaaatcgtgacaatgagtcatcaggcattgggagatgtagcgggaaggggaaatgaaaagaaaccttcaagtgtgagagcgctgtccatcgtgcttcctatcgtgctgttagtatttctatgtttaggagtttttttactttggaagaactggcggctcaagaacataaattctattaactttgataacccagtgtaccagaaaacaacggaagatgaagttcatatctgccataatcaggatggatattcctacccatctagacagatggtatccctggaagatgatgtggct

SEQ ID NO: 165 - DNA, 2580 bp, Artificial Sequence
  Description of Artificial Sequence: Synthetic Transcript Sequence
atgggcccgtggggctggaagcttcgctggaccgtcgctctccttcttgccgcggcaggcacagctgttggtgaccgttgcgagagaaatgaattccagtgccaagatggaaagtgcatcagttataaatgggtatgcgacggcagtgccgaatgccaagatggatcagatgaatcgcaagagacgtgcctgtcagtgacatgcaagagcggggacttctcttgcggtggacgcgttaaccggtgtataccgcaattttggcgttgcgatgggcaggtcgattgtgataacgggagcgatgaacaagggtgcccaccgaaaacgtgtagtcaagacgaattccgctgccacgatggaaaatgcattagccggcaatttgtctgcgattcggatagagactgcttggatggctcagacgaggccagttgccctgtgctgacatgtggaccggcgtcttttcagtgcaattcctcaacatgcatcccccaactgtgggcgtgcgacaatgacccagactgcgaagatggctccgacgagtggccgcaacgttgtcgtggcctctacgtattccaaggcgacagctcgccgtgttctgcctttgaatttcattgcctgtcgggtgaatgtattcactccagctggagatgtgatggaggcccggattgcaaggataaatcagacgaagagaattgtgcggtcgctacgtgtcggcctgacgaatttcaatgttcagacggcaactgcatccatggaagccgacagtgcgatagggagtacgattgcaaggatatgtccgacgaagtggggtgtgtgaacgtcacactgtgcgaggggcctaataaattcaagtgccattcgggcgaatgcataacgttagataaggtgtgtaatatggccagagattgccgcgattggtctgacgagccgattaaagaatgtggaacaaatgagtgccttgacaacaacggaggttgttcacatgtctgcaatgacttgaagattggttacgaatgtttatgtcctgacggatttcaattagttgctcaaagaagatgtgaggatatcgacgaatgtcaggatcctgatacgtgcagccagttgtgtgttaatcttgaaggtggatataaatgccagtgcgaggaaggctttcagctcgaccctcacacgaaagcgtgcaaagccgttgggtcaattgcctaccttttttttacaaatcgtcatgaagttaggaaaatgaccttggatagaagcgaatatacaagcctgatcccaaacctgcggaatgttgtcgcactggacacggaagtggcctcgaatcgtatctactggtcagacctgtcacagaggatgatttgcagtacacagttggatcgcgctcatggcgtcagctcatatgatacggtgattagtcgagatatacaagcgcctgacggattagcggtcgattggattcatagcaatatttactggactgattccgtactgggaacggtgagtgtggcggatacaaagggagtgaaacgcaaaacattatttcgcgaaaatggttcaaaaccgagggcaatcgtagtcgatccggttcatggttttatgtattggacagattgggggacgccggccaagattaaaaaaggcggattaaatggtgttgatatttactccttggttacggaaaatatacaatggccgaatggtataacgttggatttgctatcaggtcggttatattgggtggattctaaactgcactctataagttcaattgatgtgaacggcggaaaccgcaaaacaattttggaagacgaaaaacgcttagcgcatccattctcactggccgtgtttgaagataaagtcttttggacggacattattaatgaagcgattttctcagcgaataggcttacaggctctgatgtaaatttgttagcggaaaatctgctgtcaccggaagatatggtcttgttccataaccttactcagccgcggggcgttaattggtgcgagcggaccacattatcaaatggcggatgtcaatatctatgcttacctgcgccgcaaattaatccgcattcaccgaaattcacgtgcgcttgcccggatggtatgttgcttgcgcgagatatgcgcagttgcctgacagaagcagaggccgcggtagcgacccaggaaacatcgacggtccgtctcaaagtcagctcgacggccgtcagaacacaacatacaacaacgagaccagtaccggatacaagcagattaccgggagctactccgggattgacgacagtggagatcgtaacaatgtcccaccaggcactgggagacgtggctgggcgcggaaatgaaaagaaacctagcagtgtgcgcgcgttaagcatcgtcttaccaattgttctgttagtattcttatgcttgggcgtctttcttctgtggaaaaattggagattgaaaaacattaatagcatcaacttcgataacccggtttaccagaaaacaactgaggacgaagttcatatatgtcataaccaggacggatattcttatccaagtagacaaatggtctctttagaggatgatgtggcg

SEQ ID NO: 166 - DNA, 2580 bp, Artificial Sequence
  Description of Artificial Sequence: Synthetic Transcript Sequence
atgggaccgtggggttggaagctgagatggaccgtggccttgttgctggctgcagcgggaactgccgtgggtgacagatgcgaacggaatgaatttcaatgccaagacggaaagtgcatttcctacaagtgggtttgtgacggttctgccgaatgtcaagacggatcggatgagtcccaggagacttgcttgtcggtcacttgtaaatccggcgatttctcctgtggagggagagtgaatagatgtatcccacagttctggcggtgcgacggacaggtggattgcgacaacgggtcggacgaacagggatgcccgccaaagacttgctctcaggacgaattccggtgccacgatggcaagtgtatcagccgccagtttgtttgcgactcagatcgggactgtctcgatgggtcggacgaggcttcatgcccggtgctgacctgcggacctgcgagcttccaatgcaactcctccacgtgcatcccgcagctttgggcgtgcgacaatgatccggattgtgaagatggatccgacgaatggcctcaaagatgccggggactctacgtgtttcagggggactcctctccttgctccgcctttgaattccactgcctctcaggtgaatgtatccattcttcatggagatgcgacggtgggccggactgcaaggacaaatcggacgaagaaaattgtgccgtcgcgacgtgccgccccgacgagttccaatgctctgacggcaactgcatccacggatcgaggcagtgtgatagagaatacgattgcaaagatatgagcgacgaagtgggctgcgtgaacgtgactctctgtgagggccctaacaagttcaagtgtcacagcggagagtgcatcacgctcgacaaggtgtgtaatatggcgcgggattgccgggattggtcagacgagcctatcaaggaatgcggtaccaatgaatgtcttgacaacaacggaggatgcagccatgtgtgcaacgacctgaagatcggatacgaatgtctttgcccggacggctttcagctggtggctcagcggcgctgcgaggatattgatgaatgccaggaccccgatacgtgctcgcagctgtgcgtgaaccttgaaggcggatacaaatgtcagtgcgaggaaggattccagcttgatccgcacaccaaggcttgcaaggccgtaggatccatcgcttacctcttcttcaccaatcggcacgaggtcagaaagatgaccctggatcgctccgagtacacctctcttattccgaacctgaggaatgtggtggcgctggatactgaagtggctagcaataggatctactggtcggacctctcccagaggatgatctgcagtacccagctggaccgcgcgcatggtgtgagctcctacgacaccgtgatctcgcgcgacatacaagccccagacggtctggccgtggattggatccattcgaatatctactggaccgactccgtgcttggtactgtgtctgtggcagatactaagggagtcaagagaaagactttgttccgcgaaaacggctcaaaaccgcgcgctattgtcgtggatccggtgcatggtttcatgtattggacggattggggcactccggcgaagatcaagaagggaggtctgaacggagtggacatctactccctggtgaccgaaaacatccagtggcccaacgggatcactctcgacctcctgtcaggacgcctctactgggtcgactccaaattgcatagcatctcgtccatcgatgtgaacggaggaaaccgcaaaactattctcgaggacgagaagcggttggcgcaccctttcagcctcgccgtctttgaggataaggtgttctggaccgacatcattaacgaggctatcttctcagctaatcgccttacgggatccgacgtcaacctgctcgcggaaaacctcctttccccagaggacatggtcttgttccataatctgacccaaccgcgcggggtgaactggtgtgaacgcaccactctgtctaacggagggtgccaatacctgtgcctgcccgcaccccaaatcaatcctcactcgccgaagtttacctgcgcctgtccagacggaatgcttctggcgcgcgacatgcggtcctgcctcactgaggcggaggccgctgtggcaactcaggaaacctcaactgtgcgactgaaagtgtcctccaccgcggtgcgtacccaacataccaccacccgtcctgtcccagatacttcgcggctgcctggggctactccaggtctgactactgtggaaatcgtcaccatgtcccatcaagcattgggcgatgtggcaggtcgcggaaatgaaaagaaaccctcaagcgtgagggctctgtcgatcgtcctgccaatcgtgctgctggtgtttttgtgtttgggagtgttcctgctgtggaagaattggcgcctcaagaatatcaactcaattaacttcgacaaccctgtctatcagaaaaccactgaggacgaggtgcacatctgccacaaccaggatggctactcctacccgtcaagacagatggtcagcctggaagatgacgttgcc

SEQ ID NO: 167 - DNA, 2580 bp, Artificial Sequence
  Description of Artificial Sequence: Synthetic Transcript Sequence
atgggcccctggggatggaagttacgctggactgttgcactgcttcttgcggccgctggaactgccgtaggggaccggtgcgaacgaaatgaattccagtgtcaggacggcaaatgcatttcttacaagtgggtgtgtgacggttccgcagaatgccaggatggctccgatgagtcacaggaaacctgcctatcggttacctgcaaaagcggggatttctcgtgcggagggcgagtgaatcggtgcattccgcagttctggagatgtgatgggcaggtcgattgtgacaatgggagtgatgagcagggctgccctcccaagacttgttcacaggacgaattcaggtgccacgacggtaaatgtatttcccgacagttcgtctgcgactcagatcgagattgtcttgatggaagcgatgaagcttcgtgccctgtcctcacttgtggtcccgcttcctttcagtgtaactcatctacctgcatcccgcagctgtgggcttgcgataatgatccggactgtgaggacggatccgacgaatggcctcaacgctgccggggcctatatgtttttcaaggggactccagtccctgctctgctttcgagttccattgtctctctggggagtgcatccactccagctggcgatgcgacggaggacccgactgtaaggataaaagcgatgaagagaactgtgccgtcgccacttgtcggcctgatgagtttcagtgttctgatggaaattgtatacatgggtctaggcagtgcgaccgcgagtatgactgcaaggacatgtcagatgaggttgggtgcgtgaacgtgactctgtgcgagggtccgaataaattcaagtgccatagtggggagtgcattactctggacaaggtctgtaacatggctagagattgtagagattggtctgatgagcccattaaagagtgcggaacgaacgaatgcctggataacaacggtgggtgcagccacgtgtgcaatgacttgaaaatcgggtatgagtgcctatgtccagacgggtttcaactggtggcccaacgtcgctgcgaggacattgacgagtgtcaggacccagacacctgcagtcagctttgtgtgaatctcgagggagggtataagtgtcaatgcgaggagggattccagcttgacccacatactaaggcctgtaaagcagtgggttcgatcgcttacttgttcttcacaaataggcacgaggtcagaaagatgacactagatcgtagcgagtacacgtccctgattcctaatctgaggaatgttgtcgccctcgataccgaggtggcctctaatagaatctattggagtgacctgagccagaggatgatttgctcaacacagctggaccgggctcacggggtgagcagctatgacaccgtcatttctcgggatattcaggcaccagacggcctcgcggtggactggatacattccaacatctattggacagacagcgtgcttggcacagtgtccgtggccgacaccaaaggcgtgaagcgaaaaaccctgttccgcgaaaacggctccaaaccccgagctatagtggtggatcccgtacatggcttcatgtactggacagactggggtacaccagctaagatcaaaaagggcggactgaacggggtggatatttactctttggtgacagaaaacattcagtggcccaacgggatcactctcgatctcctcagtggaaggctgtactgggtcgattctaaactccactccatctcatccatagatgttaacggcggcaatagaaagactatcttggaagatgagaagcggcttgcacatcctttcagcctcgccgtgtttgaggacaaggtcttctggaccgacattatcaatgaggcgatattttccgcaaatcgcttgaccgggtctgacgtgaacctactcgcggagaacctccttagccctgaggacatggtcctgttccataaccttactcagcctcgcggcgtcaattggtgtgagcgaactactctgtcgaacggaggatgccaatatctgtgtctgccagcaccacagatcaaccctcattcaccgaaatttacctgtgcatgcccagacggcatgctcctcgcgagagacatgcgatcttgccttacagaagccgaagctgcagtcgccactcaggaaactagcacggttagactgaaggtgagtagcaccgcggtaagaacgcaacacactacaaccagacccgttcccgatactagccggctgcctggggcaacaccaggattgaccaccgtcgaaatcgtgaccatgtcccatcaggccctcggcgacgtcgctggaagagggaatgaaaaaaagccctcaagtgtacgggctttaagcatagtacttcctattgtcctgttggtgtttctgtgcttaggagtgtttctcctctggaaaaactggcgtctgaagaatataaattctattaattttgacaatcctgtctaccaaaaaactacagaagacgaagtgcatatctgtcataatcaagacgggtacagctatccatctcgccaaatggtctcgttggaagacgatgtcgct

SEQ ID NO: 168 - DNA, 2580 bp, Artificial Sequence
  Description of Artificial Sequence: Synthetic Transcript Sequence
atgggcccatggggctggaagctccggtggactgttgctcttcttctcgcggccgctgggactgcagtcggcgataggtgtgaacgaaatgagtttcagtgccaggacggaaaatgcatcagctacaagtgggtttgcgacggctcggcagaatgtcaggatggttcggacgaatcgcaggagacttgtttgagcgtgacctgtaagtcaggagatttttcctgcggcggtcgcgtcaacaggtgcatcccgcagttctggagatgtgacggacaagtggattgcgacaatggatctgacgagcaggggtgcccgccgaaaacttgctcgcaggatgaatttcgctgccacgatggaaagtgtatttcacgccagtttgtgtgtgacagcgatcgcgactgcctggatgggagcgacgaagcctcgtgtccggtcctcacttgcggccctgcctcgttccaatgcaactcgagcacgtgcatcccccaactgtgggcatgtgacaacgaccctgattgcgaggacggttcagacgaatggccgcaaagatgccggggattgtacgtattccagggtgactcctccccttgctcagcgttcgagttccattgcctgtcaggagaatgcatccattcaagctggcggtgcgatggcggcccggactgtaaagataagtcggacgaggagaactgcgcagtggccacgtgccgccctgacgaatttcaatgttcggacggcaactgcatccacggctcaaggcaatgcgaccgggagtatgattgcaaagacatgtcggacgaggtcggatgcgtgaacgtaaccctgtgcgaagggcccaataagttcaagtgtcattccggagaatgtatcactctcgataaagtgtgtaatatggcgagagactgccgggactggtcggacgagcctatcaaagagtgcggaaccaacgaatgcctggacaacaatggagggtgctcacacgtttgtaatgacctcaagattggatacgagtgcctgtgcccagacggattccagctggtcgcgcagagacggtgcgaggacatcgatgagtgccaagacccggacacttgctcccagctgtgcgtcaatctggaaggcggctacaagtgccagtgcgaagaaggattccagctcgatccacataccaaggcatgcaaagccgtgggatcaatcgcctacctgtttttcaccaatagacacgaagtgaggaaaatgaccctggaccgcagcgaatatacctcgctgatcccgaatctccggaacgtggtcgccctcgacaccgaagtggcgtcaaataggatctactggtcggatttgtcgcagagaatgatttgctcaacccagctggaccgcgcccatggcgtgtcaagctacgatactgtgatcagcagggacatccaagcgccagacgggctcgcggtggactggattcacagtaacatatactggactgactcggtcttgggtaccgtgagcgtggccgacaccaagggtgtgaagagaaagactctgttcagggaaaacggatcaaaaccgcgggctatcgtggtggacccagtccacggattcatgtactggactgattggggcaccccggccaagatcaaaaagggcggactgaatggggttgacatttacagtcttgtgacggaaaacatccaatggccgaacggcatcaccctggacctcctgagcggacgcttgtactgggtcgactcgaagctgcattcgatcagctcgatcgatgtcaacggcggaaaccgcaagaccatcctggaggatgagaagagactcgcccacccgttctcgctcgccgtgttcgaagataaagtgttctggaccgacatcatcaatgaggcgatcttttccgcgaaccgtctcactggcagtgacgtgaacctgctggcggagaatctgctgtcgcccgaggatatggtgctgttccacaacttgacccaaccgcgcggtgtgaactggtgtgaacggactacgctgtcaaacggaggctgccagtacctgtgtctgccagcccctcaaatcaacccacattcgccaaaattcacttgtgcttgtcctgacggaatgctgctggcgcgcgacatgcggtcgtgtttgaccgaagcggaggctgccgtggctactcaagagacttccactgtgcggctgaaggtgtcctccaccgccgttcgtacgcagcacactactaccaggccggtcccagatacttctcgcctgccgggggccacccccggacttactacggtcgagatcgtgactatgtcgcaccaagcgctcggagacgttgctggcagagggaatgagaagaagccgagctcagtgagagcactgtcaatcgttctgcccatcgtgctgctcgtgttcctctgcctgggagtgttcctgctgtggaagaactggaggctcaagaacatcaacagcatcaattttgataatccagtgtaccaaaaaactactgaggatgaggtgcacatctgccataatcaggatggatactcgtacccatcacgccagatggtgagcctggaagatgatgtggcg

SEQ ID NO: 169 - DNA, 2580 bp, Artificial Sequence
  Description of Artificial Sequence: Synthetic Transcript Sequence
atgggaccatggggatggaagcttaggtggaccgtcgctctcctgcttgccgccgcaggaactgccgtgggcgacagatgcgagcgtaatgagtttcaatgtcaggacggaaagtgcatcagttacaagtgggtatgtgacggatccgccgagtgccaagatggttccgacgaaagtcaggagacctgcctcagcgtaacatgtaagagcggagacttcagttgcggcggaagggtcaatcgttgcatccctcagttttggcgctgcgatggacaggtcgactgtgacaacggttcagacgagcagggctgcccccccaaaacatgttcccaagacgaatttagatgccacgacggaaaatgtatctcaaggcagttcgtctgcgacagcgatagagactgtctggatggtagtgacgaagctagctgccctgtactgacctgtggccctgccagcttccagtgtaactcctccacatgcataccccagctgtgggcctgcgacaacgatcccgactgcgaggacggtagtgacgaatggccacagcgctgtaggggtctttacgttttccagggagactcctctccatgttctgctttcgagttccattgcttgtccggagaatgcatccatagctcttggaggtgcgatggaggtccagactgcaaggacaagagcgatgaagagaactgtgccgtggctacatgcaggcccgacgagttccaatgtagcgatggaaactgcatccacggttctaggcagtgcgacagagaatacgactgtaaggacatgagcgatgaagtgggttgtgtcaatgtgaccttgtgtgagggacccaacaagttcaagtgccactctggagagtgcatcacattggacaaagtatgcaatatggctcgtgattgcagggactggtctgacgagcccataaaagaatgtggtacaaacgaatgcctggataacaatggaggatgtagtcacgtctgcaacgatctcaagattggctacgagtgtctctgccccgacggattccaactggttgcacagaggaggtgcgaggacatagacgagtgccaagatcctgacacttgctcccagttgtgtgtcaacctcgagggaggctacaagtgccaatgtgaggagggtttccagttggatccacacactaaggcctgcaaggctgttggatccatcgcctatctgttctttacaaacagacacgaagtgcgcaaaatgaccctcgatcgttctgagtacacctctctcatccctaacttgaggaacgtggtggctttggacactgaggtggctagtaatagaatttactggagtgacctgagccaacgtatgatttgcagtacacagctggatcgcgcccacggagtgagcagctacgacaccgtcatcagtcgtgatatacaggcacctgacggacttgcagttgattggatccactccaacatctattggactgactcagtgcttggcactgtgtctgtggctgatacaaagggagtgaagcgcaagacattgttcagggagaatggttctaaacctcgcgctatcgttgtggaccccgtacatggcttcatgtactggactgattggggcacacccgccaagataaagaagggcggactcaacggcgtggacatctactccctggtgacagagaacatccagtggcccaacggcatcacattggatcttctctccggcagactttattgggtggactctaagctccattccatatcaagcatcgatgtcaatggtggtaatcgtaagaccatcctggaggatgagaagcgtctcgcacacccattctcactggctgtatttgaggataaggtgttctggactgacatcattaacgaagcaattttttctgccaaccgcctgaccggctctgacgttaacctgttggccgaaaatcttctcagcccagaggacatggtgcttttccataacctcacccaaccccgtggtgtaaactggtgcgaacgtactacactgtctaatggaggttgccagtacctgtgcctgcccgctcctcagatcaaccctcactcacctaagtttacctgcgcctgccccgatggaatgctgctggccagggacatgcgtagctgtcttaccgaagccgaggctgcagtggccactcaggagactagcaccgtgcgtcttaaggtctccagtacagctgtaaggacccagcacactacaacccgtcctgtaccagacacttcacgtttgccaggcgctacacctggcctcaccaccgtagaaattgtaaccatgtcacaccaagctctgggagacgtggctggaagaggtaatgagaaaaagccttccagcgtgcgcgccttgtctatcgtcttgccaatagtcctgctggtatttctctgtctgggtgttttcctgctgtggaaaaattggcgtctcaaaaacatcaactcaattaacttcgataaccctgtgtaccagaaaactactgaggacgaggtgcatatctgccacaatcaggatggctactcttacccctcacgccaaatggtgtccttggaggatgatgtagct

SEQ ID NO: 170 - DNA, 2580 bp, Artificial Sequence
  Description of Artificial Sequence: Synthetic Transcript Sequence
atgggcccttggggatggaagctccggtggaccgtggccctgctcctcgcggccgccggaaccgccgtcggcgataggtgcgaacggaatgagttccagtgccaggatggaaagtgtatttcatacaagtgggtctgtgacgggtccgccgaatgccaggacggatcagacgaaagccaggagacgtgcttgagcgtgacttgcaaatcgggagatttctcgtgcggaggccgcgtgaacaggtgtatcccacagttttggcgctgcgatggccaagtggattgcgacaacggttccgatgaacaaggatgtccccctaagacttgctctcaagatgagttcagatgtcacgatggtaaatgtatcagccggcagttcgtgtgcgactccgacagggactgcttggacggatctgatgaggcttcttgcccggtcctgacttgcggccccgcctcctttcaatgcaatagcagcacctgcatccctcagctgtgggcctgcgacaatgacccggattgcgaagatggcagcgatgaatggccgcaacgatgccgcgggctttacgtgttccaaggagactcgtcaccatgttccgcgttcgaattccactgcttgagcggagaatgcattcactctagctggaggtgcgacggaggacccgactgcaaagataaatccgatgaagaaaattgcgccgtggctacttgtcgcccagacgaattccagtgttccgatggaaactgtattcatggatcaagacagtgtgatcgggagtacgactgcaaggacatgtccgatgaggtgggatgtgttaacgttaccctgtgcgagggcccgaacaagtttaagtgtcactccggggagtgcatcacgctcgataaagtctgtaatatggccagagactgccgcgattggtcggacgagccgatcaaggaatgcggaaccaacgaatgcttggacaataacggaggatgctcacatgtgtgcaacgatctgaagatcgggtacgaatgtttgtgtcccgatggattccagctcgtcgcccaaagaagatgcgaggacatcgacgagtgccaggatccggacacctgctcacaactctgcgtgaacctcgaaggaggatataagtgtcaatgtgaggaaggatttcaactcgacccgcatactaaagcgtgcaaagctgtcggatcgatcgcttacctgttcttcacgaatcggcacgaagtgagaaagatgactttggaccgctcagaatacacttcactcatccccaacctgcgcaacgtcgtggcgctggatactgaagtggccagcaaccggatctattggtcggatctctcccagcggatgatctgctccacccagctggaccgcgcccacggggtttctagctacgacactgtcatctccagagacatccaggccccggacggtctggctgtggactggatacattcaaacatctactggactgactcggtcttgggcaccgtctcggtggcagacaccaagggggtgaaacggaaaactctgtttcgcgaaaacggatcgaagccgcgcgcgatcgttgtggacccagtgcatgggtttatgtactggaccgattggggaacgcccgctaagatcaagaaaggagggctcaacggagtcgacatttactcattggtgaccgagaatatccagtggccgaacggtatcactctggaccttctgtccggtcggctgtactgggtcgattccaagctgcactcaatctccagcatcgacgtgaacggcggaaaccgtaagacgattctggaggacgagaagcggctggcacaccctttcagcctcgcggtgttcgaggacaaggtgttctggactgacattatcaacgaagctatcttcagcgccaatcgcctgactggcagcgacgtgaacctgctcgcagaaaacttgctgagcccggaagatatggtgttgtttcacaacctgactcagcccaggggagtgaattggtgtgaacgcactaccctgtcgaacggaggctgccagtacctgtgcctgccggcaccgcagattaacccgcatagcccgaagttcacctgcgcatgtccagatggcatgcttctcgcccgggatatgcggtcctgtctcactgaagctgaagcggccgtggcgactcaggaaacctctactgtgcgactgaaggtgtcctccaccgctgtccgcacccagcataccacgactcggcctgtgccagacaccagccggctgcccggcgcgactcctggattgaccacggtggaaattgtgaccatgtcacaccaggcgctgggagatgtcgcaggcagaggtaacgaaaagaagccatcaagcgtgcgcgccctgagcatcgtgctgccgattgtgctgctggtgttcctttgtctgggagttttccttctgtggaaaaactggcgcttgaagaacatcaattcgatcaatttcgacaatccagtgtaccaaaaaactactgaggacgaagtgcacatctgccataaccaggatggatactcctacccatcacgccaaatggtttcgctcgaggacgatgtggca

SEQ ID NO: 171 - DNA, 2580 bp, Artificial Sequence
  Description of Artificial Sequence: Synthetic Transcript Sequence
atgggcccttggggctggaagctgaggtggacagttgctctattgttggctgccgctggaaccgctgtcggcgacagatgcgagagaaacgaattccaatgtcaggacgggaaatgcataagctacaaatgggtctgcgacggctcggcggagtgccaagacggctcggacgaaagccaagaaacatgtctgtccgtgacctgcaagtcgggcgactttagttgcggaggaagagtgaacaggtgtattcctcaattctggaggtgcgatggacaggtggactgtgacaacggtagtgatgagcaaggttgccctccaaaaacctgtagccaagatgagttccggtgccacgacggaaagtgcatctcacgccagtttgtgtgcgatagcgatcgagattgcctggacgggtcagatgaggcatcatgtccagtgctgacttgtggccccgcttcatttcagtgcaattctagcacttgcataccccagctctgggcatgcgataacgatcccgattgcgaggatggctctgacgagtggcctcagagatgtaggggattatatgtgtttcagggcgacagctctccctgcagtgcctttgagttccattgcctcagcggggaatgtatccattcaagctggcggtgcgatggaggccctgactgcaaggacaagtctgacgaagaaaactgcgccgttgccacctgtagacccgacgaattccaatgcagcgatgggaattgtatccacggctccaggcagtgcgaccgagagtatgactgcaaggatatgtctgatgaagtcggatgtgtgaacgtaaccttgtgcgagggaccgaacaaattcaaatgccattctggagagtgcatcacactggataaagtgtgcaacatggctcgcgactgtcgggactggagcgatgaacccattaaagaatgcggaactaacgaatgcctggacaataacggcggctgctcccatgtgtgcaacgatttgaagatcggttacgagtgcctgtgccctgacggcttccagctggtggcccagcggaggtgcgaagacatcgatgagtgccaggaccctgatacttgttcccagctctgcgtgaatctggagggcggctacaaatgccagtgtgaggaaggctttcaactggacccacatactaaagcttgtaaggctgttggatctattgcctatcttttctttaccaacaggcacgaggtcaggaagatgaccttggacagaagcgaatacacgagtctgatccctaaccttcgaaatgtggtggcactggataccgaagttgcttcaaatagaatttactggagcgatcttagccagcgcatgatctgttcaacccagctagacagggcacacggcgtgagctcatacgatacagttatcagcagggatatccaggcgcctgacgggcttgctgttgactggatccacagcaacatctattggaccgattctgtgctgggaacagttagcgttgcagataccaaaggagtgaagaggaaaactctctttcgcgagaacggttctaagccccgcgcaatcgttgtggacccagttcacggctttatgtattggactgactggggcacaccggcaaaaatcaagaaagggggcctcaacggagtcgatatctactctctggtcaccgaaaacatccagtggcctaacgggataaccctcgaccttctgagcgggagactttactgggtggacagtaaactccattcgatatctagtattgatgtaaatggtggcaacagaaagactattcttgaagacgagaaacgcctggcccaccccttctcactggcggttttcgaggacaaggtgttctggactgacattatcaacgaggcaatcttcagcgctaaccgattgacaggcagcgacgtcaacctcttggccgaaaatctgctatctccagaggatatggtgctcttccataacctgacacagccgcgtggagtcaactggtgcgaaaggaccaccttgagcaatggcggctgccaatatctgtgcctccctgctccccaaatcaatcctcatagtcctaaattcacctgtgcatgccccgacggcatgctgctcgcccgggatatgaggtcttgtctcaccgaggctgaggccgcagttgcaacccaggaaacttcaacagtgaggttaaaagtgtcatccaccgccgtgcgcacccagcacactaccacccggcccgttcctgacacaagcaggctgcccggagccaccccagggcttactactgtcgagatcgtgaccatgtcccaccaagcactgggagacgtggccggcagaggaaatgaaaagaagcctagcagcgtgagagccttgtctattgttctgcctatcgtgctgcttgtctttttgtgtcttggggttttcctcttatggaaaaattggcgcctgaaaaatatcaacagtataaacttcgataaccccgtttaccagaagacaactgaggacgaagtccacatttgccacaatcaggacggatattcatacccatcacgccaaatggtgtcacttgaggatgatgtcgct

SEQ ID NO: 172 - DNA, 2580 bp, Artificial Sequence
  Description of Artificial Sequence: Synthetic Transcript Sequence
atgggcccttggggttggaagctgcggtggacggtggctctcttgctagcggccgctggaacagctgtcggagacaggtgtgagagaaacgaattccagtgtcaggatggaaaatgtatatcatacaagtgggtgtgcgacggaagcgccgaatgccaggatggatcggacgagtcccaggagacatgcctgtctgtcacctgtaaaagtggtgatttctcatgtggcggacgggtgaacaggtgcattccccaattctggcgctgtgatgggcaggtggattgtgataacggctccgacgagcagggttgtcccccaaagacttgtagccaggatgagtttagatgtcacgatggaaaatgtatttcacggcaattcgtctgcgattctgacagagattgtcttgacggctctgatgaggcgagttgtccagtgctgacatgtggcccagcgtcgttccaatgtaattctagtacgtgcattcctcagctctgggcttgcgataatgatcccgactgcgaagacgggtcggacgagtggccacagaggtgcagaggcctttacgtcttccagggggactcctccccatgttctgccttcgaatttcattgtctttcaggtgaatgcatccattcatcttggaggtgcgacggaggcccggattgtaaggataagagcgacgaggaaaactgcgcagttgcaacctgccggcctgacgaatttcaatgcagcgatggaaactgcatacacggttccaggcaatgtgaccgagagtatgattgtaaagatatgagcgatgaagtcggctgcgtgaatgtgacactgtgtgaaggccctaataagttcaagtgccactccggcgagtgtattacacttgacaaggtgtgtaacatggcccgcgactgccgggactggtcagacgagcccattaaagagtgcggcaccaatgaatgtctcgataataacgggggctgttctcatgtgtgcaacgatctgaaaatcggttacgaatgcttgtgcccagatgggtttcagctcgtggctcaaagacgatgcgaagacattgatgagtgccaggatcccgatacctgttctcagttgtgcgtgaaccttgaaggcggctacaaatgccagtgcgaagagggcttccagctggacccccacaccaaggcttgtaaagccgtgggttccattgcataccttttctttacaaacaggcatgaggtgaggaagatgactttagatcgttcagagtacacctctctcatacctaacctcaggaacgtggtcgctctcgacacggaggtcgcaagtaacagaatctactggtccgacctttcccagcggatgatctgcagtacccagctagatagagcacatggggtgtctagctacgacaccgtgatttcgcgggacattcaagccccagacgggttggcggtggattggattcactcaaacatctattggactgattcagtgctcggcacagtatctgtggccgatactaagggggttaagagaaaaacccttttcagggagaacggcagtaaaccccgggcaatagtagtggacccagtgcatgggtttatgtactggacggattgggggactcccgccaagattaaaaaggggggtcttaacggtgtcgacatatattcgttagttacagagaacattcagtggccaaacggtatcaccctagacctgttaagtggcagactgtattgggtagacagcaagctccactccatctcgtccatcgacgtgaatggcgggaaccggaaaaccatcctggaggacgagaagcgactggcccaccccttctcacttgcagtgtttgaggacaaagtgttttggacagacattatcaacgaggctatattctcggctaatcgcttgactgggagcgatgtcaatcttctcgccgagaacctcctgtctccggaggacatggtgctgttccataatcttacccagcctcgcggcgttaattggtgcgaacgaactacattgtccaatgggggttgccagtatctatgtctgccagctccccaaattaatccacactccccaaaatttacctgcgcctgtcctgatggcatgctgcttgcaagggacatgagaagctgcttaacagaagccgaggctgcagtggccacacaggaaacctctactgtgcgattaaaagtgagcagcacagccgtgagaacccagcatacaaccacccgcccagtgcctgatacttcacggctgccaggcgccacaccaggactgacgactgtagaaatcgtgacaatgagccaccaggccctcggggacgttgcagggagaggtaacgagaaaaagccaagctcagtgagggcattaagtattgttttgcccatcgttctgctggtatttctgtgtctgggagtattcctcctgtggaagaactggcgcctgaagaatatcaattctatcaactttgacaaccccgtgtaccagaaaaccacagaagatgaggtgcatatttgccataaccaagacggttactcgtatccaagtaggcagatggttagcctggaagacgatgttgca

SEQ ID NO: 173 - DNA, 2580 bp, Artificial Sequence
  Description of Artificial Sequence: Synthetic Transcript Sequence
atgggaccgtgggggtggaagcttcgctggactgtcgctttgttattagctgcagcgggaactgccgtcggcgacagatgcgaaagaaatgaatttcaatgccaggatggcaaatgtatttcttataaatgggtctgtgatggaagcgccgaatgtcaagacggaagcgatgagtctcaagaaacgtgtttgtcagttacgtgtaaatcgggggatttcagttgcggtggtcgagttaatagatgcatcccacaattctggcgatgtgatggtcaagttgattgcgataacggaagcgatgagcaaggatgtccgccaaaaacgtgttcgcaagatgagttcagatgtcatgatggaaagtgcatttcccgacaattcgtgtgcgattcagatagagattgcttggatggttcggatgaagcatcttgccctgtgctgacttgtggacccgcaagttttcaatgcaattcttccacctgcattccacaactctgggcttgcgataatgatccagactgtgaagatgggtccgatgaatggccacaacggtgtcggggattgtatgttttccagggagatagcagtccctgtagtgcctttgagtttcattgtttgagcggagagtgtattcattcatcttggcgctgtgatggaggacctgattgtaaggataagtcagatgaagagaattgtgcagtggctacttgtcgcccagatgagtttcaatgctcggatggaaattgtattcacggttcccgtcaatgcgatcgggagtatgattgcaaagacatgtccgacgaggttggttgtgttaatgtaactttgtgtgaaggaccaaataagtttaaatgccactctggcgaatgcattacgcttgataaagtatgtaacatggcacgcgattgtcgagattggtccgatgaaccgattaaggagtgtggaacgaatgagtgcctagacaacaatggaggatgttcgcacgtgtgcaatgatctgaagattggttacgaatgcctgtgtccggatggattccagctggttgctcaaagacgctgtgaagatattgatgaatgtcaagatccagatacctgttcacagttgtgtgtaaatcttgaaggcggttacaagtgccagtgcgaagaagggtttcaactggacccacatactaaggcgtgtaaggcagtagggagtattgcatacttgtttttcaccaacagacacgaggtacgaaagatgactttggatagatctgaatatacttctctcatccccaatctaaggaacgtagttgcacttgacacggaggttgcgtctaaccggatctactggagcgatctttctcaacgtatgatttgttcaacccaattggatagagctcatggagtatcatcttacgacactgtcatttcccgagacattcaggccccagatggccttgccgtagattggattcactccaacatttactggacagatagcgtattaggaaccgtatcggttgcggatactaagggagtgaaaaggaaaactctttttcgagaaaacggatctaaaccacgagctattgttgtggatccagtacacgggtttatgtattggacagattggggaactcctgcgaaaattaaaaaaggcggactgaacggagtagacatctattctcttgttactgaaaatatccaatggccaaatggtataacgctcgatcttctttcgggacgactgtactgggtcgactctaagttgcattcaatttcgtcgatcgacgtaaatggaggaaatagaaaaactattctagaagacgaaaaacggctcgctcaccctttttcacttgcggtatttgaggataaagttttctggacagatataatcaacgaggctatcttcagcgctaatagacttacaggaagtgacgtaaatctgttggccgaaaacttgctgtctcccgaagatatggtactcttccacaatctcacacaaccacgaggagtcaattggtgtgaacggactacgctttcgaacggaggttgtcagtacctttgcctgccagctccccagatcaatccacattcacctaaatttacttgcgcgtgcccagatggtatgcttcttgctagagatatgcgttcatgtcttacagaagctgaagcagctgttgctacgcaagaaactagtacagttcgtttaaaagtgagttctaccgcggtgcgaactcagcacactaccacgcgaccggtcccagacacatccagactgccgggagctacgccaggactaaccacagttgaaattgtcaccatgtcacaccaagcactgggtgacgtggccggacgtggaaatgaaaagaagccaagttctgtgcgagctctgtctattgttctccccatagtacttctagttttcctttgtctcggcgtctttctgctgtggaaaaattggcgattgaaaaatatcaatagtattaattttgacaacccggtataccaaaagaccactgaagacgaggtccacatttgccataatcaggatggatacagttatccatccagacaaatggtctctcttgaagacgatgtggcc

SEQ ID NO: 174 - DNA, 2580 bp, Artificial Sequence
  Description of Artificial Sequence: Synthetic Transcript Sequence
atgggcccttggggctggaaacttcgctggacggttgcgctgctgttggccgctgccggtacggcagtgggggatcgttgcgagcgtaatgagttccagtgtcaagacggaaagtgcatatcgtataagtgggtatgcgacggatcggctgaatgtcaggatggttcggacgaatcacaggagacatgcctgagcgttacctgcaagtctggtgatttcagttgtggcggacgtgtgaatcgttgcattccccagttttggcgatgcgacggccaggtggactgtgataacggatcagatgaacaaggttgcccacccaagacctgctcccaggacgagttcagatgtcacgatggcaagtgcatttccaggcagttcgtgtgcgactcggaccgggattgcctggacggctcagatgaggcttcctgcccagtgctgacctgcggaccggctagcttccagtgcaacagttcgacatgcattcctcagctgtgggcctgcgacaatgatccagactgcgaggatggatctgacgagtggccgcagagatgccgtggtttgtatgtctttcagggtgacagttccccgtgttctgcctttgagtttcattgcttgtcgggcgaatgcatccatagtagttggagatgcgatggtggccctgattgcaaggataagagcgacgaggagaattgtgccgtagctacttgccgtccagatgagttccagtgcagcgacggaaactgcatccacggatcccgacaatgcgaccgcgagtatgactgcaaagatatgtccgatgaggtgggatgcgtgaacgtgaccctttgtgaaggaccgaataagttcaagtgccattcgggcgagtgcataactctggataaagtgtgtaatatggccagggactgtagagattggagcgatgaacccatcaaggagtgcggaaccaatgagtgcctggacaacaacggtggatgctcgcatgtgtgtaatgacctgaagatcggttacgaatgcctgtgccctgatggcttccagttggtcgctcagaggcgctgcgaggacatcgacgaatgccaagatccggacacctgtagccagctgtgcgtcaatctagaaggcggctacaaatgccagtgcgaggagggattccaattggaccctcatacgaaagcctgtaaagctgtgggcagcatcgcctacctatttttcaccaatcgacacgaggtgcgcaagatgaccctggataggagtgagtacaccagtctgattccaaatctgcgaaatgtagtggccctcgacacagaggtcgccagtaaccgcatctactggtcggatctctcccagcgcatgatttgctccactcagttagatcgagcccacggcgtgtcgagctacgatactgttatcagccgtgacattcaagccccggacggcttggccgttgactggattcattccaatatctattggaccgattccgtactgggtaccgtctcggttgccgatacaaagggcgttaaacgcaagacgctcttccgggagaatggtagcaagcccagggcgatcgtcgtggatccagtccatggttttatgtactggactgattggggcacacccgccaagattaaaaagggcggacttaatggcgttgacatctattcgttggtgacggagaatattcagtggcccaacggcataactctggacctgttgtccggccgtctctattgggtggatagtaagctccattccatctcctccattgatgtgaatggcggcaacagaaagacaatcctagaggacgagaagcggctagcgcatcccttcagcctggccgtgttcgaggataaggttttctggacggatatcataaatgaggctatcttttccgccaatcggcttacgggctcggatgtcaacctcctggcggagaatctgctgtcccccgaagacatggttctgtttcacaatctgacccaaccgcgcggagtcaactggtgtgagcgaacaacccttagtaatggcggctgccaatacctgtgtcttccggccccccagattaacccacactcgccaaagttcacgtgcgcatgccccgatggaatgctgcttgctagagacatgcggagctgtctaacggaggccgaggcggcggtggccactcaagagacatcgacggttcgactgaaggtatcctccacggctgtgcgtacccaacacacgactacacgcccggtccctgacacatcgcgactgcccggtgccacaccgggccttaccacagttgaaatcgtgacgatgtcccatcaggcactcggagacgtcgccggtcgtggaaacgagaagaagccgagctcggtgcgcgcccttagtatcgtgctcccgattgtcctcctcgtgttcctgtgtctgggcgtgttcctactttggaagaattggcgactgaagaacatcaacagcattaatttcgacaatccagtttatcagaagaccaccgaggacgaagttcacatctgccataatcaggacggctactcctaccccagccggcaaatggtgagcctggaggatgacgtcgcg

SEQ ID NO: 175 - DNA, 2580 bp, Artificial Sequence
  Description of Artificial Sequence: Synthetic Transcript Sequence
atgggaccctggggatggaagctccggtggactgtggcacttctgcttgccgcagcgggaactgcagtgggcgatcggtgtgaacgcaacgaatttcagtgtcaggatggaaagtgcatctcctacaaatgggtctgtgatggaagcgcagaatgtcaagatggatcagatgagtcgcaggaaacctgtctgtcggtcacttgtaagtctggcgacttctcctgcggtggacgtgtcaatcgctgcatcccacaattttggagatgtgatggccaagtggattgtgataatgggtcggacgagcagggatgcccgccaaagacctgtagccaggacgaatttagatgtcatgatgggaaatgtatatcgcgccaatttgtgtgtgactccgatcgagactgcctggatggctcggatgaagcctcgtgcccagttcttacctgcggtcctgcatcatttcaatgtaactcgagcacctgtatacctcaactttgggcatgtgataatgaccccgactgtgaagatgggagcgatgagtggccccaaagatgccgcggactctacgtgttccaaggagactcatccccttgttcagcgtttgaatttcattgtctttcaggtgaatgtattcattccagctggaggtgtgatggaggacccgattgcaaggataagtcggatgaagaaaactgcgcggtagcaacctgcagaccagatgaatttcagtgctccgacggaaattgcatacacggatcgagacaatgtgatagagaatacgattgtaaggatatgtccgacgaggtcggttgtgtgaacgtgactttgtgtgagggacctaacaagtttaagtgccactcaggggagtgtatcactctggataaagtttgtaacatggccagagattgtagagattggtcggatgagcctatcaaggaatgtgggactaacgaatgtctggataacaacggcggttgctctcacgtgtgcaacgatcttaagattggctacgaatgtctttgccctgatggattccaactcgtggcacaacgtcgctgtgaggatattgatgaatgtcaggatcccgacacctgcagtcagctgtgtgtcaacttggaaggcggctacaagtgtcaatgtgaagaaggattccaattggatcctcacactaaagcatgtaaggcagtgggttcgattgcgtacctcttcttcactaatcgccatgaggtgaggaagatgactctcgacaggtccgagtacaccagcctcatccctaacctgcggaatgtggtggcgctcgatacggaggtcgcgtccaaccgcatctactggagcgatctgagccagcgcatgatttgttctacccaattggatcgcgcacatggcgtgtcctcgtacgatactgttatttcgcgggatatccaggcacctgatggtcttgctgtggactggattcacagcaatatctactggactgacagcgtcttgggcaccgtgtcagtggcggataccaagggtgtcaagagaaagaccctgtttcgagagaacggttccaaacctcgtgcaatcgtcgtggacccagtgcacggctttatgtattggactgattggggaactcccgcaaagatcaaaaagggcgggctgaatggtgtggatatctatagcttggtgaccgagaatattcaatggccaaacggtatcactctcgacctgcttagcggacggctttactgggtggattcgaaactgcactccatttcgtccatcgacgtcaacggaggcaatcggaaaaccatcctggaagatgaaaagcgactggcacatccattctctctggcagtgtttgaagataaggtcttttggactgacataatcaatgaagcgatcttcagcgccaaccgcctcactggttccgatgtcaacttgctggcagaaaatctgctgtcccctgaggacatggttctgtttcataacttgacccaacctagaggtgtcaactggtgcgagcgtacgaccctgtcaaatggcgggtgccaatatctttgtctgccagcgcctcagatcaaccctcattcaccaaagtttacctgtgcctgtcctgacggtatgcttttggctcgcgacatgagatcatgcctgacggaagcagaggcagccgtggcaacgcaagaaacctcaactgtgagactgaaagtgtcatcgactgccgtgcggacccaacatactaccacgcgacctgtgcccgatacttcaaggcttcctggtgcaaccccaggtcttaccaccgtggaaatagtgaccatgtcgcatcaagcacttggagatgttgcaggacgaggaaatgagaagaagccttcttcggtgcgcgcactgtcgatagtgcttcctatcgtcctgcttgtgtttctctgcctcggtgtctttctgctgtggaagaactggagactcaagaacattaactccatcaacttcgacaaccctgtctaccaaaagaccactgaagatgaagtccatatttgccataaccaggatggttacagctaccccagccggcagatggtgtccctcgaagatgatgtggca

SEQ ID NO: 176 - DNA, 2580 bp, Artificial Sequence
  Description of Artificial Sequence: Synthetic Transcript Sequence
atgggcccttgggggtggaaacttcgatggaccgtggccctgttgttagccgcagccggaactgccgtgggagacaggtgcgagcgaaacgagttccaatgtcaggacgggaagtgtatcagctacaagtgggtgtgtgatggtagtgcagaatgtcaggacggatcagacgagtcccaggagacctgcctgtcggttacgtgcaaaagtggggacttttcctgcgggggtcgggtaaaccggtgtataccacagttctggaggtgtgacggccaggtcgattgcgacaatggttctgacgagcaagggtgtccacccaaaacttgtagtcaggatgagttcagatgtcacgacggaaaatgcatctcccgtcaatttgtgtgtgattccgatcgagattgtctggacggcagcgatgaggccagctgtcctgttctgacctgcgggcccgccagcttccagtgtaacagtagcacttgtatcccccagctgtgggcatgtgataatgatcctgactgtgaggacggatctgacgagtggcctcagagatgccgaggtctctatgtatttcaaggcgattcctcaccatgttccgcctttgaatttcattgtttgtctggtgagtgtattcacagctcatggcgatgcgacggcgggcccgattgtaaggataagagcgatgaggagaactgtgctgtcgctacttgtcgacccgacgaattccagtgctccgatggcaactgcatccacggaagccggcagtgcgaccgcgagtacgattgtaaggacatgtcagatgaggtcgggtgcgtaaatgtgacactgtgtgagggcccaaacaaatttaagtgccactcgggagagtgtattacactggataaggtttgtaatatggcacgggactgtcgtgattggtcagatgagcctataaaggagtgcggcaccaacgaatgtttggataacaatgggggctgcagtcacgtgtgcaatgacctgaaaataggctatgaatgcctttgtccggatggattccagctggtggcccagaggagatgtgaagacatagatgagtgccaggatccggacacttgctcacagctgtgcgtaaacctggagggcggctacaaatgtcagtgcgaggaaggattccagctagaccctcataccaaagcttgcaaggctgtcggatccatcgcttatttgttcttcacaaaccgtcatgaggtgcgaaagatgacgttggaccgctcagagtatacctcccttatccctaacttacggaacgtggtggcgcttgacacagaggtggcctccaacagaatttactggtctgatctgagtcagcgaatgatttgttctacccagcttgaccgagcacatggggtcagctcctatgataccgtgatctcgagagatatacaggctccagacgggctagctgtggattggatccacagcaacatctactggaccgacagtgtcctgggaaccgtatctgtggccgatacaaagggcgtcaagcggaaaacactgtttagggagaacgggtctaaacctagggctatcgtggtcgatccagttcacggattcatgtattggaccgactggggaacccccgctaaaattaagaagggggggctgaatggggtcgacatctatagcttggtcacagagaatatccaatggcccaacggcatcaccctcgacctactctccggaagactgtactgggtggacagtaaactgcattccatttctagcatcgatgttaatggaggtaaccggaagacaatcctggaagacgaaaagagacttgctcatccgttttctctggctgtattcgaggataaagtgttttggacagatatcattaatgaagcgattttcagtgctaatagattaacaggcagcgacgtcaaccttctagctgaaaatctcctctcaccagaggacatggtgctatttcacaacctcacacagcccagaggagtgaattggtgcgaacgaactaccctgagtaacggaggctgtcagtacctgtgcctgccagcgccacagattaatccgcactcccctaagttcacatgcgcttgtccagatggcatgctgcttgcccgggatatgaggtcttgcctaacagaagctgaggcggctgtggccacccaggagacgagtacggtaagactaaaagtcagctcaacggccgtgagaactcaacataccacaacccgccccgtgcccgacacatccagactcccgggcgccacccccgggttaaccacagttgaaatcgtgactatgtcccatcaggccctcggagacgtggccggcagaggcaacgagaagaagcccagttctgtaagggctctatctatcgtcttaccaatcgttcttctcgtgtttctgtgccttggcgtcttcctgctgtggaagaattggcgcctaaaaaacatcaatagtatcaattttgacaaccctgtttaccaaaagaccaccgaagacgaagtgcatatttgccacaaccaggatggctattcctatccgagtcggcagatggttagcctggaggatgatgtagca

SEQ ID NO: 177 - DNA, 2580 bp, Artificial Sequence
  Description of Artificial Sequence: Synthetic Transcript Sequence
atgggaccatggggttggaaacttcgttggacggtggcacttcttcttgcagcagcaggaaccgctgtcggcgatcgctgcgaacgaaatgaatttcagtgccaagatgggaagtgcatctcctacaagtgggtgtgtgatggttccgcagaatgtcaagatggaagcgatgaaagccaagaaacctgcctttcggtgacctgcaaaagtggggatttcagctgtggcggaagagtgaatagatgtatcccccagttttggcggtgtgatggtcaagtggattgtgataacggatctgacgagcaaggttgtcctcccaagacttgctcacaggatgagttccggtgtcacgacggtaagtgtatctcacggcagttcgtctgcgattccgatagagactgccttgatggatcagatgaagcctcgtgtccagtgcttacttgtggaccagcatcctttcagtgcaactcatcgacctgcatcccccagttgtgggcatgcgataatgatcccgactgtgaagatggatccgatgaatggccacaaagatgccgcggactttacgtgtttcaaggagacagctcgccatgttcagcgtttgaatttcactgtcttagcggggagtgtattcattcctcgtggaggtgtgacggtggacctgattgtaaagacaagtccgacgaggagaactgcgcggtggccacctgccgtcctgatgagtttcagtgctcggatgggaactgtattcatggatcgagacaatgcgacagagaatacgattgtaaggacatgtcagacgaagttggttgtgtgaacgtgaccctctgtgaaggtcctaacaaattcaagtgtcatagcggtgaatgtataacccttgataaggtctgtaacatggcaagagattgtcgagactggtcagatgagcctatcaaagaatgtggaactaatgaatgtctggacaacaatggcggatgcagccacgtgtgtaacgatctgaaaattggatacgagtgtctttgtcctgacggattccaattggtcgcgcaacggcgctgcgaggacatcgatgagtgtcaggacccagacacctgctcacagttgtgcgtcaatcttgagggaggttacaagtgtcaatgtgaggagggattccagcttgacccgcatactaaggcatgcaaggcggtgggttctatagcatacttgttctttactaaccggcacgaagtgcgcaagatgacccttgaccgcagcgagtacacctccctcattccaaaccttagaaacgtggtggcacttgacactgaggtggcctcgaatcgcatttactggtcggacctgtcgcaacgtatgatctgttcgacccagctggatagagcacatggagtgagctcgtacgatactgtgatttcccgggatattcaagcaccagatggacttgccgtggactggattcattccaatatctactggacggattcggtccttggtactgtgtccgtggcggacacgaagggcgtgaagcgaaagaccctgttccgcgaaaatggttccaaaccacgcgcaattgtggtggatcctgtgcacgggtttatgtactggactgactggggtacccctgcaaaaatcaaaaagggaggactgaatggtgtggacatatactccctcgtcactgagaatatccaatggccaaacggcattactctggatcttctgtcggggcggctttattgggtggacagcaaactgcactctatctcatcaattgacgtcaacggcggaaaccgcaagaccattcttgaggacgagaagcgtcttgcccatcccttttcactggccgtctttgaggataaggtgttctggaccgacatcatcaacgaagcaatcttttcggcgaatcggctgaccggttccgatgtgaatctcctggcagaaaacctgctttccccagaagatatggtcctgtttcataatctgactcagccgaggggtgtcaattggtgtgagcgcacgaccctgtccaacggtggctgtcaatacctttgcttgccagcacctcagatcaaccctcacagccctaaattcacctgtgcctgtcctgatggtatgcttttggctagagatatgcgatcctgcctgaccgaggcagaagcagcggtggcaacgcaggagacttcgaccgtgaggctgaaagtgtcctcgaccgcagtgagaacccaacatacgactaccaggccagtgcctgacacttcacggctgccaggggcaacccctgggttgactacggtggagattgtgactatgagccatcaagccctgggggatgtggcaggccggggtaacgaaaagaagccatcgtccgtgcgcgcccttagcattgttctgcctatcgtcttgttggtctttctttgcctgggtgtgtttctgctgtggaaaaactggaggctgaagaatatcaactcgattaactttgacaatcctgtgtaccagaaaaccactgaagatgaagtccatatttgtcacaaccaagacggatactcctacccatcgaggcagatggtgtccctggaggacgatgtggca

SEQ ID NO: 178 - DNA, 2580 bp, Artificial Sequence
  Description of Artificial Sequence: Synthetic Transcript Sequence
atggggccctggggttggaaacttcgttggaccgtcgcacttctgcttgcagccgcaggaaccgcggtcggtgacagatgtgaaaggaatgagtttcaatgtcaagacggaaagtgtatttcatacaagtgggtgtgtgatggtagcgcagaatgtcaggatgggtcagacgagtcgcaggaaacgtgtctgagcgtgacgtgtaaatccggtgatttttcgtgtggaggccgtgtgaaccggtgtattccacaattttggaggtgcgatggtcaggtggattgtgataacggatccgatgagcaaggttgtcctccgaaaacgtgctcccaagacgaattccgttgtcacgacggtaagtgcattagccgccaatttgtgtgtgattcggatcgtgattgtcttgatggtagcgacgaggcaagctgccctgtccttacttgtggtcctgcctcctttcaatgcaactcttcgacctgcatccctcagctttgggcatgcgacaatgatccagattgcgaggatggttccgacgagtggcctcaacgctgtagagggctttacgtgtttcaaggagacagctcgccttgtagcgcgtttgagtttcactgcctttccggcgaatgcattcactcatcctggagatgtgatggcggaccggattgtaaggataaaagcgatgaagagaattgtgctgttgctacttgtcggccggacgaatttcaatgtagcgatggtaattgtattcatggatctcgccagtgcgatagggaatacgactgtaaggacatgagcgacgaggtgggttgtgtgaatgtcaccctctgtgagggacctaacaagttcaaatgtcattcgggagagtgcattactctcgataaagtctgtaatatggcaagagactgtcgcgactggagcgatgagcccatcaaggagtgtgggactaatgagtgtcttgataacaatggcgggtgctcccacgtgtgtaacgatctgaagataggctacgagtgtctttgcccggacggatttcagcttgtggcccaaagacggtgtgaggacattgatgagtgccaggatccagatacctgctctcagctttgtgtgaacctcgagggcgggtacaaatgccaatgcgaggaaggttttcaattggatccacacactaaggcatgtaaggccgtcggtagcatagcttacttgttctttacgaacagacacgaggtccgtaagatgacccttgatagaagcgaatacacctccctgattcctaatctgcgtaatgtggtcgctctggacactgaagtggcgtcgaataggatttactggtccgatctctcgcagcgcatgatctgttcaacccagttggatcgagctcatggggtcagctcgtacgatactgtcatttcaagagatatacaggcacctgatggactcgcagtggattggattcattcaaacatctactggactgatagcgtcttgggtactgtgtccgtggcagataccaagggagtgaagagaaagaccctttttagagaaaacggttccaagccacgagcaattgtggtcgaccccgtccatgggtttatgtactggaccgattggggtaccccggccaagattaagaagggcggactcaatggagtggatatctactccctggtgactgaaaacattcagtggcccaatggtattacccttgacctgctgtcaggcagactctactgggtggacagcaaactgcattcaatatcgtcaatcgacgtgaacggcggaaatcggaaaaccatactggaagatgaaaaaaggcttgcgcacccattttcgcttgcggtgtttgaagataaagtgttttggactgacattatcaatgaggcaatcttttcagcgaacaggctcaccggatcggatgtcaatctgctcgcagagaatctcctctcgccggaagatatggtgcttttccataacctgacccaacccagaggggttaactggtgtgaaaggaccactctgtcaaacggcggatgtcaatacctttgcctgcctgcgccacagataaacccccactcgccaaagtttacctgtgcctgtcctgatgggatgctgctggcgcgggatatgcgatcgtgcctgactgaagcggaggcagcagtggcaactcaggaaacctcaaccgtgagactgaaagtctcctccactgcagttcgcacccagcataccaccacccgccccgtcccagataccagtagactgccaggagcaactcctggtcttactaccgtcgagatagtcaccatgtcacatcaagcactgggagatgtggcaggcagagggaacgaaaagaagccttcgtccgtgcgagcactctcgattgtgctgcctattgtgttgcttgttttcctttgccttggtgtctttcttctttggaagaactggaggttgaagaacataaacagcattaacttcgacaacccagtctaccagaaaacgacggaagatgaggtccatatctgccataaccaggatggttactcgtacccatcgcgccagatggtgtcgctggaagatgatgtcgcg

SEQ ID NO: 179 - DNA, 2580 bp, Artificial Sequence
  Description of Artificial Sequence: Synthetic Transcript Sequence
atgggcccttggggttggaaactccggtggactgtggctttgttgctggcggcggccgggaccgccgtgggagacaggtgcgaacgcaacgagttccagtgtcaagatggaaaatgcatctcatacaagtgggtgtgcgacggatcggctgaatgtcaggacggctcggatgaatcccaagaaacttgcctgtcggtcacgtgcaagtcaggtgacttctcctgtggcggaagggtaaaccgctgtatcccccagttctggcgctgcgatggccaggtggattgtgataacggatcggacgagcaaggatgcccgccgaaaacctgttcacaagacgaattccggtgtcacgacggaaagtgcattagtcggcagttcgtgtgcgactcggatcgcgactgtctggatggatccgatgaagcatcgtgcccggtgctcacttgcgggccggcgtcctttcaatgcaactcatctacctgcatccctcagttgtgggcctgcgacaatgacccagactgcgaggatggctccgacgagtggccccagcggtgccgcggcctgtacgtattccagggagatagctcaccatgctcagcctttgaattccactgtctgagcggtgagtgcatccacagcagctggcggtgcgacggtggaccagactgcaaggacaagtcggacgaggaaaactgcgccgtggcgacctgccgcccggatgaatttcagtgctcggacggaaactgcatacatggatcgcgccaatgcgacagggaatacgattgcaaagacatgagcgacgaagtggggtgcgtgaatgtcactctgtgcgagggcccaaataaattcaagtgtcatagcggcgaatgtatcactcttgacaaggtctgtaatatggcccgcgactgccgagactggtctgatgaaccaatcaaagaatgcggaactaatgaatgccttgacaacaatggaggctgttcccacgtgtgcaacgatctgaagatcggatacgaatgcctgtgcccggacgggttccaactcgtggcacagagaaggtgcgaagatattgacgagtgtcaggaccccgacacctgctcacaactttgcgtgaacctcgaaggaggatacaagtgccagtgtgaggaggggtttcaacttgacccacacaccaaggcctgtaaggcggtgggaagcatcgcatacctgttcttcaccaaccggcacgaggtgcggaaaatgaccctggatcgctcggaatatacctcgctgatcccgaacctgagaaacgtcgtcgccctggacaccgaagtcgcttcgaacaggatctactggtccgatctgtcgcagcggatgatctgttcaacccagctcgaccgcgcgcatggtgtgtcgtcctacgatacggtcatctcgagagacatccaagctccggatggcctcgctgtggactggattcacagcaacatctactggaccgacagcgtcctgggaaccgtcagcgttgcagacaccaagggcgtgaaacgtaagaccctcttcagagaaaatggctccaagcctcgggccatcgtggtggacccggtccacggattcatgtactggactgactgggggacccctgccaagatcaagaaaggaggactgaacggggtggacatctacagcctggtgactgagaacattcagtggcctaatggcatcacgctggatctgctgagtgggcgcctgtactgggtggactcgaagctgcactcaatttccagcatcgacgtgaacggtggcaatagaaagactatcctggaggatgaaaagagactggcgcacccgttctcgctcgccgtctttgaggataaagtgttttggactgatatcatcaatgaagcaatcttctcagctaaccgcctgactggaagcgatgtgaatctcctcgcagaaaacctgctgtccccggaggacatggtgctcttccataatctgactcagccaagaggcgtgaactggtgcgagcgaactacgctttcgaacggcggatgccagtacctttgcctcccggcacctcaaattaatccgcattccccaaagttcacttgcgcgtgcccggatggtatgctcttggccagggatatgcggtcgtgtttgacggaagcagaggccgccgtcgccacccaggagacttcaactgtccggctgaaagtgtcctcaaccgcagttcgcacccaacataccacgacccgccccgtgcctgacacctcccgcctcccaggagcgactcccggactcaccactgtcgaaatcgttactatgagccatcaggccctgggagatgttgcggggagaggaaacgagaagaagccatcaagcgtgcgggccttgtccattgtcttgccgatcgtcctgctggtgttcctttgcctgggtgtgttcctgctctggaagaattggagactcaagaacatcaactccatcaactttgacaatcctgtgtaccaaaagaccactgaggatgaagtccatatctgccacaaccaggatggatattcttacccgtcccggcagatggtgtccctcgaggatgacgtggct

SEQ ID NO: 180 - DNA, 2580 bp, Artificial Sequence
  Description of Artificial Sequence: Synthetic Transcript Sequence
atgggaccctggggctggaagttgagatggacagtggccctcctgctcgcagccgcgggcacagccgtgggcgacaggtgcgagagaaacgagttccagtgccaggacggtaagtgcatctcttataagtgggtctgcgatggtagcgccgagtgccaggacggttctgacgaaagtcaggaaacatgcctgagcgtcacatgcaagagcggtgacttttcctgcggaggtagagtgaataggtgcatcccccaattctggcgctgcgacggacaggtggactgtgacaacggtagcgatgagcagggttgccccccaaaaacgtgctctcaagacgagttccgctgtcatgacggtaagtgcatctctaggcaatttgtttgtgacagtgacagggactgtctggatggaagcgacgaagcttcatgtcctgtactgacgtgcggtcctgcctctttccagtgtaactcctcaacctgtatcccacagctgtgggcgtgtgataacgatccagattgcgaggacggatccgacgagtggccacaaaggtgtcgcggactgtatgtttttcagggagacagttccccctgttccgctttcgaattccactgcctgtctggtgagtgcattcattcttcttggcgctgtgacggaggtccagattgcaaggataagtcagacgaagagaactgtgcggttgcgacatgcagacctgacgagttccaatgtagcgatggaaactgcattcatggtagcagacagtgcgaccgcgagtacgattgcaaggacatgtccgacgaagtaggctgtgttaacgtgactctttgtgagggacctaataaattcaaatgccacagcggagagtgcattaccttggataaggtgtgcaatatggctagagactgccgcgattggtcagatgaacccatcaaggagtgcggcactaacgagtgcctggataataacggtggctgttcccatgtgtgcaacgaccttaagattggatatgagtgtctgtgccccgatggttttcagttggtcgctcagaggaggtgtgaagatatcgatgaatgtcaagatccagatacatgttcacaactttgcgttaacctggaaggaggttataagtgccaatgcgaggagggttttcagcttgatccccacacgaaggcctgcaaggccgtgggctccatagcgtacttgttctttacgaaccgccatgaggtgcgcaagatgactttggatcgcagtgagtacacaagcctgattcccaacttgagaaacgttgtcgccttggacacagaggttgcctcaaatcgcatctattggtctgacctgtctcagaggatgatctgctcaacccaactcgaccgcgcacacggcgtgagctcctacgatactgtgatttcaagggatatccaggcccctgacggcttggctgtagactggatccacagcaatatttattggactgattcagtgctgggcaccgtgagcgtcgccgacacgaaaggtgtgaagcgcaaaacactgtttagagaaaatggctcaaagccccgcgctatcgtcgtggaccctgtacatggttttatgtattggaccgattggggcacacctgccaaaatcaaaaagggcggactgaacggcgtggatatttactccctggtgacagagaacatccagtggcctaacggtattacattggacctgcttagtggccgcctctactgggtcgattcaaagctgcacagtatctcctccattgacgtaaacggtggcaatagaaagacgatcttggaggatgagaagaggcttgcacaccccttctcactggctgttttcgaggacaaagtcttttggaccgacattattaatgaggcaattttcagcgccaatagacttaccggtagcgacgtgaatttgctggccgagaacttgcttagccccgaggacatggttttgttccataacctcacacagcccaggggtgtaaactggtgtgagagaactaccctgagcaacggcggttgccagtacctttgccttcctgcgccacaaattaatccgcattccccaaagtttacctgcgcctgccccgacggtatgttgctcgccagagacatgcgctcatgcctcactgaagcagaggctgccgttgccacacaggaaacctctactgtaagattgaaggtctctagcactgctgtcaggacccagcacacgactacccgccctgtgcctgatacctccaggctgcctggcgccaccccaggcctgacgaccgtggaaatcgtgactatgagccatcaggccttgggcgatgttgccggtcgcggtaatgagaaaaaaccatcctccgtgcgcgccctgagcatcgtgctgcccattgtgctcttggtcttcctgtgtctcggagtgttcctgctctggaagaactggcgccttaaaaatatcaacagcattaacttcgataacccagtctaccagaaaactacagaggacgaggtgcacatctgccacaatcaggacggctactcttacccttcccgccagatggtaagtctggaagacgacgtcgct

SEQ ID NO: 181 - DNA, 2580 bp, Artificial Sequence
  Description of Artificial Sequence: Synthetic Transcript Sequence
atggggccgtgggggtggaaattacggtggactgtggcacttttgctcgctgctgccggcacagcagtgggcgacagatgtgagcgcaatgagtttcaatgtcaggatgggaaatgtatcagttataagtgggtctgtgatggaagtgcggaatgccaggacgggagcgacgaatcacaggaaacgtgtctgagtgtgacatgcaagtcaggtgacttcagctgtggcggaagagtgaatagatgcattcctcagttctggcgatgtgatggccaggtggattgcgacaatggatctgatgagcagggctgtccgcctaagacctgtagccaggatgagttccggtgccacgatggcaaatgtatctcacgacagtttgtttgcgactccgatagagactgcctggatggcagtgacgaagctagttgccctgtgctcacttgcggaccggccagtttccagtgcaactcctcaacatgcataccgcaactttgggcttgcgataacgatcccgattgtgaggatgggtcagatgaatggccacagcgatgccggggactctacgtatttcagggagactcatcgccctgttccgccttcgagttccattgcttgtcaggggagtgcattcattccagttggcgctgcgacggaggacccgactgcaaggacaaaagtgacgaagagaattgtgcggtggctacttgccgccctgacgaattccagtgttctgacggcaactgtatccacgggtctaggcaatgcgacagggaatatgattgtaaagacatgtctgacgaagtgggctgcgttaatgtcactctgtgtgagggacccaacaagtttaagtgccacagtggggagtgtatcacattagacaaagtatgcaacatggcccgagattgcagagattggagcgacgaacctataaaggagtgtggaacgaatgaatgcctggacaataacggcggctgcagtcacgtgtgcaacgatctcaagatcggttatgagtgtctgtgtccagatggatttcagcttgtagcacagcgtcgatgtgaagatatcgatgagtgccaggatcctgacacatgttcccaactgtgcgtgaatcttgaaggagggtacaagtgccagtgcgaagaaggctttcagttggatccccacactaaggcctgcaaggccgtgggctccatagcgtacctgtttttcacaaatcgccacgaggtgagaaagatgaccctcgacagatcagagtacactagcctaatccccaacttgaggaatgtggtggctctggacactgaagtggcctccaaccgcatttattggagtgatttatctcagcggatgatttgtagcactcagctggatcgagcacacggtgtgtcaagctatgatactgttattagcagggacattcaggcgcctgacggtctggcagtggattggatacattctaacatttactggaccgactccgttctagggactgtctccgttgcagataccaaaggtgtcaagcggaagaccctgttcagagagaatggctcgaaacctcgcgccattgtcgtcgatcccgtacacggcttcatgtattggactgattgggggactccagctaaaataaagaaaggtggactgaatggggtggacatctactctttggtaactgaaaacatacagtggcccaacgggataactctggacctgctgtcgggacggctgtattgggtcgatagtaaactccactctatcagctccatcgatgtgaatgggggtaatagaaagaccatcctggaggatgaaaagcgcttggctcacccgttttccttagcggtgttcgaagacaaggttttttggacagatattatcaatgaagccatattctctgctaataggttgaccggttccgacgtcaatttactggctgagaatctgctgagtccggaggacatggtgctgtttcacaaccttacccagcctcggggggtgaactggtgcgagaggaccacactctcaaacggtgggtgccagtacctttgcctccccgctccccagatcaacccccattcccctaagtttacctgcgcctgtcctgatggaatgctactggcccgggacatgaggagttgccttaccgaggccgaggcggccgtcgccacccaagagactagcaccgtccgtctgaaggtaagttccactgccgtgagaacccagcacactacaaccagacccgtgccagatacaagtcggctgcctggagctacgccaggactgacaaccgttgaaatcgttactatgagccaccaggccctgggggatgtagccgggagaggcaatgagaagaaaccttcttctgttagggctttgagcattgtactgcctatcgtgcttctcgtctttctgtgcctcggggtctttcttctgtggaaaaattggcgattgaaaaatatcaattccattaatttcgacaatccggtgtaccagaagaccactgaggacgaagtgcacatttgtcacaatcaagatggctactcctacccatcccgccagatggtgtctttggaggacgacgttgca

SEQ ID NO: 182 - DNA, 2580 bp, Artificial Sequence
  Description of Artificial Sequence: Synthetic Transcript Sequence
atgggcccttgggggtggaagctccgttggaccgtcgcattgttgctggcagccgcaggcactgcagtcggagacagatgtgagcggaacgagtttcagtgtcaagacggtaagtgcatttcatacaagtgggtgtgtgacggatcggctgaatgccaagacggaagcgatgaatcacaggaaacctgtctctcggtgacctgcaagtcgggcgactttagctgcggcgggcgagtgaatagatgtatcccacagttctggaggtgtgacggacaggttgactgtgataatggaagcgatgagcagggttgtcctcctaaaacctgttcacaggatgaattcaggtgtcatgatggcaaatgcatctcccgccaattcgtgtgtgactcggatcgcgattgcctcgatggatcagatgaagcatcatgtcctgtgcttacttgcggacctgcgtcgtttcagtgtaactcaagcacttgtatcccacaactttgggcctgtgacaatgaccccgattgcgaagatggcagcgatgaatggccccagaggtgtaggggtttgtacgtgtttcagggagattcttccccatgttcagcctttgaattccattgcctgtccggcgaatgtatacatagttcctggcggtgtgatggtggacctgactgtaaggataagtcggatgaggaaaactgtgcagtggccacttgtcgaccagatgaatttcagtgttcagatggtaactgtatccatgggtcgcgccaatgcgatcgcgagtacgattgtaaagatatgtccgatgaagttgggtgcgtgaacgtaaccctctgtgagggacctaataagtttaagtgtcatagcggcgagtgcattaccttggataaagtgtgtaacatggcaagagactgtcgtgattggtcggacgaacccattaaggaatgcggaaccaacgagtgtctggataacaacggaggatgcagccatgtgtgcaatgacctgaagatcggctacgagtgcctgtgtcctgatgggttccaactggtcgcgcaacgcagatgcgaggacatagacgagtgtcaagaccctgacacttgttcacagttgtgtgtgaacctcgaaggaggatataagtgccagtgcgaggaagggtttcaacttgatccgcatactaaagcgtgtaaggcagtgggatcaattgcatacctgttctttaccaatcgtcacgaagtgcgaaaaatgacgctcgatcggtccgaatacactagcctgattccgaacctgagaaatgtcgtcgcactcgatactgaggtcgcatcgaaccggatttactggtcggatctgtcacaaaggatgatctgttcgactcaacttgaccgagcacacggtgtctcttcgtacgacaccgtcatttcccgtgatattcaagcacctgatgggctcgcggtggattggattcatagtaacatatactggactgatagcgtccttggcactgtgagcgtggcagataccaaaggcgtgaagcggaaaactctgttccgcgaaaatggatcgaagcctcgagccatcgtcgtcgaccccgtgcatgggtttatgtactggaccgactggggaaccccagccaagattaagaaaggtggtcttaacggcgtcgacatctactctctcgtgactgagaatattcaatggccaaatggtattacgcttgatctgctgtccggacgcctctactgggtggattccaagctgcattccatttcatcaatcgacgtgaacggggggaatcgaaagaccatcctggaggacgaaaagcgactggcgcaccctttttcgctcgcagtattcgaagataaggtgttctggacggacattatcaacgaggcaatcttttcggccaatcgactcaccggaagcgatgtcaatctgctcgctgaaaaccttctttcgcctgaagatatggtgctgtttcacaacctcacgcagcctagaggagtgaactggtgcgaaagaaccaccctctccaacggcggttgtcagtatctgtgtctgcccgccccccagattaatccacacagccctaagtttacctgtgcctgtcctgatggaatgctccttgcgagagatatgagatcctgtctgaccgaagcggaagcagccgtggcaacgcaagagacgtcgactgtgaggctgaaggtgtcgagcaccgcagtccgtacccagcacactaccacccgccctgtcccagacacctcgcgcctccctggtgctacccccgggcttaccactgtcgaaatagttactatgtcccatcaggctcttggggacgtggcaggacggggaaatgagaaaaaaccttcgtccgtgagagccctttcgattgtgctgcctattgtgttgctggtctttctgtgtctcggtgtctttctgctgtggaagaattggagactgaagaatatcaactccatcaacttcgacaaccccgtgtaccagaaaaccactgaggacgaggtgcatatttgtcataaccaagatggatactcatacccgtcgcggcaaatggtatcgcttgaagatgatgtggca

SEQ ID NO: 183 - DNA, 2580 bp, Artificial Sequence
  Description of Artificial Sequence: Synthetic Transcript Sequence
atgggcccctggggttggaagctgcgctggaccgtggcgttgcttctcgcggcggccggaaccgctgtgggcgaccgctgcgaaagaaacgaatttcagtgccaggatgggaagtgcatcagctacaaatgggtgtgcgacggaagcgcagagtgccaggacggttctgatgagtctcaggaaacttgcctcagtgtgacatgcaagtcaggcgacttctcctgcggcgggcgggtcaatcggtgtattccccagttttggaggtgtgacgggcaggtggactgtgataacgggtccgatgagcagggatgcccccctaagacctgtagtcaagatgagttccgttgccacgatgggaaatgcataagcagacaattcgtctgtgatagtgacagggattgtctggatggaagcgatgaggcttcctgtccggtcctgacgtgtggccctgccagcttccagtgcaatagttcaacttgtataccgcagctttgggcgtgcgataatgatcccgactgtgaggacggctctgacgaatggcctcaaaggtgcagaggcttgtatgtgttccagggtgattcaagcccctgctcagcgtttgaattccactgtctctctggtgaatgcatccatagctcatggcgctgcgacggaggacctgattgtaaagataagtccgacgaagagaactgcgctgtggccacctgtaggcctgatgaatttcaatgttccgacgggaactgtatccacgggtcccggcagtgcgatcgagagtacgactgcaaggacatgagcgatgaggtggggtgtgttaatgtgacactatgcgaaggtcctaacaagttcaaatgccactcgggggaatgtatcacactagacaaagtgtgcaatatggcccgagattgcagagattggtccgatgagccgataaaggagtgcgggacaaatgagtgtctggacaataacggaggctgttcccacgtgtgtaacgacctgaaaataggctatgagtgcctatgtccagacggatttcagttggttgcgcaacggcgatgtgaagacatagatgaatgccaagatcccgatacctgctcccagctgtgtgtgaatctggaaggcgggtataaatgtcagtgcgaggagggctttcagctggatcctcacacaaaagcctgcaaggcagtcggctctatcgcttatttgttctttactaatcggcatgaagtgaggaaaatgaccttggatcgttctgagtacacatcactgatccccaatttacggaatgtggtcgccctagataccgaggtcgcgagtaacagaatctactggtccgatctaagccaaagaatgatctgtagcacacaattggaccgagcccacggtgttagttcgtacgacacggtgatctcaagagatattcaggcgccggacgggctggccgtggactggatacattccaacatatattggaccgactccgtcctggggactgtctctgtggcagacacaaagggggtgaagaggaagacactctttcgcgaaaacgggtcaaagccacgggctatcgtggtggatcctgtgcatgggttcatgtactggacagattgggggacacccgccaagatcaagaagggcggcctgaatggtgtggatatttactctttggtgaccgaaaatattcagtggcccaacgggattacactggacctgttgagcggtcgcctctattgggtggattcgaaattgcactccatctccagcatagatgtcaatggcgggaaccggaaaactattttggaggacgaaaagcggctagcccaccccttttctctggccgtctttgaggacaaagtcttctggacggacatcatcaatgaggccatctttagcgccaataggcttaccggcagcgatgtcaatctgcttgccgagaatcttctgtcccccgaggacatggtgttattccacaacctaacccagccaagaggggtgaactggtgtgagcggaccacgctgagcaatggtggttgccaatacctgtgcctgcctgcaccacaaatcaacccacacagtcccaagttcacctgcgcttgtccggacggcatgctgttggcaagagacatgcggtcttgtctgacagaggccgaggccgccgtggccacccaggagacaagtacggttcggctgaaggtgtcctcaacagctgtgcgcacgcagcatacgaccacgagacccgtgccagatacgtcccgcctgcctggtgccacccccggcctcaccaccgtggaaatcgtcactatgagccatcaagctctcggcgatgtcgccggaagggggaatgagaagaaaccttcatctgtccgggccctctcaatcgtcctgcctatcgtgctgctcgtcttcctgtgtctcggagtgtttctcctctggaagaattggcggctgaagaacatcaatagcatcaacttcgataatccagtctaccagaaaacgacagaagatgaggtacacatctgtcataatcaggacggatattcatacccctcacgacagatggtgtctttagaagatgacgtggca

SEQ ID NO: 184 - DNA, 2580 bp, Artificial Sequence
  Description of Artificial Sequence: Synthetic Transcript Sequence
atgggtccttgggggtggaaactgaggtggactgtcgcactgcttctggcagccgcaggcactgcagtgggggacagatgtgaaagaaacgagtttcaatgtcaagatggaaagtgtatctcgtacaagtgggtgtgtgatggatcagctgagtgccaagacggttcggacgaatcgcaggaaacttgcctctccgtgacctgtaagtcaggcgatttttcgtgtggtggtcgtgtgaatcgctgcattcctcaattttggcggtgtgacggacaagtggattgtgataatggatcggatgagcagggatgtccacctaaaacttgctcgcaagacgaatttagatgtcacgacggtaagtgcattagcagacaatttgtgtgtgactcggatagggattgcctcgatggtagcgacgaagcaagctgccctgtgctcacctgcggccctgcctcatttcagtgtaactcctccacttgtataccacaactctgggcctgcgataacgatccagactgtgaggatggatcagatgaatggccacaaaggtgccgcggcttgtacgtgtttcaaggtgattcgtcaccctgttcagcatttgaatttcattgtctgtccggagaatgtattcatagcagctggcggtgcgatggaggaccggactgcaaggataagagcgacgaagagaactgtgcagtggcaacttgcaggccggacgaatttcaatgtagcgatggcaattgtatacatggttcgagacaatgtgatcgtgaatacgattgcaaggacatgagcgatgaagtgggatgtgtgaatgtgaccctttgtgaaggtcctaataagtttaagtgccattctggagagtgcattacgcttgataaggtttgtaacatggcccgggattgcagagactggagcgacgaacctattaaggaatgcggcaccaatgaatgcctcgacaataatggaggctgttcgcacgtgtgtaacgatctgaagattggttacgagtgtctttgtccggatggatttcagcttgtcgcacaacgcaggtgtgaagatatcgacgaatgtcaagacccagacacctgctcgcagctctgtgttaacctcgaaggtggctataagtgtcaatgtgaagaaggttttcagctggatcctcatactaaagcctgcaaggcagtggggtcgattgcttacctgtttttcactaatcggcatgaggtgcgcaagatgaccttggacagatcagaatacacttccctcattccaaaccttaggaatgtcgtcgccttggacacggaggtggcctccaaccggatttactggtccgatctctcgcagagaatgatctgctccacccaacttgatcgcgcccacggagtcagctcgtacgataccgtcatttcccgtgatatccaggcaccagacggtctggccgtcgattggattcactccaacatctactggaccgattcggtgctgggaactgtttccgtcgcggacactaagggtgtgaaaagaaagaccctttttcgggaaaatgggtccaagccccgcgcgattgtggtcgatccggtgcacggttttatgtactggactgattggggcacccctgcaaagattaagaaaggcgggctcaacggagtcgacatttactcgcttgtgaccgaaaacatacaatggcctaatggcattactcttgatctgctgtctggcagactttactgggtggactcaaaacttcactccattagcagcattgatgtcaatggaggaaaccgcaagactatcctggaggatgaaaagcgccttgcacatccattctcacttgcagtgttcgaagataaagtgttttggaccgacataatcaatgaagcgatattcagcgccaacaggctgaccggctcagatgttaatctgcttgcagaaaacctgcttagccctgaggatatggtgctctttcataaccttactcaacctcgaggtgtgaattggtgtgagagaaccactctttccaacggaggctgtcagtacctctgcttgcccgcaccacagattaacccgcatagccccaaattcacctgtgcgtgtcctgacggtatgcttctggcccgcgacatgcgctcctgcctcactgaagccgaagcagcagtggctacccaagaaaccagcaccgtgaggctgaaggtgtcgtcgactgcagtccgtacccaacacacgaccacgcgacctgtgccagataccagccgtttgcctggggcaacgccggggttgaccaccgtggagatagtgactatgtcccatcaggccctcggagatgtcgcaggaagaggaaacgagaaaaaaccttcaagcgtgagggccctctcaatagtgctgcctattgtgctgctggtgttcttgtgtcttggggtattcctgctttggaagaattggcggctcaagaacatcaactccataaactttgataatcctgtgtaccaaaagaccactgaagatgaggtccacatttgtcataaccaggatggctactcgtacccttccagacaaatggtgtcgctcgaagatgatgtggcg

SEQ ID NO: 185 - DNA, 2580 bp, Artificial Sequence
  Description of Artificial Sequence: Synthetic Transcript Sequence
atgggcccatggggatggaaattgagatggaccgtggctctgttgctggccgcggcgggaaccgccgtgggagacaggtgcgaacggaacgaattccagtgccaggatggaaaatgtatttcgtacaaatgggtctgtgacggctcggccgaatgtcaagacggctctgacgagagccaagagacttgcctgagcgttacctgtaagagcggagacttcagctgcggcggacgggtaaatcggtgcatcccgcagttctggcgatgcgacggccaggtcgattgtgataacggatcagatgaacaagggtgtccgcccaagacttgctcgcaggatgagttcaggtgccatgacggaaagtgcatttcgcgccagttcgtctgtgactccgaccgggactgtctcgatgggtccgacgaggcgtcatgccccgtcctgacttgtgggcccgcctccttccagtgcaacagctcaacctgcatcccccagctgtgggcctgtgacaacgatccggactgcgaggacgggagcgacgaatggcctcaacggtgccgcggactttacgtgttccaaggggatagcagtccatgctcggcgttcgagtttcactgcctgtctggtgaatgtatccactcgagctggcgctgcgatggaggaccggattgtaaggacaagtccgatgaagagaattgcgccgtcgctacctgtcgccccgacgaatttcagtgctccgacggaaactgtatccatggatcgcgtcagtgcgatcgggaatacgattgcaaggacatgagtgacgaggtgggatgtgtgaatgtgactctttgcgaaggcccaaacaagtttaagtgccactccggagaatgcatcaccctggataaggtctgcaatatggcgagagactgcagagactggtcggatgaacccatcaaggagtgcggaaccaacgagtgcctcgataacaatggcggatgttcccatgtgtgcaacgacctcaagattgggtacgagtgtttgtgccctgacggtttccagctcgtcgcacagagacggtgcgaggatatcgatgaatgccaagatcctgacacttgttcccaactctgcgtcaatctcgagggtggctacaaatgccaatgtgaagagggattccaactggaccctcatacgaaagcctgcaaggctgtgggaagcatcgcgtacctgttcttcacgaaccgccacgaagtgagaaaaatgaccctggaccggtccgaatacactagtctcatccccaatctgaggaacgtggtcgcgctcgacaccgaagtggcgtccaacaggatctactggtccgatttgagccagcggatgatctgctccacgcagctggacagggcgcacggcgtctcttcttacgacaccgtgatttcgagagacattcaggcccccgatggtcttgcggtggattggatccactcgaatatctactggactgactcggtgctcggtactgtgtcggtggcggatactaaaggagtgaagcgcaagactctttttagagagaatgggtccaaaccaagggccatcgtggtggatccggtccacggcttcatgtattggaccgattggggtaccccggccaagataaagaaggggggactgaacggtgtggacatttactccctggttaccgagaatatacagtggcccaacggaatcactcttgacctcctgtccggacgcctgtactgggtcgattcaaagctgcactccatctcgtccatcgatgtgaatggagggaaccgcaaaacgattttggaggacgaaaagcgcctggcccatcctttcagcctcgcggtgttcgaggacaaagtgttttggaccgacatcatcaacgaggccatcttctccgccaaccgccttactggttcggatgtcaatctcttggccgaaaacctgctctcacctgaagatatggtgttgttccacaacctgacccagcccaggggcgtcaattggtgcgaacgcaccactttgtctaatggagggtgccaatacctgtgcctcccggcaccgcagattaatccgcattctccaaagttcacctgcgcctgcccggatggtatgctgctggcccgggatatgagatcctgcctgaccgaggccgaggccgcagtggccacccaggagacgtcaaccgtgcggctcaaagtgtcgtcgaccgccgtccggactcaacatactacgaccagacctgtgcctgacaccagccgactgccgggcgctacgccaggactgactaccgtcgagatcgtgactatgtcgcaccaggcactgggcgacgtggccggccggggaaacgagaagaagccgtcctcggtgagagctctgtcaatcgtgctgcccatcgtgctcctcgtgtttctgtgcctgggcgtgttccttctctggaagaattggagactgaagaacatcaattcaatcaacttcgataacccagtctaccagaaaactactgaagatgaagtgcatatttgccacaaccaggacggctattcttacccgagcagacagatggtttccctggaagatgacgtcgcc

SEQ ID NO: 186 - DNA, 2580 bp, Artificial Sequence
  Description of Artificial Sequence: Synthetic Transcript Sequence
atgggcccttgggggtggaagctgagatggaccgtggccctgcttctagctgcagccggcacggcagtgggggatagatgcgagcggaacgaattccaatgtcaagatggaaaatgcatttcatacaagtgggtgtgtgatggaagcgcagagtgccaagacggctctgatgagtcccaggagacctgtctgtccgtgacctgcaaaagtggagacttctcatgcggtgggagggtgaatcgttgcattcctcagttttggcgctgtgacggccaggttgactgcgataatggctccgatgaacaagggtgccccccaaaaacctgcagccaggacgagttcagatgccacgacgggaagtgcatctcaagacaatttgtgtgcgactcagatagggattgtctggacgggagcgacgaggccagttgtccagtactgacatgtggtcccgcctcgttccaatgcaattcaagcacatgtattccgcagctttgggcctgtgataatgaccccgattgcgaagacggttctgacgaatggccacagcgttgccggggcctttacgtctttcagggcgactcctctccctgctcggcatttgagtttcattgcctatcaggtgaatgtattcattcctcatggagatgcgatggtgggcctgattgtaaagataaaagcgatgaggaaaactgtgcggtggcaacctgccgaccggacgagttccagtgtagcgatgggaattgcatacacggctccagacagtgtgaccgcgagtacgattgtaaggatatgagtgatgaagttgggtgcgtgaatgtgacactgtgcgaggggccaaataagtttaaatgtcattccggcgaatgtattacgctggataaagtttgtaatatggcccgggactgtcgggactggtcagatgagccgatcaaggaatgtggtactaacgagtgcctagacaataacgggggctgctcccacgtgtgtaacgacctgaagatcggctatgagtgcctatgtcccgatggctttcagttagtggcccagcgccggtgtgaagatattgatgagtgtcaggatcccgacacctgttcccaattatgtgttaaccttgagggaggatacaaatgccagtgtgaggaaggctttcagctcgatccccacacaaaggcatgtaaggcagtggggagtattgcatacttgtttttcaccaacagacatgaagtgcggaagatgaccctggatcgcagtgagtacacctctttaatccctaatctcagaaatgtagtggccctcgacactgaggtagccagtaaccgaatctattggagtgatctgagtcagaggatgatttgctccactcagttggatcgggcgcatggcgtctcgtcttacgacaccgtcatctctagagatatccaggcccccgacgggctggcagtggactggattcactcaaatatctactggaccgactctgtgctgggcacggtttcagttgccgacaccaagggtgtgaaaaggaaaaccctcttccgagaaaacggaagcaagccacgcgcaatcgtggttgatccggtacacgggttcatgtactggaccgattgggggactcccgcaaagattaagaagggtggtcttaacggagtagatatctattcactggtgaccgagaacatccagtggcccaatggcatcaccctggatctgctgtcaggtcgcctctactgggtggacagcaagctccattctatctcttccattgacgtcaacggcggcaatagaaagaccattttggaagacgagaaacgcctggcacaccccttctctctggcagtgttcgaagataaagtgttctggacagatatcattaatgaggccatcttctcggccaatcgcctaacagggagcgacgtgaatttgctggctgagaacttgttatctccggaagatatggtcctgttccataacttgacacagccacgtggggtaaactggtgcgagaggacaacactttccaatggtgggtgccagtacctgtgcctacccgccccacagatcaatccacattcccccaagtttacatgtgcctgcccagatggaatgctgttggcccgggatatgcgttcttgtctcacagaagcagaggcagctgtggcaacccaggagacgagcaccgtgcgcctcaaggtgagctccactgcggtacggacacagcacaccacaactagacccgtgccagacacttctcgccttccgggcgcaacccctggcctaactaccgtggaaattgtgaccatgtctcaccaggctctgggggatgttgctggccgcggcaacgagaaaaaaccatctagtgtacgggccttgtccatagtgttaccaattgtactgctggtctttctctgcctgggggtgttcttattgtggaaaaattggaggttaaagaacattaactctattaattttgacaatcctgtatatcagaagacgacagaggacgaagtgcacatctgccataatcaggacggttatagctatccgtcacgccagatggtgtctttggaagatgacgtggca

SEQ ID NO: 187 - DNA, 2580 bp, Artificial Sequence
  Description of Artificial Sequence: Synthetic Transcript Sequence
atgggaccgtggggttggaagctccggtggacggtggctctgctgctcgcggcagctgggaccgccgtgggcgaccgctgtgaacggaatgaatttcaatgccaggacggcaagtgtatctcgtacaaatgggtctgcgacggatcggcggaatgtcaagacggctctgacgaatcgcaagagacttgtctcagcgtgacttgtaagtcaggcgacttctcctgcggaggacgggtgaaccgctgcatcccgcagttttggagatgcgacggacaggtggattgtgataatggcagcgacgaacaggggtgcccgcctaagacttgctcgcaagacgagttccgctgccacgacggtaagtgtatctccagacagttcgtgtgtgatagcgatagggattgcctggatggaagcgacgaagccagctgtccagtcctgacctgcggaccggccagcttccagtgcaactcaagcacctgcatacctcagctctgggcgtgcgataacgacccagattgtgaggacggatcggacgaatggccacagaggtgccgaggactgtacgtgttccagggagactcgtctccgtgttcggcatttgagtttcattgcctgagcggggagtgcatccactcatcgtggcggtgcgacggaggaccagattgcaaagacaagtcggatgaagagaactgtgcggttgcgacttgccgccctgatgagttccaatgctcggacggtaattgcatccatggttcgaggcaatgcgaccgagaatacgattgtaaggacatgtcagacgaggtgggatgcgtgaacgtcactctgtgtgagggacctaacaaattcaagtgccattcgggcgaatgtatcaccctcgataaggtgtgcaatatggccagggattgtcgagattggagcgacgagccaatcaaagagtgcgggactaatgaatgcctggacaacaacggaggctgctcccacgtgtgcaacgatttgaagatcggatacgagtgcctctgccccgacgggttccagcttgtggcacagcgccggtgcgaagatattgatgaatgtcaggacccagatacttgctcccaactttgcgtgaatctggagggcggttacaaatgtcaatgcgaggaaggattccagctggatccgcacaccaaagcatgcaaagccgtggggagcatcgcttacttgttcttcactaatagacatgaggtgcggaagatgactttggaccgcagcgaatacactagcctcatcccaaacttgagaaacgtggtggcgcttgacactgaggtcgcgagcaatagaatctactggtcagacctttcccagcggatgatttgctcgactcagctggatagagcacacggagtgtcgtcgtacgacaccgttatctccagggacatccaggcaccggatgggctggcagtggactggatccactccaacatctactggactgattcggttctcgggaccgtgtccgtggccgacaccaagggggtcaagcgcaagaccctcttccgggaaaacggatctaagccgagagcgatcgtggtggaccctgttcatggtttcatgtactggactgactggggcaccccagccaaaatcaaaaagggaggacttaatggagttgatatctactcgctcgtgaccgagaatattcagtggcccaatggaatcacgctggatctgctgagcggccgtctgtactgggtggactcaaagctccattcaatctcgtcgattgatgtgaatggcggaaatcgcaagactattctcgaggatgaaaagcggctggcgcacccattttccctggccgtgttcgaggacaaggtgttctggactgacatcatcaacgaagcgatcttttccgccaaccggcttacggggtccgatgtgaacctccttgccgaaaatctcctgtccccggaagatatggtcctgtttcacaacctgactcaacctcgcggcgtgaattggtgcgaacgcaccactttgtctaatggcgggtgccagtacctgtgtctgccggccccacagatcaacccccattccccgaaattcacttgcgcgtgccctgatggtatgctgctcgctcgtgatatgcgatcctgcctgaccgaagccgaggcagcagtggccacccaagagactagcaccgtcaggcttaaggtgagctcaactgccgtacgcacgcaacacacgactaccagacctgtgccggacacttcccggctcccaggtgcaacccctggcctgaccaccgtggaaatcgtgactatgtcccaccaagccctcggagacgtcgccgggcgaggaaacgaaaagaagccatcctcagttcgggcattgtcaatcgtgctgccgatcgtgctgttggtgttcctgtgtctcggtgtttttctgttgtggaagaactggcgacttaagaatatcaactcaatcaacttcgacaatccagtgtatcagaaaaccaccgaagatgaggtacacatttgtcacaaccaggacgggtactcatatccctcgcggcaaatggtgtctttggaagatgatgtggcg

SEQ ID NO: 188 - DNA, 2580 bp, Artificial Sequence
  Description of Artificial Sequence: Synthetic Transcript Sequence
atgggcccttgggggtggaagctgaggtggaccgttgcactgctactggcggctgcgggaacagccgtgggagatcgctgtgaacgtaacgagttccagtgccaggatggtaagtgcataagttacaagtgggtgtgtgatgggagcgccgagtgccaagacggatccgacgagagccaggagacttgcctttcagtaacttgcaaatctggcgactttagctgcgggggccgggtaaacagatgtataccgcaattctggcgatgtgacggccaggtcgattgtgataacggatccgatgaacaaggttgtcccccgaagacctgctctcaggacgagttcagatgccacgatggaaaatgcattagcaggcaatttgtatgcgattcggaccgcgactgtctagatggcagtgacgaggctagctgtcctgtcctgacctgcggaccggcatctttccaatgtaacagttcaacatgcataccccagctttgggcctgtgataacgaccctgactgcgaggatggctctgatgagtggccccagagatgccgaggcctgtatgtttttcagggggatagtagcccttgcagtgccttcgagttccattgcctgtccggagaatgtatccatagttcttggaggtgcgacggcggacccgattgtaaagataaatccgatgaggagaactgtgccgttgccacctgccggcctgacgaattccagtgtagtgacgggaattgtatccacggttctcgacaatgcgatagggaatacgattgcaaggacatgagcgatgaggtgggctgtgtgaatgtcaccctgtgcgaggggcctaacaagttcaaatgccactcaggcgagtgtatcaccctggataaggtctgtaacatggctcgcgattgtcgcgactggtcagatgaaccgatcaaggagtgcggcaccaatgagtgtcttgacaataacggagggtgtagtcatgtctgcaatgatttgaaaatcggttatgagtgcctctgtccagatggcttccaacttgttgcccagcgtcgctgcgaggatatcgacgagtgccaagaccccgacacttgctctcagctgtgcgtgaacctggaaggcggctacaaatgccagtgtgaagaagggtttcaacttgaccctcatacaaaagcttgtaaagctgtggggagcatcgcctacttattttttactaacagacacgaggtccggaaaatgactctcgatcgaagtgagtacaccagcctaatacccaaccttaggaacgtggtggcacttgatactgaagtggcaagcaataggatttactggagcgacttgtctcagcgcatgatatgctcgacccagttagaccgggcacacggcgtgtctagttatgacacagtgatctctcgggacatacaggcgcccgacgggctggccgtggattggattcacagtaatatatattggactgacagcgtgttaggcactgtctcagtggcagatacaaaaggcgtgaagaggaagacattattcagagaaaacgggtcaaagccgcgcgcgatcgtggtggacccagtgcacggttttatgtattggactgattggggcactcctgctaaaattaagaaagggggactgaatggggtagacatatatagcctggtgaccgaaaacatccagtggcccaacggcataaccttggatctgctgagcggcagactatattgggtggactcaaagctgcactccatctcgagtattgatgtgaacggcgggaatcgcaaaaccattctggaagacgagaaacgcttggctcatccgtttagcctcgcagtgttcgaggacaaagtcttttggaccgatatcatcaatgaggcgattttcagcgccaaccgtctgactggcagcgatgtcaacctactggcagagaacctactttccccagaggacatggtgttattccacaatctaactcagccacgaggcgtgaactggtgtgaacggaccacactgtcaaatgggggctgtcagtacttgtgccttccggcaccacagatcaatccccacagccctaaattcacatgcgcatgtccagacgggatgctcctagcacgagacatgcgatcatgcctcactgaagccgaagcagccgtagccacacaggaaaccagcaccgtgaggctgaaggtgagcagtaccgccgtgagaactcagcacaccaccactcggcctgtgccagacacctcaagactcccaggcgccacacctgggctgactaccgtggaaattgtcaccatgtctcaccaggccctcggtgatgtggctggccggggaaatgagaaaaagcccagttcagttcgggcactgagtattgtattgcctatcgtcctgttggtcttcctgtgcctgggagtgttcttgctgtggaagaactggcgactcaaaaatatcaatagcattaatttcgataatcccgtgtaccagaaaactactgaggatgaggtgcacatttgtcataaccaggacggctacagctacccttctcgtcagatggtgagcctggaggacgatgtagca

SEQ ID NO: 189 - DNA, 2580 bp, Artificial Sequence
  Description of Artificial Sequence: Synthetic Transcript Sequence
atgggcccttgggggtggaaactgaggtggaccgtcgcgttgctgctcgctgcagccggcacagccgtgggcgaccgatgcgagcggaatgagttccagtgtcaggacggcaagtgcatttcttacaaatgggtgtgtgacggctcagctgagtgtcaagatggttccgacgagtcccaggagacctgcttaagcgtgacttgcaaaagcggggacttctcttgcggcggacgtgtgaatcgctgcattcctcagttttggcgttgcgacggccaggtggattgcgacaacggcagcgatgagcaagggtgcccacccaaaacctgtagtcaagatgagttcaggtgccatgacggcaagtgcatttcccgtcaattcgtatgcgacagcgacagggattgcttggatggctctgacgaagcgagttgtccagtcctcacttgcggcccagcgtcattccagtgcaatagcagcacctgcattccacagctgtgggcatgtgacaatgatcctgattgcgaggacggatctgatgaatggcctcagcgatgtaggggcctctacgtgttccaaggcgactcttcaccttgtagcgcttttgagtttcattgtctcagcggagagtgtatccatagttcttggcgctgtgatgggggccctgactgcaaggacaagtctgacgaggaaaattgcgctgtagctacttgccggccagacgagtttcagtgctcagatgggaactgcatccatggatcccgccagtgtgaccgagagtatgactgtaaagacatgtctgatgaggttgggtgcgtaaacgtcacactctgtgaaggccccaataagtttaagtgccatagcggagaatgcataaccctggataaagtgtgtaacatggcgcgggactgtagggactggtctgacgagccaattaaagaatgcggcaccaacgagtgcctagacaataatgggggatgctctcatgtttgcaacgacctgaagatcggttacgagtgcctgtgcccagacggtttccagctggtggcccagcgccgatgtgaggacatcgacgaatgtcaagatccggacacctgctcccagctgtgcgtgaacctcgaaggcggctacaagtgtcagtgcgaggagggctttcaactcgatccccacactaaagcctgcaaggcagtcgggtctatcgcgtatctattttttaccaataggcacgaggtgcgaaagatgacattagataggagcgagtacacaagcctgattcctaatctgcgaaacgtagtggccctggatactgaagtcgctagtaaccggatatattggagcgatctgagccagagaatgatttgttcaacacagttagatagggcccatggcgtgtcgtcttacgatacagtaatctcacgagatattcaagcgcctgacgggttggccgtcgactggattcattcaaatatttactggactgattccgtgcttggcactgtgtcagttgctgataccaaaggcgttaagcgtaagacactctttagagagaatggaagcaaacccagagccatagtggtagatcccgtccacggtttcatgtattggaccgactggggaacccctgcgaagattaagaaggggggcctgaacggagttgatatatactccttggtcacagaaaatatacagtggcctaatggtattacgcttgaccttttgagcggccggctgtattgggtggattctaagctgcacagcatttcaagcattgacgtaaacgggggcaaccgcaaaacaatcctagaagacgagaaacgcctggcccaccctttctccctcgctgtgtttgaggacaaggtcttctggacagatatcatcaatgaagctatcttcagcgctaatcggctgaccgggtctgatgtaaacctactggcagagaacctcctatccccggaggacatggttctgttccacaaccttacccaacctagaggggtcaactggtgcgaaagaacgactctttcaaacggagggtgtcagtatctgtgccttcccgccccccagattaacccgcacagccctaagtttacatgcgcttgccctgatggaatgttgcttgccagggatatgcggagctgcctcactgaggccgaagcagctgtggctacacaggagacgtccactgtgcgcctgaaggtttcgagtactgctgtgcggacccagcacacaactacaagacctgtgccggacaccagtaggctgcccggggctacccccgggctcactacagtcgagattgtgactatgtcccaccaggcccttggtgacgtcgcaggaagagggaatgagaagaagccaagtagcgtgcgcgccctcagcatagttcttcccattgtgctgcttgtatttctgtgcctaggcgtgttcctactatggaagaactggcgcctgaagaacataaatagcatcaactttgataatcctgtgtaccagaagaccaccgaggacgaggtccatatttgtcataatcaggatggttacagctacccaagccgccaaatggtcagcctggaggatgacgtggct

SEQ ID NO: 190 - DNA, 2580 bp, Artificial Sequence
  Description of Artificial Sequence: Synthetic Transcript Sequence
atggggccgtggggttggaagctgcgctggaccgtcgccctgcttctggccgccgctggaaccgccgtcggcgaccggtgcgagcggaacgaatttcaatgccaggatggaaaatgcatctcgtacaagtgggtctgcgacggatccgcggaatgtcaagatggatcagatgaatcacaggaaacctgcctctccgtcacttgcaaatcaggggacttttcatgcggcggacgcgttaaccggtgtatcccacaattctggagatgcgatggacaggtggattgtgataacggctcggacgagcaaggatgcccaccaaagacctgcagccaagacgaattccgttgtcatgacggaaagtgcatctcgcgccagttcgtgtgcgattccgacagagactgcctcgacggatcggacgaagcctcctgcccggtcctgacttgcggtccagctagctttcaatgtaattcgagcacgtgtattcctcagctctgggcgtgcgataatgacccggattgcgaggacggctcagacgagtggcctcagcgttgtaggggcctgtacgtctttcaaggcgactcatcgccgtgctccgcgttcgaattccactgcctttcgggggaatgcatccactcgtcttggagatgtgacggaggccctgactgtaaggacaagtcggatgaggagaactgcgcggtggccacctgtcgcccggacgagttccaatgttcagatggcaactgcattcatggctctcggcagtgcgacagagagtacgattgtaaagacatgtcagacgaagtgggatgcgtgaacgtgactctctgcgagggccctaacaaattcaagtgccactcaggagaatgcatcacgctggacaaagtctgtaatatggcacgcgactgccgggactggtccgacgaaccgatcaaagaatgtggaaccaacgagtgtttggacaataacggcgggtgctcacatgtgtgcaatgatctgaaaatcggatacgagtgcttgtgcccggacggattccagctcgtcgcgcagcgcagatgcgaggacattgacgaatgccaagaccctgatacctgctcccagctctgcgtgaatctggaaggaggctacaagtgccagtgcgaagaaggatttcagctggatcctcacaccaaggcatgcaaggccgtcggttcgatcgcttacctgtttttcaccaatcgccacgaggtgcggaagatgaccctcgaccggtcggaatacacgagcctgatcccaaaccttagaaatgtcgtcgccctcgacaccgaagtcgcatccaaccggatctattggtcagatctgtcgcagcgcatgatctgctcgactcagctggatcgagcacacggagtctcctcgtacgacactgtgatatcacgggacatccaggccccagacggactcgccgtggactggatccacagcaatatctactggactgattcagtcctcgggaccgtgtcggtggcagacacgaaaggggtgaagaggaaaaccctcttcagagaaaacggttccaagccgcgagctatcgtcgtggacccggtgcacggttttatgtactggactgactggggcacgcctgctaaaatcaaaaagggaggactgaacggcgtggacatctactcgctggtgaccgaaaacattcagtggccgaacggtatcaccctggacctgctttcgggacggctgtactgggtggactccaagctgcactcgatcagctccatcgatgtgaacggcggaaaccgaaagaccatcttggaggacgagaagcggctcgctcacccgttctctcttgccgtctttgaggacaaggtgttctggaccgatatcatcaatgaggcgatattcagcgccaacagactgactggatctgatgtgaacctgcttgcagagaacctcctttccccagaagatatggtgctgtttcacaatcttactcagccacggggtgtgaattggtgcgagcgcaccaccctgtccaacggaggatgccaatacttgtgtctcccggcgccacagatcaatccgcactcgcccaagttcacctgcgcttgccctgatggaatgctgctggcacgggatatgcgatcctgtctgactgaggctgaagctgccgtggcaactcaagaaacctcgactgtcaggttgaaggtttcgagcactgcggtgcgcacgcagcatactactaccagacccgtcccggacacgtcgcgcctccccggagccaccccgggactgactaccgtggagattgtgactatgtcccatcaggcgcttggcgatgtcgccggaagaggaaacgagaagaagccatcaagcgtgcgagccctcagcatcgtcctcccaatcgtgctgctcgttttcctgtgtctgggtgtgtttctcttgtggaaaaactggagactgaagaacatcaactccatcaactttgacaacccggtgtatcagaaaaccaccgaggacgaagtgcacatttgccacaatcaagacggatactcgtacccctctaggcagatggtgagccttgaagatgacgtggcc

SEQ ID NO: 191 - DNA, 2580 bp, Artificial Sequence
  Description of Artificial Sequence: Synthetic Transcript Sequence
atgggtccatggggatggaaacttcgttggactgtcgccctgctgctggcagcagcaggaaccgcagtgggggacaggtgcgagcggaatgagttccagtgtcaagacggtaaatgcatctcgtacaagtgggtctgcgacggttcagccgaatgccaggatggatccgacgagtcacaggaaacgtgtctgtccgtgacttgtaaatcaggcgatttttcatgcggtggtcgggtgaacagatgtattccacagttctggcgatgtgatggacaggtcgactgtgacaacggatccgatgaacagggttgtccaccaaaaacctgcagccaagacgaattccgctgtcacgatggaaagtgcatctccagacaatttgtgtgtgattcggatagagactgccttgatggaagcgatgaagcatcctgtccagtgcttacgtgtggtccggcgtccttccaatgtaacagctcaacgtgtatcccgcagctttgggcgtgcgataatgaccccgattgtgaggatggatcagatgaatggcctcagagatgtaggggcctctatgtgtttcagggagattcgtccccttgctcagcttttgaatttcattgtctttctggtgaatgtatacatagctcctggcggtgtgacggtggacctgactgcaaggacaagtccgatgaggaaaactgcgcagtggccacctgtcgacctgatgaatttcaatgtagcgatgggaattgtattcatgggagccgccaatgcgatcgagaatacgattgtaaggatatgagcgatgaagtgggatgtgtcaacgtgactctttgtgagggacccaacaagttcaaatgtcactccggggaatgtatcactcttgataaagtttgcaatatggcaagagactgtcgggattggtcagatgaacctatcaaggaatgcggcaccaacgagtgtctggataacaacggcggatgttcacacgtctgcaatgatcttaagattggctacgagtgtctgtgtcctgatggatttcagctggtcgcgcagcggcgatgcgaggatatcgatgaatgtcaagatccggacacctgttcccagctctgcgtgaacctggaaggaggctataagtgccaatgtgaggaaggttttcagctggatccgcatactaaggcctgtaaggcagtgggaagcattgcatacctgttctttactaatcgtcatgaagtgcgcaagatgacccttgatcggtcagaatacacgagcctgattccgaacctgagaaatgtcgtggcgttggatactgaagttgcgtcaaaccgaatctactggtctgacctgtcgcaaagaatgatttgtagcacccagcttgatagagcgcatggggtttcttcttacgataccgtgatttcccgtgacattcaagcacctgatggtttggccgtcgactggattcactctaacatatactggacggattcggtcctgggtaccgtgtcggtcgcagacaccaagggggtcaaacgtaagactctgtttagagaaaacgggtccaagcctcgtgcaattgtcgtggatcctgtccatggttttatgtactggactgattgggggaccccagcaaagatcaaaaaaggaggccttaacggtgtcgatatctactcccttgtgactgagaacattcaatggccaaacggaattaccctcgatctgctttcaggacgactttactgggtcgactcaaaactccatagcatttcgagcatagatgtcaacggtgggaatcgcaagacgatcttggaggacgagaagcggcttgcacatccttttagcctggctgtgtttgaggataaagtgttttggacggacataatcaatgaggccattttctccgccaaccggcttactgggtctgatgtgaatcttttggcagagaatcttctttccccagaagatatggtgctgtttcacaatctgactcaaccccggggtgtgaactggtgtgagcgcactactctttccaacggtggctgtcaatacctttgccttcctgcaccacagattaatccacacagccctaagttcacctgtgcctgcccagatggaatgctgctggccagagacatgagaagctgtcttaccgaggcagaagcagcagtggcgactcaagaaaccagcactgtccgtctgaaggttagttcgacggcagtgcggactcagcataccactacccggcccgtgcctgatacttcgcgactgccgggcgccaccccaggacttacgaccgtggaaatcgtgaccatgtctcaccaggccctgggggacgtggcaggaaggggtaatgagaagaagccttcttcggtgagagccttgtccatagtcctgccaattgtgcttctggtgttcctctgtttgggagttttccttctgtggaagaattggaggctgaagaacatcaactccatcaattttgacaacccagtctaccaaaagaccactgaggacgaggttcatatttgtcacaaccaggacggatattcgtacccatcgagacagatggtgtcgctggaggacgatgtcgcc

SEQ ID NO: 192 - DNA, 2580 bp, Artificial Sequence
  Description of Artificial Sequence: Synthetic Transcript Sequence
atgggaccctggggttggaaacttaggtggaccgtggccttgctgttagcggccgcaggtactgctgtgggcgaccggtgcgagcgaaacgagttccaatgtcaggatgggaaatgtattagttataaatgggtctgtgacgggagcgccgaatgccaggacgggagtgacgaatcacaagagacctgtcttagtgtgacctgtaagagcggcgattttagttgcggaggtagagtcaacaggtgcattcctcagttctggaggtgcgatggccaggtagattgcgacaacggctctgatgagcagggctgccccccaaagacttgttcccaagacgagttcaggtgccacgacggcaagtgcatctctcggcagtttgtgtgcgattccgatcgcgactgtctcgacggttctgacgaagcctcgtgtccggtcctaacttgtggtccggcgtcttttcaatgcaactctagtacttgcatccctcagctgtgggcttgcgacaatgaccccgactgtgaagacggttcagatgagtggcctcagagatgccgaggcctttatgtgttccagggtgattcatctccatgctcagcctttgagttccattgtctgtcgggggagtgcattcattcaagctggcggtgcgatggaggccccgactgcaaagataagagcgacgaggagaactgcgccgtcgccacctgcagacccgatgaatttcagtgctctgacggcaactgcatccacggtagccggcaatgtgaccgcgaatacgactgtaaagacatgtcggatgaagtgggatgcgtaaatgtaaccctctgtgaaggtccaaacaaattcaagtgccactccggagaatgcattacgctcgataaggtttgtaatatggcacgagactgtcgggattggtctgacgaaccaataaaggaatgcggcactaatgagtgtttggacaataatggagggtgcagtcatgtgtgcaatgacctgaaaataggatatgaatgtttatgcccggatgggtttcagttggtcgcacagcgcagatgcgaagacattgatgaatgccaggacccagacacatgtagccagctctgtgtaaatctggaagggggttacaaatgccaatgcgaagagggcttccagctggaccctcacacaaaagcgtgcaaagcggtgggttccatcgcctacttgttctttactaatcggcacgaggtgcgcaagatgaccctggaccgcagcgagtacacatcgctcattccaaatcttaggaacgtggtcgcccttgacacagaggtggcctccaacaggatatactggtccgacttgagccagcgcatgatctgttccacacaactggaccgcgctcatggcgtctcgagctacgacacagttatcagcagggacattcaggctccggatggtctcgccgtagattggatacacagtaacatatactggacagactccgtgttgggaacggtatctgtggcagacacaaagggggttaagaggaaaacgctctttcgtgagaatggatcaaagccgcgcgctatagtagtggacccggtgcacggattcatgtattggactgactggggcacacccgcgaagatcaaaaaggggggactgaacggggtcgatatctactccctcgttaccgagaacatccagtggcctaacggcattactttagacttgctgtctggtcgcctgtactgggtcgacagtaagttacatagtataagcagtattgatgtgaacggcgggaacaggaagaccatcctcgaggatgaaaagcggctggcccatcccttcagccttgccgtcttcgaggacaaggtcttctggaccgatatcataaacgaggccatcttctccgcaaacagattgacggggtctgacgtgaaccttctcgctgaaaatctcctgtcacccgaagatatggttctctttcacaacttgacccagccacggggggtaaactggtgtgagaggacaactttgagcaatggtgggtgccagtatctctgtctcccagctccccaaatcaatccccacagccccaagttcacctgcgcatgcccggacggcatgctcttggccagggacatgcgaagctgtcttaccgaggctgaagccgccgtcgccacccaggagacctcaactgtcaggcttaaagtttcttccacggcggtgcggacccaacacaccaccacgaggcccgtgccagacacttcgcgccttccgggagccacaccagggctgacgactgtcgagattgtcacaatgtctcaccaggccctcggtgacgtggccgggagaggtaacgagaaaaaaccaagctcagtgagagccctgtccattgttttgccaatcgttctgcttgttttcctgtgtcttggtgtcttcctgctgtggaagaattggcgtcttaagaacatcaattccatcaacttcgataacccagtgtatcagaagactacagaagatgaagtccatatttgtcataatcaggatggctacagttatccaagtagacagatggtaagcctcgaagatgacgtagcc

SEQ ID NO: 193 - DNA, 2580 bp, Artificial Sequence
  Description of Artificial Sequence: Synthetic Transcript Sequence
atgggtccctgggggtggaaactgcgttggaccgtggctctattgctcgcagctgctggtacggccgttggcgaccgctgcgagcgcaacgagttccagtgtcaagatgggaagtgcatctcatacaagtgggtctgtgacggtagtgcagagtgtcaagatggctcggacgagtcccaggaaacatgcctctctgtcacttgtaagagtggtgatttttcctgtggcggtcgcgtgaaccgctgtatccctcagttctggcgttgcgacggccaagtcgattgcgacaacggcagcgacgagcagggttgcccccccaagacttgttcacaggatgagttcaggtgtcacgatgggaagtgtatatcccgccagttcgtgtgtgattccgatcgcgattgtctcgacggtagcgatgaggcctcctgtccggttctcacctgcggacctgcgtcctttcagtgtaactcctccacctgcattccacagctttgggcctgcgacaatgacccggattgcgaggacgggtcggatgaatggccccagcggtgccgtggtctctacgtgttccagggcgactccagcccatgttccgcgttcgagttccactgtctctcgggtgagtgtatccattcctcatggagatgtgacggtggtcctgattgcaaggataagtccgatgaagagaactgtgcggtggctacctgtcggcccgatgaattccaatgtagcgacggcaactgcattcacggttcaaggcagtgcgaccgtgagtacgactgcaaggacatgtccgatgaggtcgggtgcgttaatgtcaccctctgtgagggacccaacaagttcaagtgccattcaggagagtgcattaccctcgataaggtctgtaatatggctcgcgattgtcgtgactggagcgacgaacccatcaaggagtgcggtactaatgaatgcctggataacaacggcggatgctcgcacgtctgcaacgacttgaaaatcggttatgagtgtttgtgtcccgacggctttcaactggttgcccagcggcgctgcgaggacattgacgaatgtcaggaccccgatacctgctcccagttgtgtgtcaacctcgagggcggttacaaatgtcaatgcgaggagggcttccaacttgaccctcacactaaggcttgcaaggcagtgggttctatcgcttaccttttcttcaccaaccgtcacgaggtccggaagatgacccttgacaggtccgagtacaccagcctgatccctaacttgcgcaatgtcgtcgctctcgacaccgaggttgccagcaaccgcatttactggagcgatctcagtcagcgcatgatctgctccactcaactcgacagagcccacggcgtgtcttcctatgacaccgtcatcagcagggatatccaggcccctgatggtctcgctgtggactggatccattcgaacatatactggaccgactcagtcctgggaaccgtatccgttgctgacactaagggcgtcaagcgtaagacgcttttccgcgagaacgggtcaaagccccgggctatcgtcgtggacccagttcacggctttatgtactggacggactggggtaccccagctaagattaagaagggcggcctgaacggtgtcgacatctacagtctagtcaccgaaaacatccagtggcccaacggcattaccctcgaccttctttcgggaaggctgtattgggtcgactctaagttgcactctatatccagcatcgatgttaatggtggcaatagaaagaccatcctcgaggacgagaagcgtctcgcccaccccttcagtctcgctgtgttcgaggacaaggtgttttggacggacatcatcaacgaggctattttcagcgctaatcgtctcacgggtagcgatgtgaacctgttggccgagaaccttctaagccccgaggacatggtactcttccataatctcacacagcctagaggcgtcaactggtgcgagcgcaccacactcagcaacgggggctgtcaatacttgtgtcttcctgcaccccagattaatccacattcacctaagttcacatgtgcgtgccccgatggtatgctgctggcacgggatatgaggtcttgtctgaccgaagccgaggcggcggtggccacccaggagacttctaccgttcgcctgaaggttagcagtaccgctgtccgcactcagcatacgacgactcggccagtccctgatacctcgcggctgcctggcgctaccccgggtctcaccactgtggaaatcgtgactatgtcccaccaggcactcggagatgtcgctggccggggcaacgagaagaagcccagctccgtgcgggcactgtccattgtactccccatcgtcctccttgtcttcttgtgcctcggcgtttttctgctgtggaagaactggcgtctcaagaatatcaattctatcaacttcgataacccggtctaccaaaagacgaccgaggatgaggttcatatctgccataaccaagatggatactcctacccatcccgccagatggtctccctcgaggacgacgtggct

SEQ ID NO: 194 - DNA, 2580 bp, Artificial Sequence
  Description of Artificial Sequence: Synthetic Transcript Sequence
atgggcccctggggttggaagctgaggtggactgtggccttgctgctcgcagctgctggcacagcagtgggggacagatgcgaacgaaatgagttccaatgccaggacggcaagtgcatctcctataagtgggtgtgtgatggttcggctgaatgccaggacggttctgatgaaagtcaagaaacctgtctgtcagtgacctgtaaatctggcgacttctcttgtggaggtagggtgaatcgttgtattccgcagttctggagatgtgatggccaggtggactgcgataatgggtcagacgaacagggctgtcctcctaagacatgcagccaggatgagtttagatgtcacgacgggaagtgtataagtcgccaattcgtgtgcgactctgaccgagactgccttgatgggtccgatgaagcgagctgccctgtgctgacttgcgggcccgccagcttccaatgtaattcatccacttgcataccccagctttgggcctgcgataacgaccctgattgcgaagacggatcagacgaatggccccaacgttgtcgcggcctgtacgttttccagggcgattcatcgccctgcagcgcgttcgaatttcattgtctttccggtgaatgtatccacagcagctggcggtgcgacggaggaccagattgcaaggataagtccgatgaagaaaactgtgcggtggctacctgcaggcccgacgaatttcaatgttccgatgggaattgcatccacggttcacggcagtgcgaccgagaatatgattgcaaggatatgagtgacgaagtcggctgcgtgaacgtgaccctttgtgaaggaccaaacaaatttaaatgccactcaggtgagtgcataactcttgacaaggtgtgtaacatggcccgggactgccgagactggtctgatgagcccatcaaggaatgcggaacgaatgaatgtctggacaataacgggggctgttcgcacgtgtgtaatgacctgaagattggatatgaatgcctgtgtcccgatggattccagctggtagcccagaggaggtgtgaagacatcgatgaatgccaggaccctgacacttgcagtcagctgtgtgtcaacctcgagggcgggtacaagtgtcagtgtgaggagggatttcagttagatccccataccaaggcttgcaaggctgttggatccatagcatatctcttcttcactaaccggcacgaggtgcgaaagatgaccttagaccggtcagaatatacaagtctgatacccaatctgcggaatgtagtcgctcttgacaccgaggtggcatccaaccggatttactggagcgatctatctcaacgcatgatttgttccacacagctcgatagggcgcatggggtcagttcatacgacacggtgatctcgcgcgatatccaggcgccagatggcctggccgttgattggatccacagtaacatttactggactgacagtgtgctgggcacagtttccgttgccgacaccaagggggtcaaaaggaagaccctgttccgagagaatggaagcaagccccgcgccatcgtggtggatcctgtccacggattcatgtactggaccgattggggaacgcccgctaagataaaaaaggggggcttgaacggcgtggacatatattcactagtaactgaaaatatccagtggcccaacgggatcacactggatttattgagcggtaggctgtactgggtggactccaagctgcactcgatttctagtatagacgtaaatggaggaaatagaaagacgatcctggaagacgaaaagagactggcccatccttttagtctggctgtgtttgaggataaagtcttctggaccgacatcatcaatgaggccattttctctgcgaaccggctcacggggagtgatgttaacttactggctgagaatctgttatcaccagaagatatggttctattccacaacctgacacagcccaggggcgttaattggtgcgagcgaaccacactgtctaatggaggttgtcagtacttgtgcctgcccgccccgcagattaacccccacagccccaagttcacctgtgcctgtccggatggcatgctgctcgctcgcgacatgcggtcctgcctgacagaggccgaggcagccgtggctacccaagaaacttccactgtgcgactaaaggtgtcctctaccgccgtgcgcacccagcataccaccacacggcctgtccctgacaccagccgactcccgggggctacccccgggttaacaaccgtggagatcgtgacaatgtcccatcaggcattgggcgatgtggctggtcgcggcaatgagaaaaaaccaagctccgtgagagcgctgtcaatcgtgctacccatcgtcctcctggtttttctctgcctgggcgtttttctattgtggaaaaactggcgcttaaagaacatcaacagcattaacttcgataatcctgtctaccagaagactactgaggatgaggtgcatatctgccataaccaggatggctacagctacccttcacgacagatggtgtcattggaggatgacgttgca

SEQ ID NO: 195 - DNA, 2580 bp, Artificial Sequence
  Description of Artificial Sequence: Synthetic Transcript Sequence
atgggcccatggggatggaagctcagatggaccgtcgcgctgctgctggccgcagcgggcactgcggttggtgaccgatgcgaaagaaatgaattccagtgccaggatggcaaatgtatctcttataagtgggtgtgtgacgggagcgccgaatgtcaggatgggagcgacgagtcccaagagacgtgtctctccgttacctgcaagtccggagattttagctgtggtggcagggtcaatcggtgcataccccagttttggagatgcgatggccaagtagattgcgacaatggtagtgatgagcagggatgtccccctaagacatgctcccaagatgagttcaggtgtcacgatggcaaatgcatttcacggcagtttgtgtgtgactctgatcgcgattgcttagacgggtctgatgaagcatcttgccctgtcttaacatgcgggccggcctctttccagtgtaattcaagcacttgcatcccacaactatgggcttgtgacaatgatcccgattgtgaagacggatctgacgagtggccacaacggtgcagggggctctatgtgttccagggcgacagcagtccctgcagcgcgttcgagtttcactgcctgtcaggtgagtgtatacacagttcctggaggtgcgacggagggccagactgcaaagacaaatccgatgaagagaactgcgctgtggcaacatgcagaccagacgaattccaatgcagcgatggcaactgcatccatgggtcaaggcaatgtgacagagaatatgactgtaaggacatgtcagacgaggtcgggtgtgtgaacgtgaccctgtgcgaggggccgaacaagtttaagtgtcactctggcgaatgtatcacgcttgacaaggtgtgcaacatggctagggattgtcgggactggagcgacgagcccattaaggagtgtgggaccaatgagtgcctggacaataatggcggatgtagccacgtctgtaatgatctgaaaatcggctatgaatgcctctgccccgatggattccagctggtggcccaacgacgttgtgaagatatcgacgaatgccaggatcccgacacctgctcccagctgtgcgttaacctagaggggggatacaagtgccagtgcgaggagggattccaattggatcctcataccaaagcttgtaaggccgtagggtctattgcctatctattctttacaaaccggcacgaagtacgtaagatgactctcgaccgcagcgagtacacaagcctgataccaaatctccggaatgtggtggccttagacaccgaagttgcatctaatcggatctactggagcgatctgtcacagagaatgatttgctccacccaactagatcgggcacatggtgtttcctcgtatgacacagtgatctctagagatattcaggccccggacggcctagcggttgactggattcactcgaatatttactggacagactctgtcctggggacggtttccgtggccgacactaaaggcgtgaaacggaaaacactgttccgcgagaatggctccaaaccaagagctatcgtggtcgatcccgttcacgggtttatgtattggaccgactggggcacccctgctaagatcaagaagggcggccttaatggcgtggacatatatagccttgttaccgaaaacatccaatggccaaacggcatcaccttagacctcctgtccgggcggctctactgggtcgattccaagctccattccatctcctctattgatgtcaacggcggcaatcggaagaccatcctggaagacgaaaaaaggttggcgcatcctttttccttagcggttttcgaagataaagtcttttggacagatataattaacgaagctatcttttctgccaacaggctcactgggtcagatgtgaatttactggcagaaaatctactgtctccagaggacatggtgcttttccacaacctgactcagcctcgaggcgtgaattggtgcgagcgcaccactttgtccaatggcggttgccagtacctgtgccttcctgcccctcagataaatcctcactcccccaaatttacatgtgcctgtccagacggaatgctccttgctagagacatgcgatcctgcttaacagaggccgaagccgcagtggcaacacaagaaacatccacagtccgcttgaaagtgagctctactgctgtgcgcacccagcacacaaccactaggccagtccccgacacctctcgtcttcctggtgccacacccggtctcacaacagtggaaatagtgacaatgagtcaccaggctctgggagatgttgcagggcggggaaatgagaagaaacctagtagcgttcgggctctgtcaatagtactgcctattgtgctcctggtcttcctatgcctgggggtttttctgctgtggaagaattggcgcctgaagaacatcaattccatcaactttgacaacccggtgtatcagaaaaccactgaggatgaagtgcacatatgtcacaaccaggatggttacagttacccatctagacaaatggtctctctcgaggatgacgttgcc

SEQ ID NO: 196 - DNA, 2580 bp, Artificial Sequence
  Description of Artificial Sequence: Synthetic Transcript Sequence
atgggtccttggggttggaaactgaggtggactgttgcactgcttctggccgcggctggtactgctgtgggagacagatgcgagcgcaatgagtttcaatgtcaggacggtaaatgtatcagctacaaatgggtttgcgacggctctgccgaatgccaggacggcagcgacgagtcccaggagacgtgcttgagcgttacctgtaaatcaggcgacttcagctgcgggggtcgcgtgaaccggtgtattccccaattttggcgctgtgatggtcaggttgactgcgataatggtagtgatgagcagggttgtcctcccaagacttgctcccaggacgagtttcgctgccacgatggtaaatgcattagcaggcaattcgtttgtgattccgatagagactgcctggatggttccgacgaagcaagctgtcctgtgttaacgtgcggtccggccagctttcaatgtaatagctctacgtgcatccctcagctgtgggcgtgcgataacgaccctgactgcgaggacggtagtgatgaatggcctcagcgatgtcgaggcctgtatgtatttcagggtgacagcagcccatgcagcgccttcgaattccactgcctgtctggagaatgcattcatagctcatggcgctgtgacggtggccctgactgcaaggataaaagcgatgaggaaaattgcgcggtggccacgtgtcgcccagatgagttccagtgttctgatggtaactgcattcatggttcaagacaatgtgacagggagtatgattgcaaggatatgagcgacgaggttggctgtgtgaacgttaccctgtgcgagggaccgaataaattcaagtgccacagcggcgaatgtatcacgcttgataaagtgtgtaacatggctagggattgccgcgactggtctgacgaaccaattaaagagtgcggaaccaatgaatgtctggataacaacggcggatgcagccacgtgtgcaacgacctgaaaataggttacgagtgtctgtgccctgacggattccaattggtagcgcaacgacggtgtgaagatattgacgagtgccaggatcctgatacctgttctcaattatgcgtcaatcttgaaggcggctataagtgccaatgcgaagagggatttcagcttgatccacacacgaaggcctgtaaggcggtggggagcatcgcctatttgttctttacgaaccgccatgaggtgcgtaaaatgactctggacaggtcggagtatacgagcctgatccctaatctgcggaacgtggtcgcgctggacaccgaagttgcgtcaaacagaatctattggagcgacctgagccagcgtatgatttgctctacccagctcgaccgggcgcacggagtctctagctatgatacagtaattagccgcgacatccaagccccggacggactcgcagtggactggatccactcaaatatatactggaccgatagcgtccttggcacggttagcgtagcagataccaagggtgttaagcgcaaaaccctatttagagagaacggaagcaaacctcgtgctatcgtcgtggatcctgtgcatggctttatgtactggaccgactggggcacccctgcaaaaatcaagaaggggggccttaatggagtggacatctatagccttgtgaccgaaaacatccagtggccgaacggtatcacccttgacctgctgtccggccgtctgtattgggttgattctaagctgcactctattagctccattgatgtgaatggaggtaatcgcaagaccattctggaggatgaaaagcgtttggcgcaccctttcagcttggcagtgttcgaggacaaagtattctggactgacattatcaatgaagccattttcagcgctaatcgccttacaggttccgatgtgaacctcctggcagaaaacctgcttagccctgaggatatggtgctgttccacaatctcacccagccacgcggtgttaattggtgtgagcggacgaccctgtctaatggcggttgtcagtatttgtgcctgcctgccccacagattaacccacatagcccaaagttcacgtgtgcctgtccggacggcatgctgcttgctcgcgacatgcgctcctgcctgactgaggcagaagccgcagttgccacccaagagaccagcaccgtgcgcctgaaggtttcgtcaacggcggttcgcactcagcacaccactaccaggccagttccggacacgagcagattgcccggtgcgacacctggtctgactaccgtcgagatcgtgaccatgagccatcaggcgctgggtgatgttgcgggtagaggtaacgagaagaagcctagcagcgtgcgcgccctgtctatcgtcctgccgatcgtacttctggtgttcctgtgcctgggagtatttctgctgtggaagaattggcggctgaaaaatatcaactctataaacttcgataacccagtttatcagaagaccactgaggatgaggtgcatatctgccataatcaggacggttactcctaccctagcaggcaaatggtgtctttggaggatgacgtcgcg

SEQ ID NO: 197 - DNA, 2580 bp, Artificial Sequence
  Description of Artificial Sequence: Synthetic Transcript Sequence
atgggcccttggggatggaaactgaggtggacagtagcgctcctgctggctgcagctggcactgctgtgggcgacagatgtgaaagaaacgagttccagtgtcaagacggcaagtgcatcagttacaagtgggtatgcgacggctctgctgaatgccaggacggttccgacgaatctcaagagacttgtctgtccgtgacttgtaaaagcggagacttttcttgcggaggccgcgtgaacaggtgcatcccccagttttggcgctgtgatggacaggtcgactgtgataacggttccgacgagcagggttgtccccccaagacgtgcagccaggatgagttccgctgtcacgacggcaaatgcatctccaggcagtttgtttgcgacagtgatcgcgactgccttgatggatctgatgaggccagttgtccggtgctgacctgtggacccgcctctttccagtgtaatagttctacctgtatcccacaactctgggcgtgtgacaatgatcccgattgcgaggatggctccgacgaatggcctcaaaggtgcaggggactgtatgtgtttcaaggcgactcttcaccctgtagcgctttcgagtttcactgtttgagcggtgaatgcattcacagtagctggagatgcgatggcggccccgattgcaaggacaagtctgacgaagaaaattgtgctgtggctacctgcaggcccgacgaattccagtgtagtgacggtaactgtattcacggtagcaggcaatgcgatagggagtacgattgtaaggatatgagcgacgaggtcggatgtgttaacgtcactctctgcgagggccccaacaagttcaaatgtcacagcggtgaatgtataaccttggataaagtgtgcaacatggcccgcgactgtagagattggtccgacgaaccaatcaaagagtgcggaacaaacgaatgcctcgataataatggcggttgttctcacgtctgtaatgaacttaagatcggctacgaatgcctttgcccagatggtttccagctcgtcgctcaaagaaggtgcgaggatatcgacgagtgtcaggacccagacacatgcagccagctgtgcgtgaacctggaaggcggttacaagtgtcagtgtgaggagggattccagctggaccctcatacaaaggcttgtaaggccgtcggatccatcgcgtacctgttcttcacaaataggcacgaagtacgcaaaatgacgttggataggtctgagtatacctcactgattcctaacctgagaaacgtggtcgccttggataccgaggtagcttcaaaccgcatctactggtctgatctttcccagcgcatgatctgttccacgcagctggatagggctcatggtgttagttcatacgatacagtcatctctagagacatccaggcccccgacggccttgctgtggactggatacacagcaacatttactggacggacagcgtcctcggtacggtgtccgtggcagacaccaagggcgtgaaaagaaagacactcttcagagagaatggtagcaaaccaagggcgatcgttgtggatccggtacacggcttcatgtattggacagactggggtacacccgccaagatcaagaaaggtggattgaacggcgtggacatctactctctcgttacagagaacatccaatggccgaacggaatcacactcgacctgctttccggcaggctgtactgggtggatagcaagctgcattccatatcttccatcgatgtgaatggcggcaaccgcaagaccatcctcgaagacgagaagaggctggcccatcccttcagcctcgctgtgttcgaagacaaggtgttctggactgacatcatcaacgaggcaatctttagtgcaaacagactgactggctctgacgttaacttgcttgctgagaaccttctgagcccggaggacatggtgctctttcataatctgactcaaccgagaggagtgaattggtgcgagcgcactacgttgtccaatggaggctgtcagtatctttgcctccccgctccccagatcaacccacattccccaaagtttacttgcgcctgtcccgacggcatgctgctcgcaagagacatgaggtcttgccttaccgaggccgaagcagctgtggctacacaggagacttcaaccgtaaggcttaaggtcagcagtacggctgtgagaacgcagcatacaactaccaggccggtgcccgatacctcaagactgccaggcgccacaccaggactcacgaccgtggagattgttaccatgtcacaccaggccttgggagacgtagcaggcaggggcaacgagaagaagccctcatccgtaagggccctgtctatcgttctgcccatcgtgctgctggtgttcctctgtttgggcgtgttccttctttggaagaattggagactcaagaacatcaatagcatcaacttcgataaccctgtgtaccaaaagacaaccgaagacgaggtgcacatctgtcacaaccaggacggttacagttacccttctagacaaatggtctccctcgaggatgatgtcgca

SEQ ID NO: 198 - DNA, 2580 bp, Artificial Sequence
  Description of Artificial Sequence: Synthetic Transcript Sequence
atgggaccatggggttggaaactcagatggacagtagcattgttgctggcggcggcaggcactgcagtaggagacagatgcgaacggaacgaattccaatgccaagacggaaaatgcatttcgtacaaatgggtctgcgacggatctgcagaatgccaagatggaagtgatgaatcacaggaaacttgcctgtccgtaacctgtaaatccggagatttttcatgcggaggaagagttaatcgatgtattccacagttctggagatgtgatggtcaagtcgattgtgataatggtagtgacgaacaaggatgccctccaaaaacatgttctcaggacgaattcaggtgtcacgacggaaaatgtatttctagacagttcgtatgcgacagtgaccgagattgcttggatggatcagacgaagcttcatgcccagtgttgacatgtggtcctgcatcttttcaatgcaattcgtcaacatgcattccccaactatgggcctgcgataatgatccagactgtgaagacggtagtgatgaatggccacagcgatgtaggggactatatgtgtttcagggtgattcttcgccgtgttcagcttttgagtttcattgcctatccggggaatgcatacattcttcgtggcgatgtgacggcggaccagattgtaaggacaaatctgacgaagaaaactgcgcagtggcaacgtgcagaccggatgaatttcaatgctcagatggaaactgcattcatggaagccgacaatgcgatcgagaatatgactgtaaagatatgagtgacgaggtgggttgcgtgaatgttacgctctgtgaaggaccaaataaattcaaatgtcattctggagagtgcattactttggataaggtctgcaacatggcacgcgattgtcgggactggagcgatgagccgattaaggaatgtggtactaacgaatgtctcgacaacaacgggggatgttcgcatgtttgcaatgaattgaaaataggatacgagtgtttatgtccagatggctttcagctcgttgcacaacgtcgttgcgaagacatcgatgagtgccaagatccagatacctgttctcagctttgtgtaaacctggaaggtggctacaagtgtcaatgtgaagagggttttcaattagatccacacaccaaagcctgcaaagccgttggatctatcgcttatttgtttttcacaaatcgtcatgaggtccgtaaaatgactcttgatcgctctgaatatacctcactcataccaaatttaagaaatgtcgttgctttagacacagaggttgcgtctaaccggatttactggtccgatttatcacaaaggatgatctgttctacgcagttagaccgagcacatggagtttcctcatacgataccgttatttctagagacatccaagctcctgatggtctcgccgtcgattggatccattctaacatatattggacggattcagttctaggaaccgtttcagtcgccgatacaaagggggtgaaacgcaagacactttttcgtgaaaatgggagtaagccacgggccattgtagtggatccagttcatggattcatgtattggaccgactggggaaccccggctaaaattaagaaaggcggactcaatggagtcgacatctattcgttggtaacggaaaatattcagtggccaaacgggattactctggacttgttgagcggacgactgtattgggtagattcaaagttgcactctatcagtagcatcgacgtgaatggaggaaatagaaaaacgatactcgaggatgagaaaagacttgcccacccattttcactagcagtttttgaagacaaggtgttctggactgacatcataaacgaagcaattttctcagcaaatcgccttaccggatcagatgttaatctactcgctgaaaatcttctctcgccagaggatatggttcttttccataatttaacccaaccacgaggagtaaattggtgcgaacgaactacattatcaaatggaggatgtcaatatctttgcctcccagcacctcagatcaatccacactctccaaaatttacatgtgcctgcccagatggtatgttattggcgcgtgatatgcgttcgtgccttacagaagcagaagctgcggtggcaacccaggaaacgtctacagttcgactcaaagtctcttcaactgccgtcagaacccaacacacgactacaagaccggtaccggatacatctcgtcttccgggggcaaccccaggactaacaacggttgagattgtcacgatgagtcatcaagcattgggagacgttgcagggcgtgggaacgaaaaaaagcctagctcagtccgagccttatccattgttttgccaatagttcttctagtctttctttgtttgggagtttttctgctttggaaaaattggagacttaaaaatatcaactcgatcaacttcgataatccagtttaccagaaaaccacagaggatgaagtgcacatttgccataatcaggacggatactcctatccgtctagacagatggtttcgttagaggatgacgttgcc

SEQ ID NO: 199 - DNA, 2580 bp, Artificial Sequence
  Description of Artificial Sequence: Synthetic Transcript Sequence
atgggcccgtggggctggaaattaagatggaccgtagccctgttactggccgccgctggaacagctgtgggtgataggtgtgaacgaaacgaattccagtgccaggatggaaaatgtattagctacaagtgggtgtgtgatggctctgcagaatgccaggacggttcggacgagagccaggaaacatgcctttctgtgacatgcaaaagtggcgacttcagctgcggcgggcgagtcaaccgttgtatcccacagttctggcggtgtgatggtcaagtggattgcgacaatgggtccgatgagcagggttgccccccgaagacgtgtagtcaggacgagttccgctgtcacgacggcaagtgtatttcccgccagttcgtgtgcgattcggacagggactgtctagacgggagtgacgaggcctcttgccccgtgttaacttgtgggcccgcatctttccagtgcaattctagcacctgcattccacagctatgggcgtgcgataatgacccagactgtgaggatggaagtgacgagtggccgcagcgatgccgtggcctctacgtgttccaaggagatagttccccctgctcagcctttgaattccattgcttatcaggcgaatgcatccattcaagctggagatgcgacggaggaccggattgtaaggataagagcgacgaagaaaactgtgcagtggccacgtgcaggcccgacgagtttcagtgcagcgatggtaactgtatacatgggtcaagacagtgcgatcgcgaatacgattgtaaagatatgtccgacgaggttggctgtgtaaacgtgaccctctgtgaaggacccaacaagttcaagtgccactctggcgagtgcattacactggacaaagtgtgcaacatggctcgggactgtcgtgattggagcgacgagcccattaaagagtgtggcactaatgaatgtctagataataatggaggttgttcacacgtatgtaatgaactgaaaatcggttacgagtgtctgtgtcccgacggtttccagctggtggcgcagcgaaggtgcgaagatattgatgagtgtcaagaccctgacacatgcagccagctatgtgtgaatctggagggcggctacaagtgccagtgcgaggaagggtttcagttagacccacacaccaaggcctgtaaagcagtcggctcaattgcctacttgtttttcaccaaccgacacgaagtgaggaagatgacccttgatcgctcagaatatacatctctgatccccaatctcagaaacgtagtggccctggacaccgaagttgcgtccaatagaatttattggagcgacctaagccagcgcatgatctgctctacacaactggatcgcgcgcatggagtgagtagttacgatacagttatcagtcgagacatacaagcccccgatggcctggccgttgattggattcatagtaacatctattggaccgacagcgtgctgggcacggtatccgttgcagacaccaaaggcgtgaaacgcaaaaccttattccgcgaaaacggatcaaagcctcgggccatagtggtcgaccccgtgcatggctttatgtattggacggactgggggacccccgccaagatcaaaaaggggggactgaacggagtcgacatctactctcttgtgaccgagaatattcagtggccgaacgggattacattggacctgcttagcgggcgtctgtactgggtcgacagcaaactgcactctatttcctccattgatgtgaatggaggaaatagaaaaacgatccttgaagatgagaaaagactcgctcaccctttttcacttgccgtcttcgaagataaggttttttggactgacatcatcaacgaagcaatctttagtgccaatcggctcacaggaagcgatgtcaacctgctcgctgaaaatttgctctcaccagaagatatggttttgttccataaccttacacaacccagaggggtgaattggtgtgaacggacgacattgagcaatggcggttgccagtatctgtgcctgccagccccacaaatcaatcctcacagcccaaagttcacttgcgcctgccccgacggtatgctcctggcacgagacatgcgtagctgtctgacagaggcagaagccgccgttgccacacaggagacaagcacggtccgtcttaaggtgtcctctaccgctgtgcgcacccagcatactaccacgcggccggtacccgacacttcaaggctaccgggagccaccccaggcttaacaacagttgaaattgtgacaatgagtcatcaggccttgggagatgtggcgggacgaggcaacgaaaagaagccgtcctccgtgagagctctatctatcgtactacctattgtgcttctcgtgttcctttgcctaggagtttttctgctgtggaagaactggcgattgaagaacataaactcgataaatttcgataaccccgtctatcagaagacgactgaggacgaagtgcacatctgtcacaaccaggacgggtacagctatccaagtaggcagatggtaagcctagaggacgacgtggct

SEQ ID NO: 200 - DNA, 2580 bp, Artificial Sequence
  Description of Artificial Sequence: Synthetic Transcript Sequence
atgggcccctgggggtggaaactgcgatggacggttgccttgttactggccgccgctggcactgctgtcggagatagatgtgagcggaacgaatttcagtgccaggacggaaaatgtatctcgtataaatgggtatgtgacggcagcgctgagtgtcaagacggttctgatgaatcgcaggagacatgcctgtccgtcacttgtaaatcgggggacttttcttgtggaggccgtgtgaaccgctgcatcccgcagttttggaggtgcgatggccaagtcgattgcgataatggatctgatgaacagggatgcccacctaaaacgtgtagccaagacgagtttcgttgccatgatggcaaatgtatcagccggcagtttgtatgcgattcagatagggattgccttgacgggagcgatgaagcatcttgcccggtgcttacctgtggtcctgcttcattccagtgtaactctagcacgtgtattccgcaattatgggcctgcgataatgacccggattgcgaggatggctcagatgagtggccacagcgatgtcgcggattgtatgtattccaaggagactcaagcccttgttcggcgtttgaatttcactgtcttagtggtgaatgtatacatagttcttggcggtgcgatggcggaccggactgtaaagacaaatcagatgaagaaaattgtgctgttgcgacgtgcaggccggatgagtttcagtgtagcgatggaaactgtattcacggcagcagacagtgcgatcgcgaatacgattgcaaggatatgtcagacgaggtcggctgtgtcaatgtaacattatgcgagggtccaaacaagtttaagtgtcattcgggtgaatgcatcacgcttgataaagtatgcaatatggctcgagattgccgggattggagcgatgaacctataaaagaatgcgggacaaatgagtgtctagataacaatggcggctgcagccatgtgtgtaatgagttaaaaattggatatgagtgtttatgcccggatggattccaactggtcgcgcagcgccgatgtgaagatatcgacgaatgtcaagatccggacacatgcagtcagctctgcgtaaatttggaaggcggctacaaatgtcagtgtgaggagggatttcagctagatccacacacaaaagcatgtaaagccgtgggtagcattgcctatcttttttttacgaatcgtcatgaagtaagaaagatgacactggatagatcagaatatacatcgcttattcctaaccttcgcaacgtagtagctctggataccgaagtggcctccaatcgtatatattggtcagacctgtctcaacgcatgatttgtagtacacaacttgatagggcccacggcgtctcatcctatgatacggtgatcagccgggatatccaggcgcctgatggtcttgcggtagactggattcacagcaatatttactggacggatagcgtcctgggcactgtgtcagttgctgacacaaaaggcgtaaagagaaaaactctctttcgggaaaatggctcaaagcctcgcgccattgttgtagatcctgtacacgggtttatgtattggacggactggggtacaccggctaagatcaaaaaagggggccttaatggagtggatatttattccttggtgacggaaaatattcaatggccaaacgggataactctcgatctactgtcaggtcggctttattgggtggatagtaaacttcatagtattagctctattgatgtcaatggcggaaatagaaaaacgatcctggaagacgaaaagcgtctggcacaccctttctccttagcagtattcgaagataaagtgttttggacagatattatcaatgaagccatctttagcgcgaatcgacttactggcagtgacgtaaaccttcttgctgaaaacttgttatctccagaagatatggtcttatttcataacttaacacagccacgcggagtcaattggtgcgaaagaacaacgctttctaacgggggatgccaatacctttgcttacctgcacctcagattaacccgcattcccctaagtttacatgtgcgtgccctgatgggatgcttttggcgagagatatgcgctcctgtctcactgaagctgaagctgctgtagcgacacaggagacgagcacagttagattgaaggtgagctcgacggcagttagaacacagcatacgaccacaagacctgttccggataccagccgtttgccgggcgcgacccctggtctgaccacggtcgaaatcgttacaatgtcccaccaggcgttgggtgatgttgccggaaggggcaatgagaaaaaaccgtcttccgtgcgtgccttatcgatcgtcctgcctatcgtgttgttagtatttctttgccttggtgttttcttgctttggaaaaattggagactcaagaatattaactcaattaactttgacaatcctgtataccagaagacaacggaagatgaagttcatatttgccataatcaagatggctattcttacccttctagacagatggtgagccttgaagatgatgtcgct

SEQ ID NO: 201 - DNA, 2580 bp, Artificial Sequence
  Description of Artificial Sequence: Synthetic Transcript Sequence
atgggaccgtggggatggaagctgagatggaccgtggcgctgctcctcgctgcggctggcaccgctgtcggcgaccgctgcgaaagaaacgaatttcaatgtcaggacggaaagtgcatctcgtacaaatgggtttgcgacggtagcgctgaatgccaggatggctccgacgagtcccaggaaacttgtctgagcgtcacctgcaagagcggcgatttctcatgcggaggcagggtcaacaggtgcatcccacagttctggaggtgcgacggacaggtggactgtgacaacggctcagacgaacagggatgtcctcccaaaacctgttcccaggatgaatttcggtgccatgatgggaagtgtatttcacggcagttcgtctgcgactcagaccgggattgcctggacggatccgatgaggcgtcctgccccgtcttgacctgtggacctgcctcatttcaatgcaattcttcaacttgcattccgcagctgtgggcatgcgacaacgaccctgactgcgaggacgggagcgacgaatggccgcaacggtgtaggggtctgtatgtctttcagggagactcgtccccttgcagcgcctttgagttccattgtctgagcggggaatgtatccactcgagctggcgctgtgacggaggacctgattgtaaggacaagtcagacgaggagaactgtgcggtggctacgtgtcggccggatgaattccagtgctcggacggcaactgcatccatggatcccgccagtgcgaccgcgaatacgactgcaaggatatgtcggacgaagtggggtgcgtgaatgtgactctctgtgaaggccccaataagtttaagtgccactcgggagagtgcatcactctcgacaaggtctgcaacatggcccgggattgccgggactggtcggatgagccaatcaaggaatgcggaaccaatgagtgtcttgataacaacggaggatgctcccacgtctgcaacgaactcaaaatcggatacgagtgcctctgcccggacgggttccaactcgtggcccagagacgatgcgaagatatcgatgagtgccaggatccggacacctgctcccaactctgcgtgaacctcgagggcggatacaagtgccagtgtgaagaagggttccagctcgatcctcatacgaaggcgtgtaaggctgtcgggagcatagcctacctcttcttcacgaaccgccatgaggtgcgcaagatgaccctcgaccgcagtgagtacacctcccttatcccgaacttgcggaatgttgtggctttggacaccgaagtggcctccaatcggatctactggagtgatctctcacagagaatgatctgctcgacgcaactcgaccgcgcccacggtgtgagctcgtacgatactgtgatctctcgggatatccaagcaccggatggcctggcggtggactggatccactcgaacatctactggactgactcagtgctggggaccgtgtctgtggcggacaccaaaggagtgaagcgtaaaaccctcttccgagaaaacgggtcgaaaccacgagcgatcgtggtggatccggtccatggattcatgtactggactgattggggaacgccggctaagattaagaaaggaggactgaatggagtggacatctactcactggtgaccgaaaacattcagtggccgaatggtattactctggacctgctcagcgggcgcctgtactgggtggactcgaagctgcacagcatctcctccatcgatgtgaacggaggaaatcgcaaaactattttggaggatgaaaagagactggctcaccctttcagcctcgcagttttcgaggacaaagttttctggactgacattatcaatgaggccatcttttccgccaaccgactgactgggtctgacgtcaacctgctggccgaaaatctgctgtcgccggaagatatggtcctctttcacaatctgacccaaccccgcggcgtgaactggtgcgagaggactactcttagcaacggcggatgtcagtacctgtgcctgcctgcgccccagattaacccacatagtccgaagttcacctgcgcctgccctgacggaatgttgctggctagggacatgagatcgtgtctgactgaggccgaggcggcggtggcgactcaagagactagcaccgtccgcctgaaggtcagttccaccgccgtgagaactcagcatacgaccacccgcccagtgccggataccagccggcttccgggagcgactccaggcctgactaccgtggaaatcgtaacgatgtcacatcaggccctgggggacgtggcaggccggggaaacgaaaagaagccatcatcagtgagggcactgtcaatcgttctccctatcgtccttctggtgtttctgtgcttgggcgtgtttctgctgtggaagaattggaggttgaaaaacatcaactcgatcaatttcgacaacccggtgtaccaaaaaactactgaggacgaagtccacatctgtcacaatcaagatggatactcgtacccatcgagacagatggtcagtctggaagatgatgtggcc

SEQ ID NO: 202 - DNA, 2580 bp, Artificial Sequence
  Description of Artificial Sequence: Synthetic Transcript Sequence
atgggcccgtgggggtggaaacttaggtggaccgtcgcccttctgctagccgccgccgggaccgcggtaggagatcgatgtgagcgtaacgagtttcagtgccaggatggcaagtgtatttcctacaagtgggtgtgtgacggttctgcagagtgccaggacgggtctgacgagagccaagagacatgcctttcagttacctgcaagtcaggggatttttcctgtggggggagggtgaatcgctgcattccccaattttggagatgtgacggtcaggtggactgcgataacggatccgatgagcaggggtgtcctcctaagacctgttcgcaagatgagttcaggtgtcatgatggtaagtgtatatcccgccagttcgtgtgcgactccgatcgggattgtctggatgggagtgatgaggccagttgccctgtcctcacatgcggccctgcgtccttccaatgcaacagctccacgtgtatcccgcagctctgggcctgtgacaacgaccctgattgcgaagacggcagcgacgaatggcctcagcgctgtcgcggcctatacgttttccagggcgatagctctccatgttctgctttcgaatttcactgcctgagcggagagtgcatccatagcagttggagatgcgacggcgggccagattgcaaggacaaatccgacgaggaaaactgtgccgttgccacgtgtcggccggacgaattccagtgtagcgacggaaactgcatccatggaagtcgtcagtgtgaccgtgagtatgactgcaaagatatgtcagacgaggtggggtgcgtaaatgtcactctctgcgaagggcctaataagttcaagtgccacagcggggagtgcattaccctagataaggtatgcaatatggcgcgggactgcagagattggtctgatgagcctattaaagagtgtgggaccaacgagtgtctcgataataatggaggatgcagccatgtatgtaatgagctgaagataggctacgagtgcctatgtcctgacggcttccagctggtcgctcagagaaggtgcgaggacatcgatgagtgccaggaccctgacacttgtagccagctctgcgtgaatctggaaggtggatataagtgccagtgcgaggagggtttccagcttgacccccacacaaaggcgtgtaaagctgtcggatctatcgcttacctgttttttactaacagacatgaagtgcggaagatgactctggaccgctccgaatacacaagcctgatccctaacctgcgcaatgtggtggccctggacaccgaagttgctagcaacaggatttattggtctgacctctcccagcgcatgatctgttccactcagctggatcgggcccatggggttagctcctatgacacggtgatctctcgagatattcaggcgcctgacggcctggctgtggattggattcattcaaatatctactggacagactcagtccttggtaccgtcagcgtggctgacactaagggagtcaagaggaaaaccctgttcagggagaacgggtccaagcctagggccattgttgtggatcccgtccatggctttatgtactggaccgactggggcacacctgctaagattaagaaagggggcttgaatggagtggatatttacagtctggtcaccgaaaatatacagtggcctaacggcattaccttagacctgctgtccgggcgactgtattgggttgattccaagctccacagcattagctccattgacgtgaatggaggcaatcggaaaaccattctggaggacgaaaagaggctggctcacccgttctcactcgcagtgtttgaggacaaagtgttctggacagatatcataaacgaagcgatctttagcgccaaccgacttacaggttctgacgtaaacctgctggccgaaaatctcctgtctcctgaggacatggtcttgttccataatttgactcagccgaggggcgtgaactggtgcgagaggaccacattaagcaacggcggctgccagtatctttgcctgccggcaccacagatcaatccccacagccctaaatttacatgcgcctgtcctgatgggatgctgctcgcccgcgacatgagaagctgcctcacagaggcagaggcagcggtggccacccaggagacatccactgttagactgaaagtaagctcaactgctgtgagaactcagcatacgactacgagacctgtgccagatacatcccgcttacccggagcgacccctggcctgactacagtcgaaatagttacgatgtcccaccaggctcttggagacgttgcggggcggggaaatgagaagaagcctagctccgtccgggccctgtcaatcgtactgcccattgtcttgctcgtgttcctttgcctgggcgtgtttctgctgtggaaaaattggcgacttaagaacatcaactcaatcaatttcgataatcccgtgtaccaaaagacaacagaggatgaagtgcacatttgccataaccaggatggatatagttacccatctagacagatggtcagcctggaagatgacgtcgca

SEQ ID NO: 203 - DNA, 2580 bp, Artificial Sequence
  Description of Artificial Sequence: Synthetic Transcript Sequence
atgggcccatggggatggaagctacggtggaccgtagcgttgctcctggcggcagcagggaccgcagtgggagatcggtgcgagcgaaatgagttccagtgccaggatggcaaatgtatcagctataagtgggtgtgtgacggttcagccgaatgccaggacggcagtgacgagtcacaggaaacctgtttatccgtcacttgcaaaagtggcgactttagctgtggggggagggtgaatcggtgtatccctcagttttggcgatgtgacggtcaagtcgactgcgataacggttccgacgagcagggatgcccacccaagacatgctcccaggatgaatttagatgtcatgacggcaagtgcatatccagacagttcgtgtgtgattcagatcgggactgcctggatggtagtgatgaggcatcctgcccagtccttacatgtggtccagcctcatttcagtgtaatagcagcacttgcatcccacagctgtgggcttgcgataatgaccccgactgtgaggacggatccgatgaatggccccagcgctgtcgtggcctttatgtgttccagggcgatagcagcccatgctctgcatttgaatttcattgcctgtctggggaatgcatacatagctcctggaggtgtgacggagggccagattgtaaagacaagtcagacgaggagaattgcgccgtcgcaacatgcagacctgatgagtttcaatgcagtgatggaaactgtattcatggcagcaggcaatgcgaccgggaatatgactgcaaagacatgtccgatgaagtcggatgcgtcaacgttacgctgtgtgaaggccccaacaaatttaaatgtcacagtggggaatgcatcacactggataaagtttgtaatatggctcgagattgtcgcgactggagcgacgagccgattaaggaatgtggaacgaatgagtgcttggataataatggcggatgtagccatgtctgtaacgagctgaagattggctacgaatgcttgtgcccggacggcttccaactggtagcccagaggcgctgcgaggatatcgacgaatgtcaagaccccgacacgtgctcgcagttgtgtgtgaatctggaaggtggatacaaatgtcaatgcgaggagggctttcagctggaccctcacaccaaggcatgtaaggctgtaggcagtattgcgtacctctttttcacgaacagacacgaggtccgaaaaatgacgcttgacaggtcagaatatacttccttgattcccaatttgcgaaatgtcgtggcgcttgataccgaagtcgcatctaatcgcatttattggagtgatctcagtcagagaatgatctgctccactcagctggatagagcccatggcgtgagctcatacgacacagtgatttcccgtgacatacaggcaccagatggactggcagtagactggattcatagcaatatttactggacggactctgtcctggggactgtgagcgtagccgataccaagggcgtcaagaggaagactctgtttagggagaatggttccaagcctagggcaatagtggtggatccggtccacgggtttatgtactggactgattggggaacccctgctaaaatcaagaagggcggcttgaatggggtggacatctactcactggttacggaaaacattcaatggcctaacgggattacacttgatctgctgtctggccgattgtactgggtggattctaaacttcactccattagttctatcgacgtgaacggagggaatagaaagactatactagaggacgagaagcggctggcccaccccttcagcctggcagtgttcgaggataaggttttctggacggatatcataaacgaagcaatttttagtgctaaccggctgacaggcagcgacgtgaatctgctggctgaaaacctactgagcccagaggatatggtgttatttcacaacctgacgcagcctcgcggcgtgaattggtgcgaacgcaccactctttccaacggcggctgccagtacctctgtctgcctgccccacagatcaaccctcacagcccaaagtttacatgcgcctgcccagatggaatgttgctggcacgcgacatgcggagctgtttgaccgaggccgaggcagctgtggctacccaggagacatcaaccgttaggttaaaggtgtctagtaccgcggttcggacgcagcacaccactactcgaccagttcccgatacatcccgactgccaggggcaacgcctggattgaccacagttgaaattgtcaccatgagccatcaagccctgggcgatgtagccggccgggggaacgagaaaaagccgtccagcgtgcgtgccctgagtatagtgctgccaatagtgttacttgtgttcctctgcctcggggtctttctcttatggaaaaactggcgcctcaagaacatcaactcaatcaacttcgacaatccagtctatcagaagacaaccgaggatgaagtccatatttgtcataatcaggatggatacagctacccttcacgccaaatggtttcgctggaggacgacgtcgct

SEQ ID NO: 204 - DNA, 2580 bp, Artificial Sequence
  Description of Artificial Sequence: Synthetic Transcript Sequence
atgggaccgtggggatggaaattacgttggaccgtcgccctgctgctagccgccgccgggaccgccgtgggagacagatgcgagcggaatgagtttcagtgccaggacggcaagtgcatctcctacaaatgggtctgcgacgggagcgcagagtgccaagacgggtcggatgagtcacaggagacgtgtctatccgtgacgtgcaagagtggtgacttcagctgcgggggcagggtcaatagatgcatccctcaattctggcgctgtgatgggcaggttgactgcgacaacgggagtgatgagcaggggtgcccaccgaaaacctgttctcaggatgaattccgatgccacgatgggaagtgtatctctcggcaatttgtgtgcgatagcgatcgagattgtctggatggcagcgatgaagccagctgcccggtgctaacctgtggccctgcctcatttcagtgcaattcatctacgtgcatcccacagctgtgggcgtgcgataatgatccagactgtgaggacggctccgacgaatggccacagcgttgcagaggactctatgtgtttcaaggtgactcctcaccctgtagcgcgtttgaattccattgccttagtggcgagtgtatacactcctcatggcggtgtgatggcggtccagactgcaaggacaagtcagacgaggaaaattgtgccgtcgccacgtgcagaccggacgagttccagtgtagcgacggaaactgcatacacggtagcagacagtgtgacagggagtatgactgtaaagatatgagcgatgaggtaggatgtgtaaacgtcaccctctgcgaggggcccaataaatttaagtgccacagcggggaatgcattacgctggataaggtttgcaatatggcacgcgactgtcgtgattggtccgacgagcccataaaggagtgcggtacaaacgagtgcctagacaacaatggtggctgcagccacgtttgtaatgagctgaagataggttacgaatgcctctgtcctgacggttttcagctggtggcccagcgcaggtgcgaagatattgacgagtgccaagaccccgacacttgtagtcagctgtgcgtgaacctggaaggcggctataaatgtcagtgcgaggagggattccagctggacccacacacaaaagcatgcaaagcagtgggaagtattgcgtatttattcttcacaaatcgacacgaggttaggaaaatgacgttagaccgatcagagtacaccagtctaattcccaaccttcgtaatgtggtggcactggatacagaggtcgcatctaaccgcatctactggagcgatttgtctcaaaggatgatctgcagcacgcagctggaccgtgcacatggtgtgtccagctatgatacggtcatatcaagagacattcaggctccagatggcctcgcagtggattggatccacagcaacatttattggacagattccgtactcgggaccgtcagtgtggcggacacaaagggcgtgaaacggaagacccttttccgggaaaatgggtctaaaccacgagctattgtcgtagatcccgtacacggctttatgtattggaccgactgggggacacctgcgaaaatcaagaagggcggacttaacggagtcgacatatatagcctggtcaccgaaaatatccagtggcctaatgggatcacactcgatctgctgtccggtcggctatattgggtcgactccaagctgcatagcatcagttccattgatgtgaatggcggcaaccgtaagaccatcttagaagacgagaagcggctagcacacccattttcattagctgtgttcgaggataaggtgttttggacagacatcatcaacgaagccatattctcagccaatcgtctgactggatccgacgttaacctgctggctgagaaccttctatctccagaggatatggttctgttccataacctgactcagcccagaggagtcaattggtgtgagcggaccacactatcaaatggcggatgtcagtacttgtgcctgccagcgccccagataaatccgcactcacccaagtttacctgtgcctgcccggatggcatgctgctggcccgagacatgaggtcctgcctgacagaagctgaggccgccgtggccacgcaggaaacctccactgtgcgattaaaggtaagcagcaccgcagtcaggactcagcacaccacaacccgcccagtacctgatacctccaggctccctggtgccacgccgggcctgaccactgtggaaatcgttaccatgagccaccaggcattgggcgacgtagcgggacgggggaatgagaagaagccttccagtgtgcgcgcactgtccatcgtgcttccaattgtccttctggtctttctgtgtctcggggtattccttctctggaaaaactggagactgaagaatataaattctattaattttgacaacccagtatatcagaagaccaccgaggacgaggtgcacatctgccacaatcaggacggctactcatatccttcccgccagatggtgagcctggaggacgatgtggca

SEQ ID NO: 205 - DNA, 2580 bp, Artificial Sequence
  Description of Artificial Sequence: Synthetic Transcript Sequence
atgggaccatggggttggaaactccgatggactgtggccttgctcctggcggctgcaggaacagcggtgggcgatcgctgcgagcgaaacgagtttcagtgccaagatgggaagtgtatttcctacaagtgggtgtgcgatggaagcgctgaatgccaggacggtagcgacgagtctcaggaaacttgcctgtctgtaacctgcaaatccggcgattttagctgtggagggagggtgaatcgatgtattccgcagttttggcgctgtgacggacaggtcgactgtgacaatggcagcgatgagcaaggttgccctccaaagacctgttcccaggacgagttcaggtgccatgacggcaagtgcatcagtcggcagttcgtatgcgacagtgaccgcgattgcctggacggttctgacgaagccagctgtccagttttgacctgcgggcccgcaagtttccagtgtaattcctcaacctgcatcccccagctgtgggcgtgcgacaacgaccccgactgcgaggacggatcagacgaatggccccaaaggtgccggggcctgtacgtgtttcagggggactccagcccatgttctgccttcgagtttcactgcctgtcaggggagtgtattcacagctcttggcgctgtgatgggggtccagattgcaaggacaaatccgatgaagaaaactgcgccgttgctacctgtcgacctgacgaattccagtgttccgatggcaattgcatacatgggagtcggcaatgtgaccgcgaatacgattgcaaagacatgtcagatgaagttggttgtgtaaacgtcaccctgtgcgaagggcccaacaaattcaagtgccacagtggcgagtgtattactctggataaggtctgcaacatggccagagactgtcgagattggtccgatgagccgatcaaggaatgcggcaccaatgaatgtctggataataatggagggtgcagccacgtgtgcaatgaactgaagattgggtacgagtgcctgtgtcctgatggattccagctggtagctcagcggaggtgcgaggatattgacgaatgtcaggaccccgatacatgttcacaactgtgtgttaatctggagggcgggtacaaatgtcagtgcgaagaaggtttccagctcgatccccacaccaaggcgtgtaaggcggtggggtctattgcatacctcttctttacgaaccggcatgaagtgcggaaaatgactctcgacaggtccgaatatacatccctcataccaaacctgcgcaacgtggtcgcgttggatactgaggtggcttctaatcgcatttactggtccgatctgagtcagcgcatgatctgttcaacccaattggacagagcgcatggcgtgtcttcatacgacacagtcatttccagggacatccaggcgcccgatggtttggcagtcgactggatccattcaaatatctattggactgactccgtattgggtaccgtgagtgtcgccgatacaaagggagtcaaaaggaagaccctgtttagggaaaatggctccaagccacgcgctatagtcgtggacccagtgcacgggtttatgtactggaccgattggggaactcccgccaagatcaagaaaggaggcctgaacggtgtcgatatttattccctcgtgacagaaaatatacaatggcctaatgggatcaccttggacctgctgtccggccggctctattgggttgattccaagctgcactccatttcaagcatagatgtcaatgggggcaaccgcaagaccattcttgaggacgagaagcgcctcgcccaccctttctcactggccgtctttgaggataaggtgttttggaccgacatcattaatgaggcaattttcagcgcaaatcggctgacaggcagtgatgtgaacttgctggcagaaaatttgttgtcaccagaggacatggtgctgtttcacaaccttacgcagccccgaggggtgaactggtgcgagcgcacaaccctgtccaatggcggctgccagtacctttgccttcccgccccccagataaatcctcactctccgaagttcacatgcgcatgtcccgacgggatgctcctcgcgagggacatgcgctcctgcctcaccgaagccgaggctgcagtcgccacgcaggagactagcactgtcagactcaaagtgtcttccacagcagtgcgcactcagcacaccacaacccggccagtccccgataccagtagactgccgggtgccaccccaggccttacaaccgtcgagatcgtgaccatgtctcatcaggctctcggagacgtcgcaggaagaggaaatgagaagaaaccaagttccgtgcgagccctttccattgtcctgccgatagtgctgctggttttcctgtgtctgggggtattcctcttgtggaaaaattggagactcaagaatataaactctattaatttcgacaatcccgtctaccagaagacaaccgaagacgaagtacatatctgtcacaaccaggacgggtattcctatccatctaggcagatggtgagtctggaagatgacgttgca

SEQ ID NO: 206 - DNA, 2580 bp, Artificial Sequence
  Description of Artificial Sequence: Synthetic Transcript Sequence
atgggcccttggggctggaagctgaggtggacggtggcgctcctgctcgcggcggcgggaaccgccgtcggcgaccggtgcgagcgcaacgaatttcagtgtcaggacgggaaatgcatcagctacaagtgggtctgcgatggatctgcagagtgccaggatggctcagacgagagccaagaaacctgtctttccgttacttgtaaatcgggcgacttcagctgcggaggacgggtgaaccggtgcatcccacagttttggcggtgcgacggacaggtggattgtgacaatgggtccgacgaacaaggctgcccgccaaaaacttgctcccaagacgagttccgctgccatgatggaaagtgcatctcacgacaattcgtgtgcgattcggatcgggattgtctcgacggatcggatgaagcgtcgtgcccggtgctcacttgcggaccggccagctttcaatgcaattcgtcaacctgcatccctcagctgtgggcctgcgacaacgatccggactgcgaggatggatcggacgaatggccccaaagatgccgcggtctgtacgtgttccaaggtgactcctcaccgtgttcggcgttcgagttccactgtctcagcggggaatgcatccactcgtcatggaggtgcgacggtggtccagactgtaaggacaagtcggatgaagagaactgcgctgtcgccacgtgcaggcctgatgagtttcagtgctcggacggaaactgcattcacggaagccggcagtgcgaccgggagtacgattgcaaagacatgtccgatgaggttggttgtgtcaatgtcacgctctgtgagggaccgaataagttcaagtgccattccggagaatgtatcaccttggataaggtctgcaatatggcgagagactgccgcgactggagcgatgagccgatcaaagaatgcggaactaacgaatgtttggataacaatggcggctgtagccacgtgtgcaacgagctgaagattggatacgagtgcttgtgccctgatggatttcaactggtcgcacagagacggtgcgaggacatcgatgaatgccaggatcctgacacctgcagccagctctgtgtcaacttggagggaggatacaagtgccagtgtgaggagggctttcagctggacccgcacaccaaggcatgcaaggccgtggggtccatcgcctacctctttttcaccaataggcatgaagttcggaagatgacccttgaccggtcggaatatacttcgcttatcccgaatctccggaacgtggtggccctggatactgaggtggcatcgaaccgcatctactggtctgacctgagccagcggatgatctgctcgacccagctggaccgggcccacggagtgtcctcctacgacactgttatatcccgagacatccaggctccagacggactcgcggtcgattggatccattccaacatctactggaccgattccgtgctgggaactgtgtccgtggccgatactaaaggggtgaagcgcaagaccctgttccgcgagaacggatcgaagccgcgcgcgattgtggtcgaccctgtgcacggatttatgtattggaccgactggggtactccagccaagatcaagaaggggggactcaacggtgtggacatctactcacttgtgaccgaaaacatccaatggcccaacggcatcactcttgacctgctctcgggcagactgtactgggtggacagcaaactccatagcatatcctcaatcgacgtcaacggcggaaataggaaaacgatccttgaagatgagaaaagactcgcacacccattctcactcgcggtctttgaggataaagtgttctggaccgacatcattaacgaagcaatcttttcggccaaccgcctgactggatccgacgtgaacctgctggcagagaacttgttgtccccggaggacatggttctcttccataacctcacccagccccggggtgtcaactggtgcgaaagaaccactctctcgaacggtggctgtcaatacctgtgcctgcccgctccccagattaacccgcactctccgaagttcacttgtgcctgccccgatggaatgctcctggctcgcgacatgagatcatgcctcacggaggccgaggctgccgtggcaacgcaggaaacctccactgtcagactgaaggtgtcgagcaccgccgtgcggacccaacatactacgactagaccagtcccggacacctcgagactgccgggagctaccccgggcctgaccaccgtggaaatcgtgacgatgtcccaccaggcactgggagacgtggcgggacgcgggaatgagaaaaaaccttcgtcagtcagagctctcagcatcgtgcttcctatcgtgctgttggtgttcctttgtctgggagtgttcctcctttggaaaaactggagactcaagaatatcaattcgatcaattttgacaatccagtgtaccaaaaaacgactgaggatgaggtccacatctgccacaaccaggacggctactcatatcctagccgccaaatggtttcgctggaagatgacgtggcg

SEQ ID NO: 207 - DNA, 2580 bp, Artificial Sequence
  Description of Artificial Sequence: Synthetic Transcript Sequence
atgggcccatggggttggaagctgagatggaccgtggcgctgcttctcgcagcagcagggactgcagtgggtgacaggtgtgagcggaatgaattccaatgccaagatggaaaatgcatttcatacaaatgggtgtgcgacggaagcgcagagtgtcaagacgggtcagatgaaagccaggaaacttgcctttcggtcacttgtaagagcggagatttttcctgtggaggacgcgtgaacagatgtatccctcaattctggagatgcgacggtcaagtggactgcgataacgggtcggatgaacaaggatgtccacccaaaacttgcagccaggatgaatttaggtgtcacgatgggaagtgtattagcagacagttcgtgtgtgattccgatcgtgattgcctggatggtagcgacgaagcctcgtgcccggtgttgacttgtggacccgcctcatttcagtgtaactcgtccacttgtatacctcaactgtgggcatgcgacaacgatccagattgtgaggacggatcggacgaatggcctcaaaggtgcaggggactctacgtgtttcagggagactcaagcccatgctcagcattcgaatttcactgtctgtcgggtgaatgtatccatagctcgtggcgatgtgacggcggtcccgattgcaaggataagtccgatgaggaaaattgtgccgtcgcaacctgcaggccggatgagtttcaatgttccgatggtaactgtatccatggttcgcgccagtgtgatcgggaatacgattgtaaggacatgtccgacgaagtgggttgtgtcaatgtgaccctgtgtgaaggacctaacaaattcaagtgccattcaggagaatgtattaccttggacaaggtgtgcaacatggcacgcgactgcagagattggtcagatgaaccaataaaggagtgtggaaccaacgagtgcctggacaacaatggaggatgttcccacgtctgtaatgagcttaagatcggatacgaatgcctctgccctgatgggtttcagcttgtggcccaacgaagatgtgaagatatcgatgaatgtcaagaccctgatacttgcagccaactgtgtgtcaatctggaaggtggctacaaatgtcaatgtgaggaaggatttcaacttgatccacataccaaagcatgcaaggccgtgggctcgattgcatatctcttctttactaacagacatgaagtgaggaagatgacccttgatagatccgaatacacctccctcatacctaacctccgaaacgtcgtggccctcgacaccgaagttgcctcgaacagaatatactggtcggatcttagccagagaatgatctgttcaactcaacttgatagggcacatggcgtttccagctacgatactgtgatatcgcgggatattcaggcgcccgacggtcttgcggtggattggattcacagtaacatatactggactgattctgtgttggggactgtctcggtggctgatactaagggagtgaaacgtaaaaccctgtttcgcgaaaatgggtctaaacctcgggccatcgtggtggatcccgtgcatggttttatgtactggaccgactgggggactcctgcaaagataaagaagggcgggctgaatggcgtcgatatctacagccttgtgaccgagaatatccaatggccgaacggaatcacccttgatctgctttcggggagactctactgggtggatagcaaacttcattccatttcctctattgatgtgaatggtggcaaccgcaagaccatcctcgaagatgaaaagcgtctcgcacaccccttctcactggcagtattcgaggataaggtgttttggactgacattatcaatgaagctattttctcggccaacaggttgaccggaagcgacgtgaacttgctcgccgaaaatctcctttcccctgaggacatggtcctgtttcataacctcactcagcccaggggggtgaactggtgcgagcgcacgaccctttccaacggtggatgccagtacctttgtctgccagcaccccagataaaccctcattcgcccaagtttacctgtgcatgtcctgatgggatgcttctggctagagacatgcgtagctgtctgactgaggctgaggccgccgtggccacccaagaaaccagcactgtgaggcttaaggtgtcgtccactgcagtcaggacccagcataccactaccagacctgtgccagataccagcagactgccaggggccacccccggccttacgactgttgagatcgtgactatgtcgcaccaggcgctgggggatgtggccggaagagggaacgagaaaaagccatcctccgtcagggcactctccattgtgttgccaattgtcctgctggtgtttctctgtcttggcgtctttctcctttggaagaactggcggttgaaaaacattaactccatcaatttcgacaatccagtgtaccagaaaaccacggaggacgaagtgcacatatgtcataatcaagacgggtactcatacccttcgaggcagatggtgtcgctggaagatgatgtggca

SEQ ID NO: 208 - DNA, 2580 bp, Artificial Sequence
  Description of Artificial Sequence: Synthetic Transcript Sequence
atgggtccatggggatggaaactgaggtggacagtggccctcctccttgccgccgctggcacagcagtcggcgaccgatgtgagagaaacgaatttcagtgtcaggacggaaagtgtatctcttacaagtgggtctgcgatggatccgccgagtgccaggatggatcagacgaatcccaggagacctgcctgagtgtgacctgcaagtcaggagatttctcctgtggggggcgtgtcaaccgctgtatcccgcagttctggcgttgtgatggacaggtggattgtgacaacggctcggatgagcaaggatgtccacccaaaacatgctcacaggacgaatttagatgtcacgacgggaagtgcatctccaggcagttcgtatgcgatagcgatcgggattgtctggacggtagcgacgaggcgtcttgtcctgtcttgacctgtggcccagcgtcttttcagtgcaattccagcacctgtattcctcagttgtgggcttgcgataacgacccagactgtgaagacggctctgatgagtggccacagaggtgccgtgggctgtatgtgttccaaggagattcctccccgtgcagcgccttcgaattccactgcctgtccggcgagtgtattcattccagctggcgatgtgatggggggcccgactgtaaggataagagtgatgaagagaattgtgccgtggccacatgcagaccagacgaatttcagtgttctgacgggaattgcatccatggctctcgccagtgcgacagggagtatgactgcaaggatatgagcgatgaagtcggatgtgtcaacgtcaccttatgcgaaggtcccaataagttcaagtgtcattctggcgaatgcattacactggacaaggtatgtaatatggcacgtgactgtagagattggagcgacgagccaattaaggaatgcgggaccaacgagtgcctggataacaacgggggctgcagccacgtgtgtaatgagctgaaaataggatatgaatgcctgtgccctgatggtttccagctcgtggcgcagcggaggtgcgaagacatcgacgagtgtcaggatccggacacatgtagccaactctgcgtcaacttggagggcgggtataagtgccagtgcgaggagggcttccagctcgacccccacaccaaagcttgcaaagccgtaggctcaatcgcatacttattcttcacgaacaggcatgaagttcgaaaaatgaccttagaccggtccgaatacactagccttatcccaaatctgcgcaacgtggtggcgcttgacacagaagtggccagcaaccgtatatactggagtgacttgtcgcaaagaatgatttgctccacccagttggaccgggcccatggggtaagttcatacgacaccgtcatcagcagagacatacaggcacctgatgggctggcggtcgactggatacattctaacatctactggaccgattccgtcctcgggaccgtgtctgttgcagataccaaaggtgtaaagcgtaaaacactttttagagaaaatggctcaaagcccagagccatcgtcgtcgatccagtgcatggattcatgtactggaccgactggggaaccccagccaaaattaaaaagggcggcctgaacggggtggacatctactcactggtaaccgaaaacatccagtggccaaacggcattaccttagatctgctgtctggccgcctgtactgggttgattcaaagctccatagtatctctagtattgatgtcaatggggggaaccgtaagaccatcctggaagacgagaagcgcctcgcccaccctttcagtttggcagtgttcgaggataaagtcttttggacagacatcataaatgaagctatattcagcgctaatcgcttgaccggtagtgatgtgaatttgctggccgaaaacctactctcgcctgaagacatggtgctgtttcacaatctgacacagcctcgcggggttaattggtgcgagcgcacgacattgtccaatgggggctgccagtacctctgtctgcccgctccccagatcaatccacactctccaaaatttacatgcgcttgcccagacggcatgctcttagcacgggatatgaggtcttgtttgactgaagcggaagccgctgtagccacacaagagacatcaactgttcgactcaaggtcagctccactgcagtccgcacccagcataccacgactagacccgtcccagatacaagtcggttacccggcgcgacacccggtctgaccaccgtggagattgttactatgtctcaccaagcgcttggggatgtggcggggagggggaacgagaagaaaccgagttctgtgcgtgctctaagtatcgtgctccccattgtcctccttgtgttcctgtgcctcggagtctttcttttgtggaaaaactggcgccttaaaaacataaacagcatcaactttgacaatcctgtgtaccagaaaacaaccgaggacgaagtccacatatgtcataatcaggacgggtatagttacccatccaggcaaatggtgtcattggaggacgacgttgca

SEQ ID NO: 209 - DNA, 2580 bp, Artificial Sequence
  Description of Artificial Sequence: Synthetic Transcript Sequence
atggggccctggggctggaaactgaggtggactgttgcacttctgctcgcggcagccggtacagcagtaggagatcgatgcgaacgaaacgagtttcaatgccaggacggcaaatgtatatcatataaatgggtctgcgacggaagcgcagagtgtcaagatgggtcagatgagtctcaagaaacatgcctgagcgtgacctgtaagagcggcgatttctcctgcggcggaagggttaataggtgtatcccccagttctggagatgcgatggccaagttgattgtgataacggttccgatgaacaaggatgtccacccaaaacctgctcccaggacgaattccgttgccatgacggaaaatgtatttcacgacaatttgtttgtgatagtgaccgtgattgtttggatggctcagatgaagcttcgtgtccagttcttacttgcggaccagcgtccttccagtgtaactcgagcacctgtattccgcagctttgggcatgcgacaacgatcccgattgcgaggatggctcagacgagtggccacagaggtgcaggggactatacgtgttccagggggattccagtccatgttctgcctttgaatttcactgtctgtcaggggaatgcattcactccagttggaggtgcgatgggggaccagattgcaaagataagagcgatgaggagaattgtgccgtggccacttgccggcccgacgagtttcaatgtagtgatggaaattgtattcacggatctcgacagtgtgaccgagagtatgactgcaaggatatgtccgacgaggtgggatgtgtaaacgtcaccctgtgtgaaggtccaaacaaattcaagtgccacagcggcgaatgtatcacactggacaaggtatgtaacatggctagggattgccgagattggtctgacgagccaattaaggagtgtggcacaaacgagtgcctggataacaatggtgggtgcagtcatgtgtgcaatgaactgaaaatcgggtacgaatgcctttgcccagatggctttcagctagtggcccagaggagatgcgaagacatcgatgagtgtcaagacccagatacatgtagccagctgtgtgtaaacctcgaaggaggatacaagtgtcagtgtgaggaaggcttccagctggacccgcacaccaaggcttgtaaggccgttggatctatagcttacctcttttttaccaataggcacgaggtacggaagatgaccctggacaggagtgaatatacatccttgatacctaacctcaggaatgtggtagcgttggacacagaggtggcttccaaccgtatttactggtccgacctgtcccagcgcatgatttgtagtacccagctcgacagggcccatggagtctcaagttatgataccgtcatttctagggatatacaggctcccgatggcctggcggttgattggattcattcaaacatctactggaccgattccgtcctcggcaccgtgagtgtcgccgacacgaagggggtcaagcggaagactctgttcagggagaacggttccaaaccgcgtgccattgtagtggaccccgtgcacggttttatgtactggacggactggggcaccccagcaaaaattaagaaaggcggattgaacggtgtggatatctacagcttggttaccgaaaatatccagtggcctaatggcattacattggacctccttagcggcaggctctattgggttgatagcaaactccacagtattagctccatcgatgtgaacgggggcaatcgaaaaacaatccttgaggatgagaaaagattggcccatcctttcagtctggctgtttttgaagataaagtcttctggacagatattatcaacgaagctatattctccgcgaatagattgaccggcagcgacgttaacctattagccgagaaccttctgagccccgaagacatggtcctatttcataacctcacccaacccagaggcgtgaattggtgcgaacgtacgactctctctaacggcggctgccagtacctttgtctcccagctccacaaatcaacccccactctccaaaatttacgtgcgcatgtcctgacggcatgttgctggctcgtgacatgcgaagctgcctgacagaagccgaagctgcagtggctacacaggagacgagtacagtgcgactgaaggtgtcttcaacagccgtcagaacgcagcacaccactacccggccagtgcccgatacttccagactgcccggcgccactccaggcctgaccaccgttgaaatcgtgacgatgtcacatcaggccctgggggatgttgcagggagaggaaacgaaaagaagccctccagcgtgcgtgctctcagcattgtgttacctatagtactcctagtcttcttatgtctgggtgttttcttactatggaagaactggagacttaaaaacatcaactcgatcaacttcgacaacccggtgtaccaaaaaactacagaggatgaggttcacatctgtcacaaccaagatggctactcctacccctcacggcagatggtttcgttggaggatgatgtcgct

SEQ ID NO: 210 - DNA, 2580 bp, Artificial Sequence
  Description of Artificial Sequence: Synthetic Transcript Sequence
atgggtccgtggggttggaagctgcgttggactgtagctctgctcttggcagcggctggcacagcagtaggtgacagatgtgagcgtaatgaatttcaatgtcaagatggtaagtgcatatcttataagtgggtctgcgatggtagcgcagagtgccaagatggttctgatgagagccaggagacctgcttgtccgttacctgcaagtccggggattttagctgcggtggccgcgtcaatcgttgtataccgcagttttggcgatgcgacggtcaggtcgattgcgataatggctctgatgagcagggctgccctcccaagacctgtagccaagatgagtttaggtgtcatgacggcaagtgcataagccgccagttcgtgtgcgactctgatcgtgactgtctggacgggtccgacgaagccagctgtccggtccttacctgcggcccggctagcttccagtgcaacagcagcacctgtatcccccagttgtgggcgtgcgacaatgatccagactgcgaggacggtagcgatgaatggcctcagcgttgtcgcggtctgtatgttttccagggcgattcgtccccatgtagtgcattcgagtttcattgcttgtcgggtgagtgcatccacagctcgtggcgttgcgacgggggtccggattgcaaggataagagcgacgaggagaattgcgcggtggcgacctgccgcccggatgaattccagtgcagcgacggcaattgtatccatggctctcgccaatgcgaccgcgagtatgactgtaaagatatgagcgacgaggtcggctgcgtgaatgttaccctgtgtgaggggcccaataagttcaagtgtcacagcggcgaatgtatcaccctggataaggtatgtaatatggcgcgtgactgtcgcgactggagcgatgaaccgatcaaggagtgcgggactaatgagtgcctcgataataatggtggttgtagccacgtctgcaatgagttgaagattggatacgagtgtctctgccctgatggctttcagctggtggcacaacgtcgctgtgaggacatcgatgaatgtcaggacccagatacttgcagccagctgtgcgtcaatctggaaggcgggtataaatgtcagtgtgaagaaggcttccaattggaccctcacacaaaagcatgtaaggcagttggttcgatcgcgtaccttttctttacgaaccgccacgaagtaaggaaaatgacgttggatcgatcagaatatacctcactgattcctaatctgcgcaacgttgtggccctcgacaccgaggtggctagcaaccgcatttattggtctgacttgagccaacgcatgatttgcagcacccagttagaccgtgcccacggtgttagctcctatgacacggttattagccgcgacatccaagctcctgatggtctggctgtggactggatccattccaatatttactggacggactctgtcctcggcaccgtcagcgtagcagacaccaagggcgtcaaacggaaaacactgtttcgcgaaaacggcagcaagccgcgcgcgatcgtggttgaccctgtccacggcttcatgtactggacagactggggtacccctgctaaaattaagaagggtggtctgaatggtgtcgatatttacagcctggtaacagagaacattcaatggcctaacggcatcaccctggacctgctgagcggccgcttgtactgggtggattccaagctgcactccatttcttctattgatgtcaatggcggcaatcgcaaaacgattctggaggatgagaaacgcctcgcccacccatttagcctggccgttttcgaagataaagtgttctggactgatataatcaatgaagctattttcagcgcaaatcgactgactggtagtgacgtgaatttgttggcagagaatctgctgagccctgaagacatggtgctgttccataacttaacccaaccgcggggtgtgaattggtgcgaaagaactaccctgtccaacggtggctgtcagtacctgtgcctccctgccccccagattaatccacactctcccaagtttacctgtgcatgcccggatgggatgctgctggcaagggatatgcgctcctgcctgaccgaagccgaggcagccgttgctacccaagagacgagcaccgtgcgcctgaaagtcagctccactgcggttaggactcagcacacgactacgcgccctgtcccggacacgagccgcttgcctggtgcgaccccaggcctgaccactgtggagattgtgaccatgagccatcaagcgttgggggacgtggccggccgcggcaatgagaagaagccttcctcagtgcgcgctctgtctattgtgctgcctattgtgctcctggtcttcttgtgccttggcgtgttcctactgtggaaaaactggaggcttaagaacatcaacagcattaatttcgacaatccggtgtaccagaaaacgaccgaggatgaagttcacatttgccataaccaggatggctactcataccctagccggcaaatggtgagcctggaggatgatgtggct

SEQ ID NO: 211 - DNA, 2580 bp, Artificial Sequence
  Description of Artificial Sequence: Synthetic Transcript Sequence
atggggccttgggggtggaaactacgctggacagtcgccctgctgttagctgccgccggaactgcagtgggagacaggtgcgaacggaatgaatttcagtgccaggatgggaagtgtatatcttataaatgggtgtgcgatggatcagcagagtgtcaggatggaagtgatgagtctcaggaaacatgtttaagtgtcacgtgcaaatccggagatttctcatgcggggggcgggttaatcgatgtatcccacagttctggcgctgtgatggacaagttgattgtgacaacggatctgatgaacaggggtgcccaccaaaaacatgctctcaggatgaattccggtgtcatgacgggaagtgcatctcacggcagtttgtttgtgattctgacagagattgtcttgacgggtctgatgaggcttcgtgtccagtactgacttgtgggcctgcttctttccagtgcaattcttcaacatgcatcccacagctgtgggcttgtgataatgatccagattgtgaagatgggtcagatgaatggccccagcgatgtaggggactctatgtatttcagggggattcttcgccatgttccgcattcgagtttcactgtctgtcaggggaatgtatacactcttcctggagatgtgatgggggacctgattgcaaagataagagtgatgaggaaaattgcgccgtggccacttgcaggcctgacgaatttcagtgttcagatgggaactgtattcatgggtcaagacagtgcgatcgggaatacgattgtaaggatatgtctgatgaggtgggatgcgtaaacgtgacattatgcgagggacctaataaattcaaatgtcactcaggggaatgcataacacttgacaaagtgtgcaatatggcccgggactgtagggattggtcagatgaacctatcaaggagtgcgggactaatgaatgtctcgataacaatggagggtgctctcatgtatgcaatgaacttaaaataggatacgaatgcctatgcccagatggatttcagctggttgcccagaggcggtgtgaagatatcgacgaatgtcaggaccctgatacgtgttctcagttatgtgtgaacctcgagggaggatataaatgccagtgcgaagaaggattccagctcgacccccatacaaaagcatgtaaagctgtcgggagtatagcttatctgttttttacaaacaggcatgaagtccggaaaatgacattagatcgctccgaatatacatccctgataccaaatcttcgaaatgtggttgccctcgatactgaagtggcatcgaatcgcatctactggtccgatctgtctcaaaggatgatctgcagtacacagctagatcgggcccacggagtgtcaagttatgatactgtgatttctagggatattcaggcgccagatggactagctgtcgattggatacactcaaatatctattggactgattcagtattgggaacagtgtccgtagcagatacaaaaggggtcaaaaggaaaactcttttcagagaaaacgggtcaaaaccccgagccatagtggtggatccagttcatggattcatgtattggacagattggggaacaccggcgaaaatcaaaaaaggaggactcaacggagtggatatctattcacttgtcactgaaaatatacagtggccaaatggaataacactagatctactctctgggcggttatattgggttgattcaaaactacacagtatctcatccatcgatgtgaatggaggaaatagaaaaacaatcctcgaggatgagaagaggctggctcacccattttcattagccgtttttgaagacaaagttttctggacagacattatcaatgaggctatattctctgccaatagactgacaggatctgatgtgaacctccttgcagaaaacttattgtctcccgaggacatggtgctgttccataatttgactcagcctcggggggttaactggtgcgaacgaacaactctgtccaacggggggtgtcagtatctttgtttgcccgctccacagatcaatccccactccccaaaattcacatgcgcatgccctgatggaatgctactagcccgggatatgagaagttgcttgacagaagctgaagccgctgttgctactcaggaaactagtacagtcaggcttaaagtgtccagtactgccgtgcggactcagcacacaactactagaccagtgccagatacttctaggttacctggggctacacctgggctaactactgtagaaattgtgacaatgtcacaccaggctctaggggacgtggctgggcgcgggaacgaaaagaaaccttcatccgtgagagcactatctatagtattaccaatagtccttttagttttcctttgccttggagtgttcctcctctggaagaactggaggctgaaaaacattaactctatcaactttgacaatccggtgtatcagaagacaacagaagatgaggttcacatatgtcacaatcaggatggatattcctatccatcacgtcagatggtaagtctcgaagatgatgtagcc

SEQ ID NO: 212 - DNA, 2580 bp, Artificial Sequence
  Description of Artificial Sequence: Synthetic Transcript Sequence
atgggaccgtggggctggaagctgcgctggaccgtcgctctgctcctcgctgcagcaggaaccgctgtgggagatcgttgcgaaagaaatgaattccagtgccaggacggtaaatgcatctcgtacaagtgggtgtgcgacggatccgcggagtgtcaagacggctcagacgaatcacaagaaacctgtctgtcagtgacgtgtaagtcgggggatttctcctgcggcggaagagtcaacagatgcatacctcagttttggaggtgcgatggacaggtggattgcgacaatggctccgacgagcaaggctgtccgcccaagacgtgctcccaggacgagttccgctgtcacgatggaaagtgcatctcgcggcaatttgtctgtgatagcgatcgggactgcctcgacggaagcgatgaggcctcgtgcccagtgctgacttgcggtcctgctagcttccagtgcaacagctcgacttgcatcccacagttgtgggcctgcgacaacgatccggattgcgaggacggatccgacgaatggccgcaacgctgcagaggactgtacgtctttcagggagactcgtctccttgctcggcgtttgagttccattgcctttccggtgagtgtatccactcaagttggcggtgcgatggtggacccgactgcaaagacaaaagtgacgaagagaactgtgcagttgctacttgcagaccggacgagttccagtgctccgatggaaattgtatccacggctcccgacaatgtgatcgggaatacgattgtaaggacatgtcagacgaagtgggttgcgtcaacgtgactttgtgtgagggcccaaacaagttcaaatgtcattcaggagaatgtattaccctggacaaggtctgcaatatggcgcgcgattgtcgggattggtcggacgagccgatcaaagaatgtggaacgaacgagtgccttgacaataacggtggatgttctcacgtgtgcaacgagctcaagatcggatatgaatgcctctgcccagacggcttccagctcgtggcgcaaaggcggtgcgaggacatcgacgaatgccaggaccctgacacttgctcgcaactttgcgttaatctggaaggggggtacaagtgccagtgcgaggaggggttccaactggatccccacaccaaagcgtgcaaagccgtgggatcgattgcctacctgttcttcaccaatcgccacgaagttcggaagatgactctggaccggtccgaatacacctccctgatcccgaacctccgcaacgtggtggctcttgatacggaagtggcttccaaccgcatctactggtcggacctgtcgcagcgcatgatttgctccactcagttggacagggcgcatggcgtgtcgtcgtatgacaccgtgatttccagagacatccaggccccagacggactcgccgtcgattggatccactcaaatatctactggaccgactcagtcctcggaactgtctcggtcgccgacactaagggcgtcaaacgcaagacgttgttcagggaaaacggatctaagccgcgcgccattgtggtggatccggttcacggctttatgtactggaccgattggggcactccagcgaaaatcaaaaagggaggacttaatggagtggatatctatagcctggtgactgaaaacatccagtggcccaatggcataaccttggatctgttgtcgggtcgtctttactgggtggattccaaactgcattcaatctccagcatcgacgtgaacggcgggaaccgaaagaccattctcgaagatgaaaagcggcttgcccacccgttctcactggccgtgtttgaggacaaagtgttctggaccgatatcatcaacgaagcgatcttctccgcaaaccggctgaccggctctgacgtcaatctgctggccgaaaacctgctgagcccggaggacatggtactgttccataacctgacccagccgcgcggcgttaattggtgcgagcgcaccactttgtcaaacggggggtgccagtatctgtgtttgcctgctccacagattaatccacattcgcctaagttcacctgtgcatgccctgacggaatgctgctggctcgggacatgagatcatgccttactgaagccgaagccgccgtggcaacgcaggaaacttcgactgtgcgactgaaggtgtcctctactgccgtcagaacccaacacaccacgacccggccagtcccggacacttcacggctgccaggcgcgactcccggcctcaccaccgtagagatcgtgaccatgtcgcatcaagcccttggagatgtggcgggtcgcggtaatgagaagaagccatcctctgtgcgcgccctgtcaatcgtgctgccgatcgttctgctcgtctttttgtgcctgggggtgttcctgttgtggaagaattggcgactcaagaacatcaatagcatcaactttgataacccagtgtaccaaaagactaccgaagatgaagtacacatctgtcacaaccaagacggctactcctacccatccagacagatggtgagcctcgaggatgacgtggct

SEQ ID NO: 213 - DNA, 2580 bp, Artificial Sequence
  Description of Artificial Sequence: Synthetic Transcript Sequence
atgggtccctggggatggaagttgcgatggaccgtggcgctgctgcttgcggcagcaggcacggcggtgggagatcgttgtgaacgaaacgaattccaatgtcaggacggaaagtgcatttcttacaagtgggtctgtgatggctcggcagagtgtcaggatggatcagatgagtcgcaagaaacctgtctcagcgtgacctgcaagtccggggacttctcctgtggtggaagagtgaacaggtgtatcccacagttctggcggtgcgatggtcaggttgattgcgataatggctccgatgagcaaggctgtccgcccaagacctgttcacaggacgaattccggtgccacgacggcaagtgcatcagccgccaatttgtatgcgattcagatcgcgattgtcttgatggtagcgacgaagccagctgtccagtgctgacctgcggtcctgcatcattccaatgtaactcaagcacttgtattccccagctttgggcctgtgataacgatcctgactgtgaagatggatcggacgaatggcctcagagatgtaggggactgtacgtgtttcaaggagactcatcaccctgttcggcattcgaattccactgtctttccggagagtgtattcactcgtcctggagatgcgacgggggtcctgattgcaaagataaaagcgatgaggagaattgcgcagtcgccacttgtagaccagacgaatttcagtgtagcgatggaaattgtattcatggatcgcgacagtgtgatagggaatacgactgtaaagatatgtccgatgaagtcgggtgtgtgaacgtgaccttgtgcgaaggacccaataagtttaagtgtcattccggtgaatgtataacgctggataaggtctgtaatatggcacgtgattgccgcgactggtcagacgaacccatcaaagaatgtggaaccaacgagtgcctcgataacaacggggggtgttcgcatgtgtgtaacgagctcaagattggttacgaatgtctttgtccggatggatttcaacttgtggcacaaagacgttgtgaagatatcgatgaatgccaggatcctgacacttgctcacaactctgcgtgaacctggaaggaggatacaagtgtcaatgtgaagaaggctttcaacttgaccctcataccaaagcatgcaaggccgtcggatcaattgcataccttttcttcaccaacagacacgaggtgcgcaagatgactctggatagatcagaatacacttcgttgatacctaatcttcgaaacgtggttgcactcgataccgaagtcgcctctaatcggatctactggtcagatctgagtcaaagaatgatttgctccacccaactcgatcgggcccatggagtcagctcctatgacactgtgatcagcagagacattcaagctcccgatggactggcggttgattggattcattctaatatctactggactgactcagtgttgggtaccgtgtcggtggccgataccaaaggagttaagcgtaagacgctttttcgagaaaatggatccaagcctagggcaatcgtcgtcgatccagtgcatgggtttatgtactggaccgattggggaactccagcgaagatcaaaaaggggggacttaatggagtggatatctattcacttgtcactgagaacattcagtggccaaatggtatcacccttgatctgctgtcgggcaggctttactgggtggatagcaaacttcattcgatttcctccattgacgtgaacggaggtaatcggaaaaccatactggaggatgaaaaaagactcgcacatcctttctcgctggcagtctttgaggacaaagttttttggaccgatatcattaacgaggcaattttctccgcaaatcgacttactggctccgacgtaaatcttcttgcagagaacttgctctcacccgaggatatggtcctctttcataatctgacccagccaagaggtgtgaactggtgcgagaggaccacgctctcgaacggcggctgtcagtacctctgcctcccagcgccgcaaatcaaccctcactccccaaagtttacgtgtgcgtgtcctgatggcatgttgctggcaagagatatgagatcatgcctcactgaagccgaggccgccgtggcaactcaggagacttccactgtgcgattgaaggtgtcgtcgacggcagttcggacccaacacaccaccactagaccagtgcccgatacctcacggctgcctggagcaacccccggactgactacggtcgagattgtgactatgtcgcaccaggcactgggtgacgtcgccggtagaggaaatgaaaagaagccatcatcggttagggctctttcgattgtgcttccaatcgtgttgctggtgttcctttgcctgggagtctttcttctgtggaagaactggcggctcaaaaacattaacagcattaactttgacaatcccgtttaccagaaaacgaccgaggatgaagtccacatttgtcataatcaagatggttacagttacccatcgagacagatggtgtcgttggaggatgatgtggca

SEQ ID NO: 214 - DNA, 2580 bp, Artificial Sequence
  Description of Artificial Sequence: Synthetic Transcript Sequence
atgggcccctggggatggaagttgcgttggaccgtagctttgttgctggcagcagcaggaactgcagtgggtgacagatgcgagcgcaatgaatttcagtgccaggatggaaagtgcatcagctacaagtgggtgtgcgacgggagcgccgagtgccaagacggctcggacgaatcccaggaaacttgcctcagcgtgacctgcaaaagcggagactttagctgcgggggccgtgtgaacagatgtatcccgcagttctggcggtgtgatggacaggtcgactgcgacaacggttctgacgagcagggatgccctcctaaaacgtgttcccaggacgaatttaggtgccatgatggaaaatgcatctcaaggcaattcgtgtgtgactcggaccgcgactgcctcgatggatcagatgaggcgagctgccctgtgctcacctgtggacctgcctccttccagtgcaatagcagcacttgcatcccgcagctgtgggcctgtgataacgacccggactgcgaggatggatcggatgaatggccgcagaggtgccgcgggctgtacgtgttccaaggagattcgagcccatgctcggctttcgaattccactgcctttcaggagaatgcatccactccagctggcgctgtgatgggggccccgactgcaaggataagagcgatgaggagaactgcgctgtcgcgacctgcaggccagatgagttccaatgttccgatggaaactgtatccatggttcgcgccagtgcgatagagaatacgactgtaaggacatgagcgatgaggtcggttgcgtgaacgtcaccctgtgcgaaggaccaaacaaattcaagtgccattcgggagagtgtatcaccctggacaaggtctgcaatatggcaagagactgccgggattggtcagacgaaccgattaaggaatgcggaaccaatgaatgcctcgacaataacggaggttgttcccacgtgtgtaacgagctcaagatcggatacgaatgcttgtgcccagacgggttccaactcgtcgctcagagaaggtgcgaggacatcgacgaatgccaggatccagacacgtgctcacagctgtgtgtgaacctggaaggcggatacaaatgtcaatgcgaggagggtttccagctggacccgcacactaaggcatgtaaggccgttggatcgatcgcttacctgtttttcacgaatcggcacgaagttcgcaagatgactttggacagatctgaatacacctccctcattccgaatttgagaaacgtcgtggcacttgatacggaagtggcctcgaaccgcatatactggtcggacctttcgcaaagaatgatctgctcaactcaactggaccgcgcccacggggtgagttcttacgacaccgtcatctcgagggatatacaggcgccagacggcctggccgtcgattggatccactctaacatctactggaccgattcagtcctgggaactgtgtctgtcgcggacactaagggtgtgaaacgcaagactcttttccgggagaatggatccaaaccacgcgcaatcgtagtagatccagtccatggctttatgtactggacggactggggtactccggcgaagatcaagaaaggcgggctcaatggtgtggatatctattccctcgtgaccgaaaacattcaatggcccaacggcatcacccttgacctgctctccgggcgactgtactgggtggacagtaaactgcactcgatcagcagcatcgacgtgaatggcggaaatcgcaagactatcctggaggatgagaagcgcctcgcccatccgttctccctggcagtttttgaagataaggtgttctggaccgatatcattaacgaagcgatcttttcggccaatcggctgactgggtcggacgtcaacctgttggccgaaaacctgctctccccagaagatatggtactcttccacaatctgacccaaccgagaggggttaactggtgtgaacgcactaccctgtccaacggaggatgtcaatatctgtgcctgccggccccgcagataaacccgcatagccctaagttcacttgtgcctgcccagatggaatgcttctggcccgagatatgcgcagctgcctcaccgaggctgaagccgcagtggcgactcaggagacttccaccgttcggctgaaggtgtcatcgacggcggtgcggacccagcacacgaccacccggcctgtgccagacacttcacggctgccgggtgcgacccccggccttactaccgtggagattgtgactatgtcccaccaggccttgggcgacgtggctggaaggggaaatgagaagaaaccgtccagcgtgcgcgccctgtcaattgtcttgccgattgtcctcctcgttttcctgtgcctgggcgtgttcctgctgtggaaaaactggcggctgaagaacatcaacagcatcaattttgacaaccctgtgtaccaaaagaccactgaggatgaagtgcatatctgccacaaccaggacggatactcatacccctcgcggcagatggtgtcgctcgaggacgacgtcgct

SEQ ID NO: 215 - DNA, 2580 bp, Artificial Sequence
  Description of Artificial Sequence: Synthetic Transcript Sequence
atggggccgtggggctggaagttgcgctggaccgtggcgctcctcctcgcggccgccggaacggccgtgggggatcgctgcgaacggaatgaattccagtgccaagatggcaagtgcatctcgtacaagtgggtgtgcgacggctcagcagagtgccaggacggaagcgacgaatcccaggaaacctgcctgtcggtgacctgtaaatccggagacttcagctgcggaggtcgggtgaatcgctgcatccctcagttctggaggtgtgacggacaggtcgactgcgacaatggctcggatgagcagggatgcccgccaaagacctgctcgcaggacgaatttcgctgccacgacggaaagtgtatctcccgtcaattcgtctgtgattcggacagagactgcctggacggatccgatgaggcgtcgtgcccggtgctcacctgcggacccgcatccttccagtgcaactcctcaacgtgcatcccgcagctgtgggcttgcgacaatgacccagactgcgaagatgggagcgacgaatggccacagcgctgcaggggactgtacgtgttccaaggagactcgtccccatgctccgcattcgagttccactgtctcagcggagagtgcattcacagctcgtggagatgcgacgggggtccggactgcaaggacaagtccgacgaggaaaattgtgccgtcgcaacttgccggccggacgagttccagtgttccgacggaaattgtatccacggatcgcgacaatgtgatcgcgagtacgattgcaaagacatgagcgatgaagtgggatgcgtcaatgtgaccctgtgcgagggaccgaacaagttcaaatgccacagtggagaatgtattactctcgataaagtgtgcaatatggcgcgggactgccgcgactggtcggacgaaccaattaaggaatgcggaaccaacgaatgcttggataacaacggaggctgcagccacgtgtgcaacgagcttaagatcggctacgagtgcttgtgcccggacggatttcaactggtagcgcaaagacgatgcgaagatatcgacgagtgtcaagaccctgatacctgctcacaactgtgcgtgaatctggaaggagggtacaagtgccagtgtgaagagggatttcagctcgaccctcacactaaggcatgtaaggcagtcggctcgatcgcatacctgttctttactaatagacatgaggtgagaaagatgacccttgaccggtcggagtacacgtcgctcataccgaacctccggaacgtggtggcgttggataccgaggtggcatcgaatcgcatctactggtcggatctgtcacagcggatgatttgttcaacccaacttgacagagcgcacggagtgtcctcgtacgatactgtgatcagccgcgacattcaagccccagatggacttgccgtggactggatccactccaacatctattggaccgactccgtcctcggcactgtgtcagtggccgatactaagggagtgaagcgcaaaactctgtttcgcgagaacggctcgaagcccagagccatcgtggtcgacccagtccatggattcatgtattggaccgattggggaactcccgctaaaatcaagaagggaggactcaacggcgttgacatctactccctcgtgactgagaatatccagtggcctaatggaattaccctggatctgctctccggccgcctgtactgggtggactccaagctgcattcaatttcttccatcgacgtcaacggaggaaaccggaaaacgatccttgaggacgagaaacggctcgcgcacccgttttcgctggcggtgtttgaggacaaagtgttctggacggacatcatcaacgaagccatctttagcgcgaatcggctgaccggatccgacgtgaatctcctggccgaaaacctgttgagcccggaagatatggtgctgttccataacctgacccagccgagaggagtgaattggtgtgagcgcaccaccctgtccaacggaggatgccaatacctgtgccttccagctccccagattaacccacattccccgaagtttacctgcgcttgcccagatggcatgctgctggcccgcgacatgagatcatgtttgactgaagccgaagccgcggtggcgacgcaggaaacgtcgactgtcagactcaaggtgtcaagcactgcagtccgcactcagcataccactacccggccagtgccagacacctcaagacttccaggagcgaccccgggactcaccaccgtggagatcgtgactatgtcccatcaagcgctcggtgacgtggccggacgcggcaacgagaaaaaaccatcgtcggtgagggccttgtccatcgtcctgccgattgtcctcctcgtgttcctctgtctgggggtctttctcctctggaagaactggagactgaaaaacataaacagcatcaacttcgacaaccctgtgtaccagaaaaccactgaagatgaagtccatatttgtcataatcaggatggatactcatacccctccagacagatggtttccctggaagatgatgtggcc

SEQ ID NO: 216 - DNA, 2580 bp, Artificial Sequence
  Description of Artificial Sequence: Synthetic Transcript Sequence
atgggaccatggggatggaaacttagatggacagttgcattacttctcgcagcagctggaacagcagttggagatagatgcgaacgtaatgaatttcaatgtcaagatggaaagtgtatttcatataagtgggtttgtgacgggtcagctgaatgtcaagatggttctgatgaatctcaagagacatgtttatcagttacttgtaagtcaggagatttttcttgtggtggtagagttaacagatgtattcctcaattttggagatgtgatgggcaagtagattgtgataatggaagtgatgaacaaggttgtcctccaaaaacttgttcacaagacgaatttagatgccacgatggaaaatgtattagtagacagttcgtatgtgattctgatagagattgtttagatggttctgatgaagcttcatgtcctgttttgacatgtggtccagcttcatttcaatgtaatagttctacctgtattccacaattatgggcttgtgataatgatccagattgcgaagatggtagtgatgaatggcctcaaagatgtagaggattatatgtttttcaaggagatagttctccatgttcagcttttgaatttcattgtttatcaggtgaatgtattcacagtagttggagatgtgatggaggacctgattgtaaagataagtcagatgaagaaaattgtgctgttgcaacctgtcgaccagacgaatttcagtgtagtgatggtaattgtattcatggaagtagacaatgcgatagagaatatgattgcaaagatatgagtgacgaagttggatgtgttaacgttactttgtgtgaaggacctaataagttcaaatgtcattcaggtgaatgtattacattagataaggtttgtaatatggcaagagattgtagagattggagtgatgaaccaattaaagaatgtggaacaaatgaatgtcttgataataatggaggatgttcacacgtttgtaatgaattaaaaattggatatgaatgtctttgtccagatggatttcagcttgttgcacaaaggagatgtgaagatatagatgaatgtcaagatccagatacttgttctcaactttgtgtcaatttagagggaggatataaatgccaatgtgaggaaggatttcaattagatcctcatacaaaagcttgtaaagctgtaggaagtatagcatatcttttttttacgaatagacatgaagttagaaaaatgacattggatagatcagaatacactagtcttattcctaatttacgaaatgttgttgctttagatactgaagtcgcatcaaatcgtatttattggtccgatttgtctcaaagaatgatttgttcaacacaattagatagagctcatggagtttctagttatgatactgtaatatcaagagatatccaagctccagatggattagctgtcgattggattcattctaatatttattggacagatagtgtgttaggtacagtttctgttgcagatacaaaaggagttaaaagaaaaacattatttagggaaaatggaagtaaaccaagagcaattgttgttgatcctgttcatggatttatgtattggactgattggggtacaccagcaaaaatcaagaaaggaggattaaatggtgtagatatatacagtttagtaactgaaaatatacagtggccaaacggtatcactcttgatttactatcaggacgattatattgggttgattctaaacttcattcaataagttctattgatgttaatggaggtaatagaaaaactattttggaagatgaaaaacgacttgctcacccattctcattggctgtatttgaagataaagtattttggacagatattattaatgaagcaattttctcagctaatagattaacaggatctgatgttaatcttttagctgaaaatcttctttcaccagaagatatggtcctttttcataatttaactcaaccaagaggtgtcaattggtgtgaaagaacaactttatctaatggaggttgccaatatttatgtcttccagctcctcaaattaacccacatagtccaaaatttacgtgtgcatgtccagacggaatgcttttagctcgagatatgagatcatgtttaactgaagcagaagctgctgtagctacacaagaaacttcaactgttagattaaaagtttcgtctactgctgttcgtacacaacatactactacacgacctgttcctgatacttcacgattaccaggtgctacaccaggacttacaacagttgaaattgtaacaatgtcacatcaagcattaggtgatgtagctggacgtggaaatgaaaaaaaaccatcttcagttagagcattgtcgatagttttaccaattgttcttttagtttttctttgtttaggtgtatttttactttggaaaaactggagattaaaaaatattaatagtataaattttgataatcctgtttaccaaaagactacagaagatgaagtacatatttgtcataatcaagatggatacagttacccatcaagacaaatggtttcattagaagatgatgtagca

SEQ ID NO: 217 - DNA, 2580 bp, Artificial Sequence
  Description of Artificial Sequence: Synthetic Transcript Sequence
atggggccatggggctggaagctgagatggactgtggcccttctgttggcagcagcagggactgccgtgggggatagatgtgaacgcaatgagtttcagtgtcaggacggaaagtgtatcagctacaagtgggtgtgtgacggaagcgcggaatgtcaagatggaagtgacgaatcgcaagaaacgtgtctgagcgtgacctgtaagagcggtgatttttcgtgtgggggacgggtgaatagatgtattccacagttctggaggtgcgatggacaagtcgactgtgataatggatccgatgaacaaggctgcccccctaaaacttgttcccaggatgagtttagatgtcatgatggaaaatgtatctcgcgacagttcgtgtgcgactccgacagggattgcctggatggaagcgatgaagcatcgtgccctgtgctgacttgtggtcccgctagctttcaatgtaactcgtcgacctgtatacctcagctctgggcatgtgacaatgaccctgattgtgaggacggctccgatgagtggcctcaaagatgtagaggactgtacgtgtttcagggagatagctctccttgttccgcctttgaatttcattgtctgtccggagaatgcatccacagctcatggcgttgtgacggtggaccggactgtaaggacaaaagtgatgaagagaactgcgctgtcgccacctgccgtcctgatgaattccagtgctcggacggaaattgtatccatggaagtcgacagtgtgatagagaatacgactgtaaggatatgtcggacgaagtgggttgtgtgaacgtgaccctgtgcgagggaccgaataagtttaagtgccactccggagagtgtataaccctggataaggtgtgcaacatggcacgggattgtagagactggtccgatgaaccaattaaggaatgtgggaccaatgaatgtctcgacaataacggtggatgttcacatgtgtgtaacgagttgaaaatcgggtacgagtgtctgtgcccagatggattccaattggtcgcacagagacggtgtgaggatatagatgagtgtcaagaccccgacacgtgttcgcagctctgtgtgaatctcgagggaggatacaagtgccagtgtgaagaaggatttcagctggatccgcataccaaagcctgtaaggcagtcggttcgatagcctacctctttttcactaaccgccacgaagtcagaaagatgactcttgatcgctcagaatacacttcactgatcccaaatttgcgcaacgtggtcgcccttgacacggaagtcgccagcaacagaatttactggtccgacctcagccagcggatgatttgtagcacccagctggatcgagcacacggggtgagcagctatgatacggttatctcccgagacattcaggcaccagatggcctcgcagtcgattggattcattcgaacatctactggaccgactcggtgctgggcactgtgagcgtggcggataccaagggggtgaaacgcaaaactctttttcgggaaaatggatcgaaacctcgggcaattgtcgtggatcctgttcacggtttcatgtattggactgactggggtacccccgcaaagatcaaaaagggaggtctgaacggagtcgacatttactcgcttgtcaccgagaacattcaatggccaaatgggattactcttgacctcctctcaggtagactgtactgggtggattctaagctgcattcaatttcgagcatcgatgtgaacgggggtaacagaaagaccatacttgaagatgagaagcgcctggcacatcctttttccctggccgtgttcgaagataaggttttctggactgacataatcaatgaagcaatattctccgcaaacagactcaccggatccgacgtcaacttgctggcagaaaacttgctcagcccggaggacatggtgctctttcacaatctgactcaaccaagaggcgtgaattggtgtgaaaggactacgctgtcaaatgggggatgtcagtacctttgtttgccggccccccagattaaccctcattccccaaagtttacctgtgcatgccctgatggaatgttgctcgcccgagatatgcgctcgtgtcttaccgaggcagaggcagcagtagctactcaggaaacttcaaccgtccggcttaaggtgtcgtcaaccgctgtccggacgcagcataccactactagacctgtgccagatacctcccggctgcctggagccacccccggactgactactgtggaaattgtgactatgtcccatcaagccctgggcgacgtggcgggtaggggcaatgaaaagaagccatcgtcggtgcgcgcactgtctatagtgctgccaattgtgctccttgtgtttctttgtctgggagtctttctgctttggaagaattggaggctgaagaacattaactcaattaactttgacaatcctgtgtatcaaaagactaccgaggacgaagtgcatatttgtcataaccaagatggatacagctacccctcaagacagatggtttcactggaagatgacgttgcg

SEQ ID NO: 218 - DNA, 2580 bp, Artificial Sequence
  Description of Artificial Sequence: Synthetic Transcript Sequence
atgggcccctggggctggaagcttcgctggaccgtagctctgttgctggccgccgctgggaccgcagtgggagacagatgtgagcgcaatgagttccagtgtcaggacggaaagtgcatatcctacaaatgggtatgcgacggcagcgccgagtgccaggatggcagtgacgagtctcaggagacatgcctgtctgtgacctgcaaaagcggcgatttttcttgtggtggcagggttaacaggtgtattccacaattttggcgctgcgatggccaagtggattgcgataacggttccgatgaacagggctgcccccccaaaacatgcagccaggatgagttccggtgtcacgatggtaaatgcataagccgacaatttgtctgcgactccgaccgcgattgtctggacggcagcgacgaggcctcctgtcctgtgttgacatgtggacctgcctcatttcaatgtaacagctccacctgtatcccacagctttgggcttgcgataatgacccagattgcgaggacggctccgatgaatggcctcaaaggtgtaggggtctttacgtgtttcaaggggatagctcaccttgcagcgcatttgaatttcattgtctgagcggggagtgtatccatagtagttggaggtgtgatggtggacccgattgcaaagataagagcgatgaggaaaactgtgcagttgccacctgtcggccagacgaattccagtgtagcgacggtaattgtatccacggcagtcggcagtgcgaccgcgagtacgattgcaaggatatgtcagacgaagtaggctgtgtaaatgttaccttgtgcgaggggcccaacaagtttaagtgtcactcaggggaatgcattaccctcgataaggtgtgcaacatggccagagattgccgggactggagcgatgaacccattaaggagtgtgggaccaacgaatgcctggacaataacgggggatgctcccacgtatgtaacgaactgaagattggctacgagtgcctgtgtcctgacggcttccagctggtcgcccagcggagatgcgaggatatcgacgagtgtcaggatccagacacatgcagccagctgtgtgttaacctcgagggcggctataaatgccagtgtgaagaggggttccagctggatcctcacacaaaggcctgcaaagctgttggatctattgcttatctcttcttcaccaacagacatgaggtgcggaaaatgacactggataggagcgaatacacgtccctgatccccaatctgcggaacgttgtggcactggacacagaggtagcttcaaaccggatctactggtccgacttgtctcagaggatgatctgcagcacgcagctggatcgggctcatggggtcagtagctatgatacagtgatctctagggacatccaggccccagatggacttgctgtcgactggatccactccaatatatattggactgatagcgtgctgggaacagtttctgtggccgacaccaaaggagtcaaaaggaagacactgtttcgagaaaacggaagcaaaccgcgagccatcgtagtggaccccgtgcacggttttatgtactggacagactgggggacaccagcaaaaattaagaaggggggcctcaatggggtcgacatttattcactcgtgaccgagaacatacaatggccgaacgggattacactggacttgctgtcaggacgactgtattgggtggacagcaagctccatagcatatccagtattgacgtgaacggcgggaaccgcaaaaccatcctcgaggacgaaaagcgactcgctcatccattttcactggcggtgttcgaggacaaggtgttttggacggacataatcaatgaagctatcttctccgcaaataggcttacaggctctgacgtcaatctgctggccgagaatcttctctcaccagaagacatggtcctcttccataacttgacacagcctcggggcgttaattggtgcgaaagaacaacgctttctaacgggggatgtcagtacttgtgcctgcctgcacctcagatcaatccccatagtccaaagttcacatgtgcatgtcctgatggtatgctcctcgcccgggacatgaggtcatgtctcactgaggctgaagctgcagtggctacccaagaaacgagtacagtgcgactgaaggtgtcctcaacagctgtccgcacacagcatacgacaacaaggcctgtccctgacacaagcagactgccgggtgctacgccaggactgaccacggtagagattgtgacaatgtctcaccaggccctgggggacgtggctgggcgcggcaatgaaaagaagccaagcagcgtgagagccctgagcatcgtcctgcccatcgttctcctggtgttcttgtgtttgggcgtcttcctgctttggaaaaactggagacttaagaatatcaacagtattaattttgataaccctgtataccagaagactacagaggatgaggttcacatatgtcacaaccaggacggttacagttacccatcccgacagatggtcagtctcgaggatgacgtcgcc

SEQ ID NO: 219 - DNA, 2580 bp, Artificial Sequence
  Description of Artificial Sequence: Synthetic Transcript Sequence
atggggccttggggctggaagctgcgctggaccgtggcgctcctgctggccgcagccggcaccgcagtgggagatcgctgcgaaagaaacgaatttcaatgccaggacggtaagtgcatttcgtacaagtgggtgtgcgatgggagcgcggagtgtcaggacggttcggacgaatcacaggaaacctgcttgtcggtgacgtgcaaatccggagatttcagttgtggtggccgcgtgaatcggtgcatccctcaattctggcgctgtgatggccaagtggattgcgacaacggatcagacgaacagggttgccctcccaagacgtgctcgcaagacgagtttaggtgccacgatgggaaatgcatcagccgccaattcgtctgcgactccgatagagactgcctggacggatctgatgaggcttcatgcccagtgctgacctgcggaccggcctcgttccagtgcaactcgtccacttgtatcccccagctgtgggcctgcgataacgacccggactgcgaggacggaagtgacgaatggccgcaacgctgccgaggactgtacgtgttccagggtgatagctctccgtgtagcgccttcgaattccattgcctgtcgggcgagtgtatccactcaagctggcggtgcgatggggggccagattgtaaagacaaatcagatgaggagaattgcgccgtcgcaacctgccgccccgatgagtttcagtgtagcgacggcaattgtatccacggatcacggcagtgcgaccgggaatacgactgcaaggacatgtccgatgaggtcggctgtgttaacgtgactctgtgcgaaggtcctaacaagttcaagtgccattcgggagaatgcatcaccctcgacaaagtgtgcaatatggcaagagactgtcgcgactggtcggacgaaccgatcaaggagtgcggaaccaatgaatgcctcgacaataatggcggatgcagccacgtctgcaatgaacttaagatcggatacgaatgcttgtgccccgatgggttccaactggtggcccagaggaggtgtgaagatatcgatgaatgtcaggacccggacacttgctcgcagctctgcgtgaacctggaaggagggtacaagtgccaatgcgaggaggggtttcagcttgacccccataccaaggcgtgcaaggctgtcgggtccatcgcctacctgtttttcactaacagacatgaggtgcggaagatgactctggaccgcagcgaatacacgtccctgatcccaaatctccgtaatgtggtggcattggacacggaagtcgcgtcaaacagaatttactggtcggatctgtcgcagagaatgatctgctcaacccagctcgatcgggctcacggcgtgtctagttacgacactgtgatttccagggatattcaagcgccggatggactcgcagttgactggatccactcaaacatctactggaccgattccgtcctgggcaccgtgtccgtggcagacaccaagggtgtgaaaaggaaaactttgtttagggaaaacggatctaagcctcgggcgatcgtggtcgacccagtgcacgggttcatgtactggaccgactggggcactccggcgaaaatcaaaaagggcggactgaacggagtagatatctattcgttggtgactgagaacatccaatggccgaacggaatcactctcgacctgctgtcagggcggctctactgggtagattcaaaacttcacagcatcagttcgattgacgttaatggagggaaccgcaagacgatactggaagatgaaaagagactcgctcatccattctccctcgcggtgttcgaggataaagtgttctggaccgacatcatcaacgaagcgattttcagcgccaaccggctcacgggaagcgacgtcaacctgctggctgagaacctgctgtcgccagaggacatggtgcttttccataacttgactcagcctagaggagtgaattggtgcgagcggaccaccctgtctaacggaggctgtcaatacctctgtctcccggccccacagataaacccgcactccccgaaattcacttgtgcctgtccggacggcatgcttcttgcacgcgacatgcgctcttgcctcaccgaagccgaggcggctgttgccactcaggaaaccagcactgtccggctgaaggtgagctctactgccgttcgcacccaacacaccaccacccgccctgtcccagatactagccgtctgccgggagccaccccgggactcactactgtggaaatcgtcaccatgtcacatcaggcactgggggacgtggcgggacggggaaacgaaaagaagccgtcgtcagtgcgcgctctctccatcgtgctgccgatcgtcctgctcgtgtttttgtgcctgggtgtgttcctcttgtggaagaattggagactgaagaacatcaattcaattaacttcgataacccagtctaccaaaagaccactgaggacgaagtacacatctgccataatcaggacggatacagctatccctcgaggcagatggtttcccttgaggacgatgtcgca

SEQ ID NO: 220 - DNA, 2580 bp, Artificial Sequence
  Description of Artificial Sequence: Synthetic Transcript Sequence
atgggaccttggggatggaagctgagatggactgtggcactgctgctggccgcagcgggaaccgccgtgggcgatcgctgtgagagaaatgagtttcagtgtcaagatgggaaatgtatttcatataagtgggtgtgtgatggctcggctgaatgtcaggacggatccgatgaaagccaggaaacctgcctgtcggtcacttgcaaatccggcgatttcagctgcgggggacgtgtgaatagatgtatcccacaattctggagatgtgacggtcaggtcgactgcgataacggttcggacgagcagggctgcccacctaagacctgttcgcaagatgagtttaggtgccatgatggtaaatgcatttcgagacaatttgtgtgcgattcggaccgggattgtctggatggttcagatgaagcgtcgtgtcccgtgctgacttgcggtccagctagctttcagtgtaacagctccacctgtattccacaactctgggcatgtgataacgatccggactgcgaggacggatctgatgaatggccccaaaggtgtaggggactgtacgtgttccaaggagattcctcgccttgttcggcattcgagttccattgtctgtccggcgagtgtattcattcctcatggcggtgtgatggcggtccggattgcaaggataagtccgatgaagaaaactgtgccgtggcgacttgtcgtcctgacgaatttcaatgttccgatggaaattgtatccacggttcgagacaatgcgacagagagtacgactgtaaagacatgtcggacgaagtgggatgtgtgaacgtcaccctttgtgaagggccgaacaaattcaagtgtcactccggcgaatgtatcactctcgataaggtgtgtaatatggcccgagattgtagagattggtctgacgaacccatcaaggaatgcggaactaacgaatgtttggataacaacggaggatgttcgcatgtgtgcaacgaacttaagattgggtatgaatgcctctgccccgatgggttccagcttgtggcacaacgccggtgcgaagatatcgatgaatgtcaagatcctgatacctgcagccagctgtgtgtgaacctggagggaggttataagtgccagtgtgaggaagggttccaactcgatccacatactaaggcctgcaaggcggttgggtcaattgcatacctgtttttcaccaatcgccatgaggtgcggaagatgaccctcgatagatcggagtacacctctcttattccaaatcttaggaacgtggtggccctcgatactgaggtcgcatcgaaccggatttactggtccgatctcagccaaaggatgatctgctccactcaactggatcgcgcacatggggtcagctcctacgataccgtgataagccgtgacattcaagcaccagacgggctcgcagtcgactggatccattcaaacatatactggaccgactccgtgctgggaaccgtctcagtggcggataccaagggtgtgaagaggaaaacgttgtttagagaaaacggatcgaaaccccgagcaattgttgtggaccctgtgcatggtttcatgtactggacggattggggaaccccagcaaagatcaaaaagggagggctcaacggagtggatatctacagcctggtgaccgaaaacattcaatggccaaacggtataactctggatctgctgtccggtaggctgtactgggtcgactccaagctccatagcatctcgtccatagatgtgaacggcggaaatagaaagactattttggaagatgaaaagaggctggcacaccccttctcgctggccgtctttgaggacaaggtcttttggactgacatcataaacgaagcgatcttctcagctaaccgactgactgggagcgatgtgaaccttttggcagaaaacctgcttagcccagaagatatggtgctcttccacaaccttacccaaccacggggggtcaattggtgtgagagaactaccctgtcaaacggtggatgtcagtacctgtgtctgcctgcacctcagattaacccgcactctccaaaattcacgtgtgcatgccccgacggaatgcttctggcaagggacatgaggtcctgcctgaccgaagcagaagccgcagtcgcaacccaagagactagtaccgtgcgcctcaaggtttcgtcgaccgctgtgcggacccaacataccaccactcgtccagtgccagacacttcgcgccttccgggtgcaaccccaggccttactactgtggaaatcgtcactatgagccatcaagcgctgggagatgtggcagggagaggaaacgaaaagaagccctcctccgtgagagccctgtcgattgtgcttcccatcgtgctgcttgtattcctgtgcctgggagtctttcttttgtggaaaaactggcgtctcaaaaacatcaactcaataaactttgacaatccagtgtaccagaaaacgactgaagatgaagtgcacatttgtcacaatcaagatggatacagctacccatccaggcaaatggtgagcctcgaggatgacgtggca

SEQ ID NO: 221 - DNA, 2580 bp, Artificial Sequence
  Description of Artificial Sequence: Synthetic Transcript Sequence
atgggaccgtggggatggaaacttagatggactgtcgcactgctgctggccgcggccggaaccgcagtgggtgatagatgtgaacgcaacgaatttcagtgtcaagatggcaagtgcatatcatacaagtgggtctgtgatggatcagccgaatgtcaagatgggagcgatgaaagccaagaaacctgcctgagcgtcacttgcaagtccggtgacttttcgtgcggtggaagagtcaaccggtgcatccctcagttttggcggtgtgacggacaggttgattgtgataatggttccgacgaacagggctgtcctcctaagacgtgttcacaggatgaatttagatgccacgatggtaagtgcatttcgagacaatttgtgtgcgattccgacagagactgcttggatgggtccgacgaagcatcatgtcccgttctgacctgcgggccagccagctttcagtgcaattcctcgacctgcatcccccagctgtgggcatgtgacaacgatcctgactgcgaagatggatcagatgagtggccgcaacgttgcagagggctgtacgttttccaaggggactccagcccatgtagcgccttcgagttccattgcctgagcggcgaatgcatacattcgtcgtggcgatgtgacggaggtcccgattgcaaagacaagagcgacgaagaaaactgtgcagtggccacctgccgcccggatgaatttcaatgttccgatggtaattgtattcacggatcacgacagtgtgatcgcgagtacgattgtaaggatatgagcgacgaagtgggatgcgtgaacgtgactctctgtgaaggaccaaacaaattcaagtgccattccggggagtgtatcacccttgacaaggtgtgcaacatggcaagagactgtagagattggtccgatgagcccattaaggaatgtggaaccaacgagtgtttggataacaatggcggatgctcccatgtgtgtaacgaacttaagatcggatacgagtgtttgtgtcccgacggatttcaacttgtggcccagcgtcgctgtgaggacatcgatgaatgccaggacccagatacgtgctcacaactttgtgtcaacctcgaaggcggttacaagtgccagtgtgaagaaggttttcaactggacccgcatactaaagcctgcaaggcggtggggtccattgcttatcttttcttcaccaatagacacgaagtgagaaagatgaccctggatcgaagcgaatacaccagccttattccgaatttgcgcaatgtcgtcgcgctggatactgaagtggcctccaacagaatctattggtcagatcttagccaaagaatgatttgcagcactcagcttgatagggcacacggtgtctcctcgtacgacaccgtcataagccgtgatattcaggccccggatgggctggctgtggactggatccactcaaacatatactggacggactctgtcctgggtactgtctctgtggcagataccaagggagtcaaaaggaaaaccctttttcgcgagaacggcagcaagccccgcgcaatcgtggtggatccagtacacggtttcatgtactggaccgactggggtacccctgctaagatcaagaagggagggcttaatggagtggatatctactcgcttgtgaccgaaaacattcaatggccgaacggcattaccctggacctgttgtccggtaggctgtactgggtcgactccaagctgcactcaatcagcagcatcgatgtgaacggagggaatcggaaaaccattcttgaggatgaaaaaaggctggctcatccgttttcacttgcagtctttgaggacaaggtcttttggaccgacattatcaacgaggcaatctttagcgcgaatcggcttactggaagtgatgtgaacctgcttgccgaaaaccttttgtccccagaagatatggtcctgttccataatctgacccagcctcgcggtgtcaactggtgtgagcgcacgactctttcaaatggcggatgtcagtacctgtgcttgccagcccctcagattaatcctcattcgccaaaattcacttgtgcgtgccctgatggaatgctcctggcacgcgatatgcgctcctgtctgactgaggcagaagcagcagtggcgactcaagagacgtcgacggtcagactcaaagtgagttccacggcggtgaggacccagcatactaccacccgccctgtgcctgatacctccaggctgcctggtgccactcctggactcaccactgtggagatcgtgactatgtcgcaccaggcactcggtgacgtcgcaggccggggcaatgagaaaaagccatcttccgtgcgcgcactctccatcgttttgcctattgtgcttcttgtgtttctgtgtctgggtgtgttccttctctggaaaaactggcgcctgaagaacattaactcaattaactttgataatcctgtgtatcaaaagacgactgaagatgaagtgcacatctgtcataatcaagatggatacagctacccatcgcggcaaatggtgtcccttgaagatgacgtggca

SEQ ID NO: 222 - DNA, 2580 bp, Artificial Sequence
  Description of Artificial Sequence: Synthetic Transcript Sequence
atgggcccttggggatggaaactgcgttggaccgtggccctcctgttggcggccgccggaaccgcggtcggtgatcggtgcgaaaggaacgaatttcaatgccaggatggaaaatgcatatcatacaaatgggtctgtgacggttcggcagaatgccaggacggttcagacgagtcacaggaaacctgcctgagcgtcacttgcaagtccggagatttctcttgcggaggccgcgtgaatcggtgcattccgcagttttggcgctgtgacgggcaggtcgactgtgataacggatctgacgaacaaggctgtccccctaaaacttgtagccaggatgagttccgctgccacgacggaaagtgcatctcgcgacaattcgtgtgtgacagtgatagagactgccttgatggaagtgacgaggcatcctgccctgtgttgacctgcggcccggcttcgttccaatgcaactcgagcacttgcatcccacagctctgggcctgcgacaatgacccggactgtgaagatggttcggacgagtggccacagcgctgccggggactctacgtctttcagggagatagttctccttgttcagctttcgaatttcactgcctgtccggagaatgtatccactcctcgtggcgctgcgacggcggaccggactgcaaggataagtcggacgaggagaattgcgcagtagcaacgtgtagaccggatgaatttcagtgctccgatggaaattgcatccacggctcgaggcaatgtgaccgtgagtacgactgcaaggacatgtcagatgaagtgggctgtgtcaatgtgactctgtgcgaaggaccgaataagttcaaatgccactcgggagagtgcatcactctggacaaggtgtgcaacatggcccgcgattgtcgtgattggagcgatgaaccaatcaaagagtgcggaaccaatgaatgtttggacaacaacggcggttgctcacatgtgtgtaatgagctgaaaataggatacgaatgtctgtgcccagacggcttccagcttgtcgcccagagaaggtgcgaggatatcgacgaatgccaagacccagacacctgcagccaactgtgcgtgaaccttgagggcggatacaagtgccagtgtgaagaaggtttccagctggatccgcataccaaggcatgcaaggctgtgggttcgatcgcgtacctcttcttcacgaaccggcacgaagtgcgcaagatgaccctcgaccggtcagaatatacctcgcttatcccgaacctgcgcaacgtggtggctctggatacggaagtggcgagcaaccggatttactggagcgacctgtcgcagcggatgatatgttcgacccagcttgaccgcgcccatggcgtgtcatcgtacgacaccgtcatctcaagagatatccaagctccggacggcctggctgtggactggatccactccaacatttactggacggattccgtgttgggaactgtgtccgtggctgatactaaaggtgttaagaggaaaactctgttcagagaaaacgggtcaaagcctcgcgcgatcgtggtggacccggtgcatgggttcatgtactggactgactggggtacgccggcaaagatcaaaaagggcggactcaacggagtggacatttactccctcgtgactgagaacatccagtggccgaacggaatcactctggatcttctctccgggcggctgtactgggtggacagcaagctccactcgatctcctccattgatgtgaatggtggtaacagaaagactatcctggaggacgaaaaacgactggcccatccattctcactggcggtgttcgaagataaagtgttttggactgacattatcaacgaggcgatcttctccgccaatcgcctgactggtagcgacgtcaacttgcttgctgagaacctcctgtcaccggaagatatggtactgtttcataacctgacccaaccaaggggagtgaactggtgcgagagaaccactctgtccaacggaggctgccagtacctctgcctcccagcaccacagatcaacccccactccccaaagttcacctgcgcgtgccctgacggcatgctcctcgcccgggacatgagaagctgcctgactgaggcagaagccgcggtggccacgcaggagacgtccacggtgcggctcaaggtgtcatcgaccgctgtgcggacccaacataccaccacgcggcccgtgccggacacttcgcgactcccaggagccaccccgggcctgactaccgtggagatcgtgaccatgagccaccaggctcttggtgacgtggcagggcgggggaatgagaaaaagccgagcagcgtgcgcgcactgtccatcgtgctccctatcgtcctcctggtgtttctctgcttgggcgttttcctgctttggaagaattggcggctgaagaatatcaattcgatcaacttcgacaaccccgtctatcaaaagaccactgaagatgaggtgcatatctgccacaatcaagacggatactcctacccttcgagacagatggtgtctctcgaggatgatgtcgca

SEQ ID NO: 223 - DNA, 2580 bp, Artificial Sequence
  Description of Artificial Sequence: Synthetic Transcript Sequence
atgggcccctggggctggaaacttaggtggaccgtggcgctattactcgcggccgcgggaacagcggtgggggatcgatgcgagcgtaacgagtttcagtgccaggatggtaaatgtattagttataaatgggtgtgcgatggtagcgccgaatgtcaggatggttccgacgagagtcaagaaacatgcttgtctgtgacatgcaagtccggggacttctcttgcggcggcagagtgaacaggtgcataccacagttctggcgatgtgatggccaggttgactgcgacaatggatccgatgagcagggctgccccccgaaaacatgtagccaggatgaattccggtgccacgatgggaagtgtatttccagacagttcgtatgcgatagtgatcgggattgcctggacggatccgatgaggccagctgccctgtgctgacatgcggtcctgcatctttccagtgtaattcatcaacttgcatacctcagctgtgggcctgcgataatgatcccgactgcgaagatggttcagacgaatggcctcagagatgccgagggctgtatgtatttcagggggactcttccccttgctcagccttcgagtttcattgccttagcggagagtgtatccatagtagctggaggtgcgatggcggaccagactgtaaagacaagagtgacgaagagaactgtgccgtggccacctgccgaccagatgaattccaatgttctgacggtaattgcatccatgggagtcgccagtgcgacagagaatacgactgcaaggacatgtccgatgaagtgggttgcgtgaatgttactttgtgcgaaggcccaaataaattcaaatgtcattccggcgaatgcatcacactggacaaagtgtgcaatatggcgcgggactgtagggattggagtgacgaacctataaaggagtgtggcactaatgagtgtctggacaacaatggtggttgtagccacgtgtgtaatgaacttaagatcggatacgaatgcctttgtcctgacggatttcaattggtggcccagcggcggtgtgaggacattgatgagtgccaggatcccgacacctgcagtcagctctgtgtcaacctggagggaggctacaagtgtcaatgtgaggagggattccagctggacccccatacgaaggcctgcaaggctgttggttctattgcttacctctttttcaccaatcggcacgaagtgcggaagatgacgctggatcgctcagaatacacgagccttataccgaaccttcggaacgtagtggccctcgataccgaggtagctagcaacaggatttactggtctgatctgtctcagcggatgatttgctctacgcagctggacagggcccacggggtgtcctcctacgatactgtgatcagcagagatatccaggctccggacggactggctgtggattggatccactcaaatatatactggaccgattctgtgctggggacagtatcagtggccgacacaaaaggggtgaaaaggaaaactctcttcagagagaatggcagtaagcctcgggctattgttgttgaccctgtacatggcttcatgtactggactgattggggaacgcctgctaagatcaagaaaggggggctgaacggagttgatatttactccctcgtcacggagaatatccagtggcccaatggcatcactctggacctgctttctggccgactgtattgggtggactctaagctccattccattagtagcatcgatgtgaatggagggaatcgtaagacgatattggaagacgagaaacgcctcgcccaccccttttccctggccgtattcgaggataaagttttctggacagacatcattaacgaggcaattttttccgcgaataggctgacagggtccgacgtaaatctcctggctgaaaacttgctgagtcctgaggacatggtgctgttccacaacctcacgcagcctagaggggtgaattggtgtgaaaggacgaccttgtccaacggcggttgccagtacctctgcctccctgctccacagattaatccacactcacctaagtttacttgtgcctgccccgacggaatgctgctcgctcgcgacatgcggtcttgcctgacagaagctgaagccgcggtggccactcaagagacaagcaccgttagactcaaggtatcaagcaccgcagtgcgaacacagcatacaacgacgcggccggtccccgatacgtccagactccctggagcaactcctgggctaactactgtggaaatcgtgacaatgtcccaccaggcgctgggtgacgtagcagggcggggcaacgaaaagaagcctagctctgtcagagccctgagcatcgtactacccatcgtgcttctggtgtttctatgtttgggagttttcctgctttggaagaattggcgactgaaaaacataaattcaatcaatttcgataaccccgtgtaccagaaaacgacggaagatgaggttcacatctgccataatcaggatggctattcctaccctagtcgacagatggttagtctggaagatgacgtggcg

SEQ ID NO: 224 - DNA, 2580 bp, Artificial Sequence
  Description of Artificial Sequence: Synthetic Transcript Sequence
atgggcccatggggctggaaacttagatggaccgtggcactgcttcttgcagcagctggaactgcggttggagatcgctgtgagcggaacgaatttcaatgtcaagacggaaagtgcatttcatacaagtgggtgtgcgatggttcggcagaatgtcaagatggtagcgacgaatcgcaggaaacctgtctttcggtgacttgcaagagcggtgattttagctgtgggggccgcgtgaacagatgtattccacaattttggagatgcgatggacaggtggactgtgacaatggttcagatgaacagggatgtcctcccaagacctgttcacaagatgaattccgctgccacgatggaaagtgtatctcgcgccaatttgtatgcgacagcgatcgcgattgtctggatggatcggatgaagcctcctgccctgtgctcacttgcggaccggcctcgtttcagtgtaacagcagcacctgtatcccgcagctttgggcatgcgataacgaccctgattgtgaagatggttcggatgaatggccacaaagatgtcggggtctttatgtgtttcaaggagactcgtccccctgctcggccttcgagttccattgtctttcaggggaatgtatccactcgtcctggcgttgtgacggtgggcctgactgtaaggataagtccgatgaagagaactgtgctgtggcaacttgccgccctgacgagttccaatgctccgatgggaattgcattcatggaagccgccaatgcgatagagaatacgactgtaaggacatgtcggatgaggtgggctgtgtcaatgtgaccctctgtgaaggaccaaacaagtttaagtgtcactcgggagagtgtattaccctggataaggtttgtaatatggcaagagattgtcgcgattggtccgatgaacctattaaggaatgcggaactaatgaatgccttgataacaatggtgggtgctcacacgtctgtaacgaactcaagatcggatacgaatgtctttgtcctgatggctttcaattggtcgcgcaacggagatgtgaagatattgatgaatgccaggatcccgacacgtgctcgcaactctgtgtcaacctcgaaggagggtacaagtgtcagtgtgaagaaggttttcagcttgacccacataccaaggcatgcaaggcagtgggaagcattgcatacctgtttttcaccaacaggcacgaggtcaggaaaatgacccttgacaggagcgagtacaccagcctgatcccaaatctgcgcaacgtcgtggcacttgacactgaagtcgcatcgaatcgaatctactggtccgacttgagccagcgcatgatttgtagcactcagctggatagggcccatggtgtctcgagctacgacaccgtgatttctcgtgatattcaggcccctgatggtctggcggtggattggatccactccaacatctactggactgattccgtgctcggaaccgtgtcggtcgctgacaccaaaggagtcaagagaaagacgctttttagagaaaatggctcgaagcctagagctatcgtcgtggatccagtccatgggttcatgtactggaccgattggggtacgccagcaaagataaagaagggtggtcttaacggggtggatatctactccctggtgaccgaaaacattcaatggcccaacggaatcaccctcgatctgctttcgggaaggctgtactgggtggatagcaagctgcactcgatctcctcgattgatgtgaacggaggtaaccgtaagaccattctggaagatgagaaacggcttgcacatcccttcagcttggccgtttttgaggataaagtcttttggaccgacatcataaacgaagcaatattctcggcaaaccgtcttactggtagcgatgtcaacctgttggccgagaaccttctgtctcctgaagatatggtcctgtttcataaccttacccaaccaagaggcgtgaattggtgcgaacgcacgacgctttcaaacggaggatgtcagtatctttgtctgccagcacctcagattaaccctcactcccctaagtttacctgcgcctgtcccgacggtatgctcctcgcacgtgatatgcggtcgtgccttactgaagctgaggcagccgtggctacccaggagactagcaccgttagactgaaggtcagttccactgccgtgagaactcagcacactactacccgaccagtcccagatacgtcgcggctgcccggcgccacccccggacttactactgtggagattgtaaccatgtcacaccaagcattgggtgatgtggccggacgaggaaatgagaagaagccctcctcagtgagggcgcttagcatcgtcctgcctattgtgctcctcgttttcctctgcctcggtgtgttcttgttgtggaagaattggcgtctcaagaacatcaattcgattaactttgataaccctgtgtaccaaaaaactaccgaagatgaagtccatatttgccacaaccaggatggatatagttatccttcccggcaaatggtgtccttggaggacgacgtcgct

SEQ ID NO: 225 - DNA, 2580 bp, Artificial Sequence
  Description of Artificial Sequence: Synthetic Transcript Sequence
atgggaccatggggatggaaactgcgctggactgtggctctgctgctcgccgcggcaggcactgctgtgggtgatagatgcgaaaggaacgagttccagtgtcaggacgggaaatgcatctcgtacaagtgggtgtgtgacggatccgcggaatgtcaagacggatcggatgagtcgcaggagacttgcctgtcagtgacctgcaaatcaggagatttcagctgcggaggaagagtaaatagatgcatcccacaattctggcggtgcgatggacaggttgactgcgataacggctcagatgaacaaggatgcccaccaaaaacctgttcgcaggatgaattcagatgccatgatggtaagtgcattagtcgacaattcgtctgtgattccgatagagactgcctcgacggaagtgacgaagcgtcgtgccctgtcctcacttgtggccccgcttcctttcaatgcaatagctccacctgcatccctcagctgtgggcatgcgataacgacccggattgcgaggacgggtcggacgaatggccgcaaaggtgtagagggctctacgtgttccagggagattccagcccttgttctgcctttgaattccactgcctgtcaggagagtgtatccactcgtcgtggcgttgcgatggcggaccagattgtaaggataagagcgacgaggaaaactgtgccgtggccacctgccggccggacgagtttcaatgtagcgacggcaattgcatccacggttccagacagtgcgaccgcgagtacgactgcaaagatatgtcggatgaggtggggtgcgtcaacgtgaccctttgtgagggtcccaataagttcaagtgccatagcggggagtgcatcacgctggataaagtgtgcaacatggcccgggattgtcgtgactggtctgatgaaccgatcaaggaatgcggcaccaacgagtgtctcgacaacaatggcgggtgctcgcacgtgtgtaacgaactcaagatcggatacgagtgcctttgccccgacggattccagctggtggcccaaagacgctgcgaggacatcgacgagtgccaggacccggacacgtgctcgcagctttgtgtcaacctcgagggcggatataagtgtcagtgtgaagaaggattccagctcgacccgcacactaaggcctgcaaggcagtcgggtccatcgcgtacctcttcttcactaaccgccacgaggtgcggaagatgaccctggacagatcggaatacacctccctgatcccgaatttgcgcaacgtggtggccctggacaccgaagtggcctcgaaccggatttactggtcggacttgtcgcagcgcatgatctgctcaactcaattggacagagcccacggagtttccagctacgacactgtcatcagccgcgacatccaagcgccggacgggcttgcagttgattggatccattcaaacatttactggactgacagcgtcctgggaactgtgtcagtggcagacaccaagggagtcaagcgtaagaccctctttcgcgaaaacggctcgaagccgcgggccatcgtggtggaccctgtgcatggattcatgtattggactgactggggaaccccggccaagattaagaagggaggactgaacggcgtggacatctactcgcttgtaactgaaaacatccagtggcccaatggcatcactctcgacctcctttcgggacgcctctactgggtcgatagcaaactccacagcatctcctccatcgacgtgaacgggggcaatcgaaagacgattctggaggacgaaaaacgcctggcgcatccgttctccctcgccgtgttcgaggacaaggtgttctggacggatatcatcaatgaggcaatctttagcgcaaataggcttaccggatccgacgtgaatctcctggccgaaaatctcctcagcccggaggacatggtattgttccacaatctgacgcagccgcggggggtgaactggtgcgaaaggaccactttgtcaaatggtgggtgtcagtacctttgcttgccagccccgcagatcaacccgcactcaccaaagtttacctgtgcctgccctgacggcatgctgctggcccgcgacatgcggtcttgcctgacggaagctgaggcggctgttgctactcaggaaacctctactgtgcgccttaaggtcagctcgacggcagtgcgcacccagcacactactacgcgcccagtgccagatacctcccggctcccaggtgcgacgcccggcctgaccaccgtcgaaatcgtgaccatgtcccatcaagctcttggagatgtggcgggaagaggaaatgagaaaaaaccctcctccgtcagagctctcagcatcgtgctgccgatcgtgcttctcgtgttcctgtgcttgggggtgtttctgctgtggaagaactggcggctcaagaacatcaattctatcaacttcgataacccggtgtaccaaaaaacgaccgaagatgaggtccacatctgccacaaccaggatggctactcctacccgtcgcggcaaatggtgtcgttggaggatgatgtcgct

SEQ ID NO: 226 - DNA, 2580 bp, Artificial Sequence
  Description of Artificial Sequence: Synthetic Transcript Sequence
atgggaccatggggctggaaactgaggtggactgtcgccctcttgctcgccgccgcaggaaccgcggtgggagatcgttgcgagagaaacgagtttcaatgccaggatgggaaatgcatctcttacaagtgggtttgtgacggctcagccgagtgccaggacggcagcgatgaatcgcaagaaacttgtctgtctgtcacgtgcaaaagcggcgacttctcctgtggagggagagtgaacagatgcattccgcaattctggcgttgcgacggacaggtcgactgcgataacggatccgatgaacagggatgcccacctaagacttgcagccaggatgagttccgatgccatgacggcaagtgtatctcgcggcaatttgtgtgcgatagcgaccgggactgtctggacggctcggacgaagccagctgcccggtgttgacctgcggccccgcctccttccagtgtaattcgtcgacgtgcatccctcagctctgggcgtgcgacaacgatccggactgcgaagatggtagcgacgaatggccacaacggtgccggggtctgtacgtctttcaaggagattcgagcccgtgctcagcattcgagttccactgcctgtcgggcgaatgtatccactcctcgtggcggtgtgacggaggcccggattgcaaggacaagtctgacgaggaaaactgcgccgtcgcgacctgcagacccgatgaatttcagtgttcggacggcaactgcatccacggttcccgccagtgcgatagggagtacgactgcaaggatatgtcggatgaggtcggctgcgtgaatgtgaccttgtgtgaaggaccgaacaagttcaagtgtcacagcggagagtgtatcaccctggataaggtctgtaacatggctcgcgactgccgggattggtcggacgaaccgattaaagaatgcggcacgaacgaatgcctggacaataatggaggatgctcccacgtgtgtaatgagcttaagattgggtacgaatgcctctgtccagacgggtttcaattggtggcgcagcgccggtgcgaggacatcgacgaatgtcaggatccggacacctgctcgcaactgtgcgtgaatcttgaaggtggttacaaatgtcagtgtgaggaaggtttccaactcgaccctcatactaaggcgtgtaaggcggtcggatcaatcgcctatttgttctttaccaaccggcacgaagtgcgcaaaatgaccctggatagatccgagtacacctcgctcatcccgaatttgcgcaatgtggtcgcactcgacactgaagtcgcctctaatcgcatctactggtcggacttgtctcaacgcatgatctgttcaacccagctggatcgagcccatggagtctcgagctacgatactgtgatttcccgggatatccaggctccagatggacttgccgtagattggattcactccaacatctactggactgattcagtcctgggtactgtgtccgtggccgacaccaagggagtgaaacgcaagaccctgttcagagagaacggctcgaagccaagagcaatcgtcgtggatcctgttcacgggttcatgtattggactgattggggaactccggccaagatcaagaagggcggactgaacggagtggacatatacagcctggtgactgaaaacatccagtggcctaatggaatcacccttgacctgctgtcgggcagactgtactgggtggactcaaagctccacagcatatcctccatcgacgtgaacggaggcaaccgcaaaacgatccttgaggacgaaaaaagactggcccacccattctcgttggcggtgttcgaagataaggtcttttggactgacatcatcaacgaagcaatcttctccgcgaaccggctcactggttccgatgtgaatctcctggccgaaaacttgctgagccccgaggacatggtgctgtttcataacctgacccagccgcgcggcgtgaactggtgcgagcgcacgaccctctcaaatggaggctgccagtacctctgcctgccggcaccgcagatcaaccctcatagccctaagttcacctgcgcctgcccggacggaatgttgctcgcgcgggacatgaggtcctgccttaccgaggcggaagctgccgtggctacgcaggagacttcgaccgtgaggctgaaagtctcttctaccgccgtgagaacgcaacataccaccaccaggccggtcccggacacctctcgtctcccgggggcaactcctgggctcaccaccgtggagattgtgactatgtcacatcaagcgttgggagatgtcgccggaagggggaatgagaaaaagccatcgtccgtgcgcgcgctgtcaattgtgttgccgatcgtcctgctcgttttcctgtgtctcggggtgttcctcttgtggaagaactggcgcctgaagaacatcaattcaatcaatttcgacaatccagtgtatcaaaagaccactgaggacgaggtgcacatctgccacaaccaggacggctattcataccccagccgccagatggtgagcctggaggacgatgtcgcc

SEQ ID NO: 227 - DNA, 2580 bp, Artificial Sequence
  Description of Artificial Sequence: Synthetic Transcript Sequence
atgggtccgtggggctggaagttgcgatggaccgtagcgctgctgctcgccgcagcaggaaccgcggtgggagataggtgcgagcggaatgaattccagtgtcaggacggtaaatgcatctcgtacaagtgggtgtgcgatgggtcagcggagtgccaagacggatcggacgaatcacaggaaacctgcctgagcgtgacgtgcaaaagcggcgacttctcatgcggaggccgcgtcaacagatgcattccccagttctggcggtgtgatggacaggttgactgtgataacggtagcgacgaacagggatgtccgccaaagacttgctcccaagacgagttcaggtgtcatgacggtaagtgcatctcgaggcaattcgtctgcgattccgatcgcgactgccttgacggttcggatgaggctagctgcccggtgctcacttgcgggccggcctcattccagtgtaattcgtcaacttgtatccctcaactctgggcttgcgacaacgacccagactgcgaagatggatcggatgaatggcctcagcgttgtagaggactttatgtatttcaaggagactcctctccgtgttcggcattcgagttccattgcctgtcgggagaatgcatccactcatcctggagatgtgacgggggaccagactgcaaggacaagtctgacgaagagaattgcgccgtggctacctgccggccagacgagtttcagtgttcagacggcaactgtatccacggctcaaggcagtgcgaccgcgagtacgactgcaaggatatgtccgatgaagtcggatgcgtcaacgtgaccctgtgtgaagggccaaacaagttcaagtgccattccggcgaatgcattacgttggataaggtgtgtaacatggcccgagactgcagagattggtccgacgaaccgattaaggagtgtggaacgaatgaatgcctggacaacaacggtgggtgttcccacgtgtgcaatgaactcaaaatcgggtacgaatgcctctgtcccgacggatttcagctggtggcacaacgccgctgtgaggacatcgacgagtgccaggaccctgacacttgctcgcagctgtgcgtgaatctggaaggcggatacaagtgccagtgcgaagagggcttccagcttgaccctcatactaaagcatgtaaggcagtcggatccatcgcttacctcttcttcactaacagacatgaggtcagaaagatgacccttgacaggagcgaatacacgtctctgatcccgaaccttcggaatgtggtggcactggatactgaagtcgcctcgaatcggatttactggtccgacctgtcccagcggatgatctgcagcacccaactggatcgtgcccatggcgtctcttcctacgacactgtaatctcccgcgatattcaggcccccgatggtctggcggtggactggatacactcaaacatctactggacggatagcgtgctcggaaccgtgagcgtcgccgacaccaagggagtgaagcggaaaaccttgttccgcgaaaacggatcgaagccgcgggccatcgtcgtggacccggtccacgggttcatgtattggactgattgggggactcctgcgaaaatcaagaagggcggactgaacggggtggatatctactccttggtgaccgagaatatccaatggccaaatggcatcacccttgacctgctcagtgggcggctttactgggtggatagcaaactgcacagcatttcctcaattgatgtgaacggaggaaaccgcaagaccatcctcgaagatgaaaagcggctggcgcacccgttctcactggcggtgttcgaagataaagtgttctggacggatatcatcaacgaggccatcttttccgccaatagactcaccggcagcgatgtgaacctgttggccgagaatttgttgagcccggaggacatggttctcttccacaacctgacgcaaccgagaggagtgaactggtgcgagagaactaccctgtccaacggcggttgccaatacctctgcctgccagccccgcagatcaacccacactcgcctaaattcacttgcgcctgtccagacggaatgttgctggcgcgggacatgcgctcgtgcctgaccgaagctgaagcggctgtcgcaactcaggaaacttcgaccgtgcgtctcaaagtatcgtcaacggccgtccggacgcagcacactactacccgaccggtgccagacacctcccggctgccgggagcaacccccggccttactactgtcgagatcgtgaccatgtcgcatcaagccctcggagacgttgctggaagaggaaacgagaagaagcccagcagtgttcgtgccctctcaattgtgctgcccatcgtgctgctcgtgtttctgtgcctcggagtctttctcctgtggaagaactggcgcctgaagaatatcaatagcatcaactttgataatcctgtttaccaaaaaaccactgaggatgaggtccatatctgccacaaccaagacggctactcgtacccttctcgccagatggtgagccttgaagatgatgtcgcg

SEQ ID NO: 228 - DNA, 2580 bp, Artificial Sequence
  Description of Artificial Sequence: Synthetic Transcript Sequence
atgggtccatgggggtggaaacttaggtggacggtcgcactgcttctggcggccgcaggaactgcagtgggggataggtgtgaaagaaatgagttccagtgtcaagatggtaagtgcatttcatacaagtgggtgtgcgatggaagcgccgaatgtcaagacggctccgacgagtcccaggagacttgtctctcggtgacgtgcaagtcaggagatttctcttgcgggggaagggtgaacagatgcatacctcaattttggcgttgcgatggtcaggtggattgtgataacggaagtgacgaacaagggtgtcctccaaagacttgttctcaggatgagtttagatgccatgacggcaagtgtatttcgagacaatttgtgtgcgatagcgatagagattgcctcgacggatcagatgaagcaagctgtcctgtcctgacgtgcggccccgcttcctttcaatgcaactcgtctacttgtattccgcagctgtgggcgtgtgataacgatcccgattgtgaggacggttcggatgaatggccacagcgttgtcgggggctgtacgtctttcagggcgattcctcgccatgctccgcgttcgaattccattgcctgtcaggagagtgcatccattccagctggcggtgcgatggtggccctgattgcaaggacaagtcagatgaggagaactgtgcagtcgcaacgtgcaggccggatgagtttcaatgttcagacggtaattgcatccatggatcccggcagtgcgatcgcgagtacgactgtaaggatatgtcagatgaagttggatgtgtcaacgttaccctgtgtgaggggcctaataagtttaagtgccatagcggggagtgtatcaccctggacaaagtatgtaacatggcacgagattgtcgggactggagcgatgaacctatcaaggagtgcggaaccaatgagtgtcttgataacaacggtggatgctcccatgtgtgtaatgaactgaagattggctatgaatgtctttgccctgatgggtttcagttggtcgcacagcggaggtgtgaagatatagacgagtgtcaggatcccgatacttgtagccagctgtgtgtcaacctggaaggaggatataagtgtcagtgcgaggaaggattccagcttgacccccatactaaagcatgtaaggctgtgggatccattgcctacttgtttttcactaaccggcacgaagtcagaaaaatgactcttgatagaagcgagtacactagtcttattccaaaccttcggaatgtggtcgcactggatacggaagtggcatccaatcgcatctattggtccgatctttctcaacgtatgatttgttcgactcagctcgaccgagcacatggagtgagcagctacgacactgtgattagccgcgatattcaagcccctgatggtcttgctgtggattggattcatagcaacatttactggaccgacagcgtgcttggtactgtctcggtggcagacaccaagggggtcaaacgtaagaccctgtttcgagaaaatgggagcaaaccacgagcaatagtggtggatcctgtgcatggatttatgtactggaccgattggggcaccccagcgaagataaagaagggaggcctcaacggtgtggacatttactctctggtgactgagaatatccagtggccaaacggtattaccctggatctcctttcggggagactctactgggtcgattcaaaactccactctatttcgagcatcgacgtgaatggcggaaatcgaaagactattcttgaagatgaaaagcgcttggcacacccatttagccttgctgtattcgaagataaggtgttttggactgacattatcaatgaagcaattttctccgccaatcgtctgactggttccgatgtcaacctgcttgccgaaaacctcctttcacccgaggacatggtgctttttcacaatctcacccagcctagaggggtgaactggtgcgaacggactactctgtcgaacggcggatgtcagtacttgtgtctccccgctccccagatcaacccacatagcccaaagtttacttgtgcatgtcctgacgggatgctgcttgcccgcgatatgcgcagctgcctcaccgaagctgaagcagcagtcgcaactcaagaaacctctactgtgcgcctcaaagtgagctccaccgcagttcggactcagcacactaccactcgccctgtgccggatacctcccggctgccaggcgcaacgcctggtcttactacggtcgagatcgtgactatgtcacatcaagcactgggggatgtggccggaaggggaaacgaaaagaaaccgtccagcgtgagagcactttccattgtcctccccatcgtgcttctggtctttttgtgtctgggtgtgtttcttctgtggaagaattggagactcaagaacattaactcaattaacttcgacaaccctgtctaccaaaaaaccactgaagatgaagttcacatatgccacaaccaggatgggtactcatacccttcgagacagatggtgtcgctcgaggacgatgtggca

SEQ ID NO: 229 - DNA, 2580 bp, Artificial Sequence
  Description of Artificial Sequence: Synthetic Transcript Sequence
atgggtccttggggatggaaactcaggtggaccgtggccctattactagctgccgccgggaccgccgttggcgatcgttgtgagagaaatgaattccagtgtcaggacggaaaatgtatcagctataaatgggtgtgtgacggcagcgcagagtgtcaggacggttctgatgagtcacaggagacatgtctctccgtgacatgcaaatctggggacttcagttgtggcggccgcgttaatcggtgtataccgcaattctggcgatgcgacgggcaggtcgactgcgataatgggagcgacgaacaggggtgccctcctaagacatgctcccaagacgaattccgctgtcacgacgggaaatgcatttcacgtcagtttgtatgcgacagtgatcgggactgtttggatggctccgatgaggccagttgtccagtgctcacctgtggccccgcttcatttcagtgtaacagctctacttgcatcccacagctgtgggcgtgcgacaatgatccagattgtgaggacggttccgatgaatggccacagagatgccgagggctgtacgtgttccaaggggactcgagcccatgtagcgcctttgaatttcattgtttaagcggggaatgcatccatagctcatggcgctgcgacggcggtcccgattgcaaggacaagtcagatgaggagaattgcgccgtggcaacatgccgccccgatgagtttcaatgctccgacggcaattgcatacacggttcgaggcaatgcgaccgcgaatacgactgcaaagacatgtctgacgaggtggggtgtgtcaacgtgaccctgtgtgaagggccgaataagttcaaatgccactcaggagagtgtatcacactggataaggtgtgcaacatggctcgggactgccgcgattggtctgacgagcctattaaagaatgcggaaccaacgaatgtctggacaacaacggggggtgctcacacgtgtgcaacgaattaaagatcggttacgaatgtctgtgccctgacgggtttcagctggtggctcagagaaggtgtgaagacatagacgaatgccaggaccccgacacttgctcacagctgtgcgttaacctggagggtggctacaagtgtcagtgcgaggagggattccagctggatcctcacactaaggcatgcaaggcggtaggcagtattgcctacttatttttcaccaatcggcacgaggtgcggaaaatgaccctcgaccggtccgagtacacctccctgatacctaatcttcgcaacgtggtcgcactggataccgaggtggcaagtaataggatctactggagtgatctgtcccaacgaatgatttgttccacacaattagatagggctcacggtgtgagctcctacgacacagtgatttctagggacatccaggcacccgatggcttggccgtggactggattcattctaacatctattggacagattctgtccttgggacagttagtgttgccgacactaaaggagtaaagcggaagaccttatttagggaaaacggcagtaaaccaagggcaatcgtggtggatccagtgcacgggtttatgtactggaccgactggggtacaccggctaaaattaagaaaggtggtctgaacggggtcgatatttattccttagtgaccgagaatattcaatggccgaatggaatcaccctcgatctgctgtcggggcggctgtactgggtcgattcaaagctacattcaatctccagcatcgacgtgaacggagggaataggaagaccattctagaggatgagaaacgtctggcacatcccttctccctcgcagtattcgaagataaggtgttctggacagacatcataaacgaggctattttctccgcgaacagactgacaggaagcgatgttaaccttctggcagaaaatctactaagtcccgaggacatggtcctattccacaatcttacacagcctcgaggcgtcaactggtgcgaacgaaccacattgtcaaacggtggttgccagtatctgtgcctccctgctcctcagattaacccccacagccccaagttcacctgcgcttgccctgatgggatgctgctggccagggatatgcgctcttgtctgaccgaagccgaagccgcggtagccacacaggaaacatcaaccgttcggctgaaagtaagttcaactgccgtccgcacacagcacacaacaactaggccagtgcctgatacgtctcgcttacccggagctacaccaggacttaccacagtggaaattgtgaccatgagccaccaggctctgggagatgtggcaggaagaggaaacgagaaaaagcccagttctgtgagagccctaagcatagtgctgcccattgtactattggtgtttctgtgccttggcgtattcctactttggaaaaattggaggctgaagaatattaattctatcaactttgataaccccgtctaccaaaaaacgaccgaagacgaggttcacatctgtcataaccaggacgggtattcctacccctctcgccaaatggtgtcactagaagatgacgttgcc

SEQ ID NO: 230 - DNA, 2580 bp, Artificial Sequence
  Description of Artificial Sequence: Synthetic Transcript Sequence
atgggaccatggggctggaagttgcgctggactgttgcccttttgctggctgcagctggaactgccgtgggagacagatgtgaaagaaacgagtttcagtgccaggacggaaaatgtatcagctacaagtgggtttgtgatggctccgccgaatgccaagatggctccgacgagagccaggagacttgcctttccgtgacctgcaagagtggagatttctcctgcggaggacgcgtgaatcgctgtattcctcagttctggcgctgcgatggacaagtggattgcgacaatggaagcgatgagcaaggctgtcctcctaagacctgttcccaggacgaattcaggtgtcacgacggtaagtgcatctcaaggcaattcgtatgcgattccgaccgcgactgccttgacggaagcgacgaagcttcatgccctgtgctgacttgcggtccagctagctttcagtgtaacagttctacttgtattccccaactttgggcatgtgataacgaccccgattgcgaggacggctctgacgaatggcctcagagatgccgcggcctctacgtctttcaaggcgacagttcaccctgcagcgcattcgaattccattgcctgtctggcgagtgcattcacagcagttggaggtgtgatggtggtcccgattgcaaggacaagtccgacgaggaaaactgtgcagtggctacctgccgtcctgacgaatttcagtgtagcgacggtaattgtatccatggttctcgtcaatgcgacagagagtatgattgcaaggatatgtcagacgaggtgggttgcgtgaatgtcactctgtgcgagggtccaaataaattcaagtgtcacagcggcgaatgcataacactcgacaaagtgtgtaacatggctagagattgcagagattggtctgatgagccaatcaaagagtgtggaactaacgagtgtctggacaacaacggcggatgctctcacgtttgcaacgagctgaaaatcggctacgaatgtctgtgccctgatggcttccagctcgtggcccagaggcgctgtgaagacattgatgaatgtcaagatccagacacctgctcacaactgtgcgtgaacctggaaggcggctataagtgccagtgcgaggagggcttccaactggatcctcacaccaaggcttgcaaggcagtcggttccatcgcttacctgttctttactaatagacatgaagtccgtaagatgacactggaccgctccgagtacacttcactcatacctaatttgaggaacgtggtagctctggacacagaggtagcctccaacaggatatactggtctgacctgagccaacgtatgatttgctccactcagttggatagggctcatggagtatccagttatgatactgtcatctcccgcgatatccaggcaccagatggactggctgtggattggattcatagcaacatttactggacagacagcgtcctgggcactgtaagcgtagccgacaccaagggtgtgaagaggaagacactttttcgcgaaaatggctctaagcccagagctatcgtggtggatcctgtgcatggctttatgtactggaccgattggggtacccccgccaagatcaagaagggtggcctgaatggagtggatatctattctctggtgactgagaatattcaatggccaaatggcatcacattggatctgctttcaggccgcctttactgggtcgattcaaaactgcacagtatctctagcatcgacgtgaacggcggaaaccgtaagaccatcttggaggacgaaaaaaggctggcccaccccttcagtctcgcagtgtttgaagacaaggtcttctggacagacattatcaatgaagcaatcttttctgctaatcgtctgaccggttccgacgtgaatcttcttgctgagaatctgctttccccagaggacatggttttgtttcataatctcacccagccccgtggagtaaactggtgcgaaaggactactttgtccaacggcggctgccagtacctgtgcctgcctgcccctcagatcaaccctcacagtcccaaattcacctgtgcatgccctgacggcatgcttctggctcgtgacatgagatcctgtctcaccgaagcagaggcagctgtagcaacacaagagacttcaacagtgcgtctgaaggtctctagcactgctgttcgtacccagcacacaaccactcgccctgtgccagatacctcccgtcttcccggcgccactcccggcctgactacagtagagatcgtcacaatgtcccatcaagccctgggagacgtcgcaggccgtggcaacgagaagaagcccagttctgtccgtgctctgtctatagtgttgccaattgttctgctcgttttcttgtgtctgggagtgttcctcctgtggaagaactggcgcttgaaaaacatcaacagtattaacttcgacaaccccgtgtatcagaaaactaccgaagacgaagtgcatatctgccataatcaggacggttactcttacccaagcagacagatggtctctctggaggacgacgtagct

SEQ ID NO: 231 - DNA, 2580 bp, Artificial Sequence
  Description of Artificial Sequence: Synthetic Transcript Sequence
atgggaccgtggggctggaagttgcgctggactgtcgcacttctcttggcggcagcaggaactgcagtgggggaccggtgcgagaggaatgagtttcagtgtcaagacggcaagtgtataagctacaagtgggtgtgtgatggatcggctgagtgccaagatggatcagacgaatcgcaggaaacctgtttgtcagtgacgtgtaagtcaggcgatttttcatgtggtggcagggtgaacaggtgtatccctcaattttggagatgcgatggacaggtcgattgcgataatggatctgacgaacaaggatgtccacctaaaacctgtagccaggatgaattccgctgccatgatgggaagtgtatatcgcgccaatttgtctgcgactcagacagagactgcctggatgggtccgatgaagcatcatgtccagttctgacttgtggaccggcttccttccaatgtaactcctccacctgtatccctcagctctgggcctgtgataatgatcccgactgtgaagatggcagcgacgaatggcctcagcgttgtaggggtttgtacgtctttcaaggagactcgtccccgtgttcggccttcgaattccattgtctgtccggggaatgtattcacagctcgtggagatgtgatggtggaccagattgtaaagataaaagcgacgaggaaaactgtgccgtggcaacctgtcgccccgacgaattccaatgttccgacggaaactgcattcatggttccagacagtgtgacagagaatacgactgtaaggacatgtcggatgaagtgggttgtgtgaatgtgaccctgtgcgaaggtcctaacaagtttaagtgtcattcaggagaatgtataaccctcgataaggtctgtaatatggcacgggactgtagagattggtcagatgaacccatcaaagagtgtgggactaatgagtgtctggacaacaacggaggttgttcgcacgtgtgcaacgagcttaagattggttacgagtgcttgtgcccggatggatttcaactcgtggcacagcgcaggtgtgaagatatcgatgaatgccaggaccctgatacttgttctcaactgtgcgtgaacctcgaaggcgggtacaagtgccaatgtgaggagggctttcaactcgacccccataccaaggcgtgcaaagcagtgggcagcattgcatacctgtttttcaccaataggcacgaggtgagaaagatgaccctcgatcgatccgagtacacctcattgattcctaaccttcggaatgtcgtcgctcttgacaccgaagtggcatcgaacaggatctactggtccgatcttagccagcgaatgatatgttcgacccaattggatagggctcatggcgtctccagctacgataccgttatcagccgtgatattcaagctccagacggccttgcggtggattggatacatagcaacatttactggactgattcggtccttgggactgtcagcgtggcagatactaagggagtcaaaagaaagaccctgttcagagaaaatggatcaaaacctagggcaatcgttgtggacccagtccacggttttatgtactggaccgattggggaactccggcaaagattaagaaggggggactgaacggcgtggacatttactcattggtgactgagaatattcagtggccaaacggcattacgcttgatctgctcagcggtcgcctttactgggtggattccaaactccactccattagctccatcgacgtcaacggcgggaatcgcaagaccattcttgaagatgaaaaacgtctcgcacatcccttctcactcgccgtctttgaggataaggtcttttggaccgacattatcaacgaggccattttctccgcaaatcgtcttaccggatccgatgtgaatctgcttgcagagaatctgctctctccagaagatatggtgctgttccacaatctgacccagcctcgaggtgtgaactggtgcgaaaggactactctgtcgaacggcggatgccagtacctgtgtctgccagcacctcagattaatcctcattcgccgaagtttacgtgtgcctgccctgatggtatgttgctggcacgcgatatgcgcagctgcctgactgaagcggaggcagccgtcgccactcaagagacttccaccgtgagactcaaggtgtcctcgaccgccgtgcgaactcagcatactacgactcggccggtgccagacacttcgagactccccggagcaaccccaggactgaccacggtcgaaattgtcacgatgtcacatcaagcactcggggacgtggcaggacgggggaacgaaaagaagccgtcatcggtgcgggcactcagcattgtgcttcctatcgtgctcctcgtgttcctgtgtctgggtgtgtttcttctgtggaagaattggcgactgaaaaacattaactcgatcaatttcgataaccctgtgtaccaaaagactaccgaggatgaggttcacatttgccacaatcaagacggatactcgtacccatcccgacagatggtgagccttgaagatgatgttgca

SEQ ID NO: 232 - DNA, 2580 bp, Artificial Sequence
  Description of Artificial Sequence: Synthetic Transcript Sequence
atgggcccttggggatggaaactccgatggaccgtggctttactcttggctgctgccggtaccgccgtgggtgaccgctgcgaacgcaatgaattccagtgtcaggatggcaagtgcatatcttacaaatgggtgtgtgacggctctgcggaatgccaggatgggagcgacgagagccaggaaacgtgcctttctgtcacctgtaaaagtggtgacttcagttgtggcggcagagtgaaccggtgtataccacaattttggcggtgcgacggccaagtcgactgcgacaacggcagcgatgagcaaggatgtcccccaaaaacttgtagtcaggacgaatttaggtgccatgacggcaagtgcatcagccggcagtttgtttgtgacagtgacagagattgcctggacgggtccgatgaagccagctgccctgttctgacgtgcggccccgcctcttttcagtgcaacagctccacttgcatcccccagctctgggcttgcgacaacgatccggactgcgaggacggatccgatgaatggccgcaaagatgccggggactgtacgtcttccagggcgacagttcgccctgctcagctttcgagttccattgtctatctggcgaatgcattcactcttcctggagatgtgacggcgggcctgattgtaaggacaaaagcgacgaggaaaactgtgcagtggccacttgccggccggatgagtttcagtgtagcgatggcaattgtatccatgggtcacgccaatgcgacagggagtacgattgcaaggacatgagtgatgaagtagggtgcgttaacgtgaccctgtgcgaaggtcccaacaagttcaagtgtcactctggggaatgtataacactcgacaaggtttgtaacatggccagggattgccgcgactggagcgacgagccgattaaggagtgcggcacgaacgagtgcttggacaataatggagggtgtagccatgtgtgcaacgagctgaagattggctatgagtgcttgtgcccagatggctttcagctcgttgcacagaggcggtgcgaagatattgacgaatgccaagacccggatacctgtagccagctctgtgtcaacctggaggggggatacaagtgccaatgcgaagaaggctttcagctggatcctcacacgaaggcatgtaaggcggtgggaagtatagcatacttgttcttcacaaatagacatgaggtgaggaagatgacactggataggagcgagtacacctcactgatccccaatctgcgtaatgtagtggccctggacacagaagtcgcaagcaaccgcatctattggagcgatctgtcacagcgcatgatatgttccacccaactggatcgggcccatggtgtgtcctcgtatgacaccgtcattagtagagacatccaggcgccagatgggctcgcagtggactggatccattcgaacatttattggacggattcagttctcggcactgtttccgtggctgatacaaaaggggtgaagcgcaaaaccctgttccgtgaaaatggatctaagcctcgagcaattgtcgttgacccggttcatggcttcatgtactggacggattgggggactcccgccaaaattaagaagggcgggcttaacggggtggacatatatagccttgttacggagaacatccaatggcccaacggaattactcttgatttgctaagcggaaggctgtattgggtcgacagcaagcttcactccatttctagcattgatgtgaatgggggaaatagaaagacgatactggaggatgaaaagcgcttagctcacccattttcactggctgtgttcgaggataaggtgttttggactgacataatcaacgaggcaattttcagtgctaacagactcactggatccgacgtgaaccttctcgccgagaacctactgtctccagaggatatggtgctatttcataacctgactcagccccgcggagtgaattggtgcgagcggacgaccttgagtaatggggggtgtcaatatctttgccttccggccccccagatcaaccctcacagcccaaaatttacctgtgcatgcccagacgggatgttactcgccagggatatgagatcctgcctcactgaggccgaggccgcagtcgccactcaagaaacatccactgtaaggctcaaagtgtcctccaccgcagtgcggacacagcacacgaccactcgccctgtaccagatacctcacgcctccctggggccacgccggggctaactaccgtcgaaatagttaccatgtcgcatcaagcattgggggacgtggccggccggggcaacgaaaagaagccaagttccgtgagagccctgtcaatcgtgttgccaatcgtcctgctggtctttctatgcctgggggtgttcctactgtggaagaactggaggttgaagaatattaatagcataaacttcgataaccctgtatatcagaagacaactgaggacgaggtacatatctgccataatcaggatggctacagctacccatcccgacagatggtgtcactcgaagacgacgtcgcc

SEQ ID NO: 233 - DNA, 2580 bp, Artificial Sequence; identical to SEQ ID NO: 223
  Description of Artificial Sequence: Synthetic Transcript Sequence

SEQ ID NO: 234 - DNA, 2580 bp, Artificial Sequence
  Description of Artificial Sequence: Synthetic Transcript Sequence
atgggcccatggggatggaagctaagatggacggttgccctgctgctggccgctgctggcacagctgtgggggaccgttgcgagagaaatgagtttcagtgccaggacggaaagtgcatctcttataaatgggtgtgcgacgggagcgctgaatgccaagacgggagtgacgagagtcaggagacctgcctgtcggtcacatgtaaatctggcgattttagctgtggaggtcgcgtgaaccgctgcattcctcaattttggcggtgtgacggacaggtcgattgtgacaatggaagcgatgaacaaggatgtccccctaagacttgctctcaggacgaatttaggtgccatgacgggaagtgtatttccaggcaattcgtctgcgactccgaccgggattgcctagatggatcagacgaggcctcctgcccggtcttgacatgtgggcccgcttccttccaatgtaattcttctacatgtattccacagttgtgggcttgcgacaatgatccagactgtgaggacgggtccgatgaatggccacagaggtgtaggggtctgtatgtgttccagggcgactcctccccttgttccgccttcgagtttcattgcctgtctggcgaatgcatccacagcagctggcggtgtgacgggggccccgattgcaaggacaagagcgatgaagaaaattgtgcagtcgcaacttgcaggcccgacgagttccagtgtagcgacggcaattgtattcatggttctaggcagtgcgaccgggagtacgactgtaaagatatgtcagacgaggtcgggtgcgtcaatgtgaccctctgtgagggtccaaacaaattcaaatgccatagcggcgaatgcatcacgctggacaaggtgtgtaacatggcacgcgactgccgcgattggagcgatgaacccattaaagagtgtgggaccaatgaatgtctggataataacggtgggtgcagccacgtgtgtaatgagctgaagattggctatgagtgcctgtgtccagatggcttccaactcgtcgcacagaggcgttgcgaggacatagatgagtgccaggatcccgacacgtgtagccagctgtgcgtgaacctcgaaggcggatacaaatgccagtgtgaggaagggttccaactggatccacacacgaaggcttgtaaggcagttggctccatcgcctacctgttcttcacgaacaggcatgaagttagaaagatgacgctcgatagatctgaatatacgtctcttatcccaaacctcagaaacgttgtggcattggacacagaagtggccagtaaccggatttattggtcagacctgtcccagcgcatgatctgcagtacacagttggatcgcgcccatggggtatcttcctacgacaccgtgatcagtagagatattcaagctccagacgggctagcggttgattggatccacagcaacatctactggaccgacagcgtgctcgggactgtttcagtggctgacaccaaaggggtgaaaagaaagacacttttccgggaaaatggatcgaaacctcgcgccatcgtggtcgaccctgtgcatgggttcatgtattggacggactgggggactcctgcaaagataaagaaaggagggctgaacggagtggacatttatagcttagttactgagaatatacagtggcctaacggtataacattggacttgctgtctggacgcctatattgggtggactctaaactccatagcatttcatctatagatgtgaacggtggaaatcgcaagaccatcctggaggatgaaaagcggcttgcccacccattttcactggctgtatttgaggataaggtgttctggactgatattataaatgaggcaatcttctccgctaatcgattgaccgggagcgacgtgaacctcctcgctgagaatctgctgtccccagaagatatggtcctgtttcataacctgactcagccgcggggcgtgaattggtgtgagcgcaccactctgtctaacggtgggtgtcagtatctatgcttgccagcaccgcagatcaatcctcactcacccaaatttacctgtgcctgtcccgacggtatgttgctagccagggacatgaggtcttgtctgactgaggcagaggccgccgttgcaacccaggagacaagcacggtgcgcctgaaggtgagctctacagcggttaggacgcagcataccactacccggcctgttccagatacgtcaaggctccccggagctacacccgggctgacaaccgtggagatagttacaatgtcgcatcaggcgctgggtgacgtggccggcaggggaaacgagaagaagccatccagcgtccgggcactttctatagttctgcccattgtcttactcgtgtttctttgtcttggtgtttttcttctgtggaaaaattggcggttgaaaaacattaactcaattaacttcgacaaccccgtttaccagaagaccacggaggacgaagtgcacatatgtcacaatcaggacgggtacagctaccctagcaggcaaatggtaagtttggaggatgatgtggca

SEQ ID NO: 235 - DNA, 2580 bp, Artificial Sequence
  Description of Artificial Sequence: Synthetic Transcript Sequence
atgggaccctggggctggaaactgcgctggaccgtggccctactgctggctgctgcaggcacggccgtcggcgataggtgtgaacggaacgagttccagtgccaagacgggaagtgtatctcctacaaatgggtgtgcgatgggtccgccgagtgccaagacggttccgatgagtcacaggaaacgtgtctttcggttacctgcaagtcaggcgactttagctgcggcggaagagtaaacagatgcatcccacagttctggagatgtgacggacaagttgactgtgataatggcagcgatgaacaagggtgcccacccaagacctgctcccaagacgagttcagatgtcacgacgggaaatgcatcagccggcaattcgtgtgtgactccgatagggactgcttagacggatcggatgaggccagctgccctgtgttaacatgcggacccgcctcctttcagtgtaattcctccacgtgcatcccacaactctgggcctgcgacaatgaccctgattgcgaggatggcagcgacgagtggccacagaggtgccggggcctgtacgtgtttcagggagatagcagcccatgtagcgcctttgagtttcactgcctgtctggcgagtgcatccattcctcatggaggtgtgacggtggccctgattgcaaagacaagagtgatgaggaaaactgtgcggtggccacctgccgccctgacgagttccagtgttccgacggaaattgtatccacggaagtcggcagtgcgacagagaatacgattgtaaggacatgtcagatgaggtgggatgtgtgaacgtgactctttgcgagggacctaacaaattcaagtgccattccggagaatgtatcacactggacaaggtctgcaacatggcccgagactgtcgtgactggtccgatgaaccaataaaagagtgcggtaccaatgagtgtctggacaacaatggtggttgttcacacgtatgcaacgaactaaaaatcggatacgaatgcctgtgccctgatggattccaattagtagcccagaggaggtgtgaggatatcgacgaatgccaggatccggacacctgctcgcagttgtgtgtgaatcttgaagggggttataagtgccagtgtgaagagggctttcaactggacccccatacaaaggcgtgtaaggcggttgggagcattgcatacttgttcttcactaaccgacacgaggtgcgcaagatgacactggaccgcagcgaatatacatccttgatccctaatctcaggaacgtggtcgcgttagacaccgaggtggcatccaacaggatatattggtctgatttatcgcaaaggatgatctgttcaacacagctggaccgggcccatggcgttagttcatatgacaccgtgatcagtcgcgatattcaggcccctgatggtctggcagttgattggatccacagtaatatatattggaccgattccgtactgggcaccgtgtccgtagcggacaccaagggcgtcaagcgtaaaaccttgtttcgggaaaatggaagtaagcctcgggccatcgtggttgatcctgttcatggatttatgtattggacagactggggcactcccgctaagataaagaaaggtggtctaaatggcgtggatatctactcattagtgacagagaacatccagtggcccaatgggattacactggatctgctgtctggccgtctctactgggtggatagtaagctccattccatcagttcaatcgacgtgaatggaggcaaccgtaagactatccttgaggacgagaagcggctggcacatccgttctccctagcggtgtttgaagataaggtgttttggactgacattatcaatgaagctatctttagtgcgaataggttaaccgggtcggatgtgaacctgttagccgaaaatcttctgtccccagaggatatggtcctgtttcataacctaacccagccgaggggtgtgaactggtgcgagcgcacgactctgtcaaatggcggatgtcagtacctgtgcctgccagctccacagattaacccgcacagcccgaagtttacctgcgcatgtcccgatgggatgctactggctagggatatgaggagctgccttacagaagcagaggcagcagtcgccacccaagaaacctccacagttaggctgaaggtttcatcgacagcagtcagaacccagcacactacaacacgtcccgtgcctgacacctcacggctgcctggggctactcccggactcacgacagtggaaattgtgaccatgagccaccaagcgcttggagatgtggctgggagagggaacgaaaaaaaacccagctccgtaagagccctgtctatcgtcttgccaattgttctgctggtcttcctgtgcttgggcgttttccttctatggaaaaactggcggctgaagaacatcaactctatcaattttgacaaccccgtatatcagaaaaccacagaggacgaggtacatatctgtcacaatcaggacggttattcttacccatcccgacagatggtgtcattggaagatgatgtcgcc

SEQ ID NO: 236 - DNA, 2580 bp, Artificial Sequence
  Description of Artificial Sequence: Synthetic Transcript Sequence
atgggaccctggggatggaaactgcgatggacggtggccctcctgctagccgccgccgggaccgccgtcggtgacaggtgcgagcgtaacgagttccaatgccaagatggaaagtgcatctcttataagtgggtatgtgatgggtcagctgagtgtcaggatggctcagatgagagccaggaaacttgcctgtccgttacttgcaagtctggcgatttctcatgcggcggacgcgtcaataggtgcattcctcagttctggaggtgcgacgggcaggtggactgcgataatgggagcgatgagcaaggctgcccaccaaaaacctgttcccaggacgaatttcggtgccacgacggcaagtgtattagccggcaattcgtgtgtgatagtgaccgggactgtctggatggctcggacgaagcgtcttgtcccgtgctcacctgtggaccagcgagcttccagtgcaattcaagcacctgcataccacagctttgggcatgcgataacgatcctgattgcgaggatgggtccgacgagtggcctcagcggtgccgcgggctgtacgtgtttcagggcgacagttccccctgttccgcctttgaattccactgcctttcaggcgagtgcatccatagctcctggcgctgcgacggaggccccgattgtaaggataaaagtgacgaggaaaattgtgccgttgctacttgccggccagatgagttccagtgttccgatggtaattgcatccatggttccagacaatgtgatagagaatatgattgcaaggatatgtccgacgaagtgggctgtgtgaatgtcacactgtgtgagggaccaaacaaattcaagtgtcactccggggagtgcattacactcgataaagtgtgtaatatggcccgtgattgtcgggactggtcggacgagccaataaaggaatgtgggacgaatgagtgtctggacaataacggtggatgttcgcacgtgtgcaatgagctgaagatcggttacgagtgcttgtgtcccgacgggttccagctcgtcgcacagcgtcgctgcgaggacatcgacgagtgccaggaccctgatacctgctcccagctgtgcgttaatctggagggaggatacaagtgtcagtgcgaggagggcttccagcttgatccccacaccaaagcttgtaaagccgtggggtccattgcttacctgttcttcaccaacagacatgaagtgagaaaaatgacactggaccgcagtgaatatacttccttgatccctaacttgcggaatgtggtagcgctggacaccgaagttgcatccaataggatctactggtccgaccttagccagcgcatgatttgctccacccagcttgaccgagcccacggagtatcctcttacgatacggtgatttcacgcgacatccaggcacccgacggacttgccgtggactggatccactcaaacatctactggactgactccgtactcggtaccgtgagcgtagccgataccaagggcgttaagcgcaaaacattgttccgtgagaatggcagcaagcctcgcgcaattgtcgttgacccagtgcatgggttcatgtattggaccgactggggcactcccgcaaagattaaaaaaggtggcctgaatggcgtggacatctactcattggttactgagaatatacagtggcccaatggcataacattggacctactgtctgggcggctatattgggtcgatagcaagctgcacagcatctcatcaatcgatgtcaatggcggtaatcggaaaaccatcttggaggacgagaaacggctggcccacccctttagtctggctgtatttgaagataaagttttctggaccgatatcattaatgaggctattttttcagctaatcgactcaccgggagcgacgtcaacttactggccgagaatctcctgtcaccagaagacatggttctatttcacaacctgacacagcctcggggcgtgaactggtgtgagcggacaactctctccaatggaggatgtcagtacctttgtcttccagctcctcagataaacccgcacagtcccaagttcacttgcgcctgccctgatggcatgctgttagctcgtgatatgcggtcatgcttaacggaggccgaagcggcggtggccactcaagaaacgtctacggtcagactcaaggtatcatctacagcggtgaggacacagcacacaacaaccagacctgtgcctgatacaagcaggctgccaggggccactccagggctcactactgtagaaatcgtgacaatgtcacatcaggccctaggggacgtggctggacgcggaaacgagaagaaaccaagctccgtccgggctctgtcaattgttctgcctattgtgctgttggtgttcttatgtctcggggtttttctgctctggaagaactggcggctgaaaaacattaactcaattaatttcgataacccagtttatcaaaaaactaccgaggacgaggtgcatatctgtcacaaccaggacgggtatagctacccctctcggcagatggtctcactggaggacgatgtggcc

SEQ ID NO: 237 - DNA, 2580 bp, Artificial Sequence
  Description of Artificial Sequence: Synthetic Transcript Sequence
atgggaccatggggatggaagctgcggtggaccgtcgctctcctccttgccgcggccggaactgcggtgggagacagatgtgaacggaacgaatttcagtgtcaagacgggaagtgcatctcgtacaagtgggtgtgcgatggtagcgcagagtgccaagacggctcagacgaaagccaagagacgtgcctctcagtgacgtgtaagtcaggcgacttctcgtgcggcggacgggtgaacaggtgcatcccgcaattctggagatgcgacggacaagtggactgcgacaacggcagcgatgagcagggatgtccccccaagacctgctcgcaggacgaattcaggtgccatgatgggaagtgtatctcgcgccagttcgtgtgcgactccgaccgcgactgtctcgacggatccgacgaagcctcctgcccggtcctgacttgcgggcctgcaagtttccagtgcaattcatcaacttgcatcccgcagctgtgggcttgcgacaacgacccagactgcgaagatggatcagatgagtggccgcagagatgcagaggactttacgtgttccaaggcgactcgagcccttgctccgcgtttgaattccattgtctctcaggtgaatgcatccattcgagctggagatgtgacggaggcccagactgcaaagataaatcggatgaagagaactgcgctgtagccacgtgccgcccggatgagtttcaatgttcagatggaaactgtattcacgggtccagacaatgcgacagggagtacgattgcaaagacatgtcggacgaggtcggatgcgtcaacgtcaccctctgcgagggacctaacaagttcaagtgccactcaggggaatgcattactctggacaaggtgtgcaatatggccagagactgtcgcgattggtcagatgaaccgatcaaggagtgcggcacgaatgagtgcctggataacaatggcggatgcagccacgtgtgcaatgagcttaagatcggatacgagtgcctttgtccggatggattccagttggtggctcagcgccgctgcgaggacattgatgaatgccaagatccggacacgtgctcgcagctctgcgtgaacctggagggcggatacaaatgccagtgcgaagagggatttcagttggatccacacactaaggcgtgtaaggcagtggggtccatcgcctacctgttcttcacgaacaggcatgaggtccgcaaaatgacgttggatcggtcagaatacacctcactgatcccaaatctcagaaatgtggtggcgctggacactgaggtggcatccaaccgcatctactggtccgacctgtcgcagcgcatgatctgctcaacccagctcgaccgagcacacggcgtgtcatcctacgataccgtcatttcacgtgacatccaggcgccggacggcctggccgtggactggatccattcgaacatttactggactgattcggtgctgggtaccgtgtccgtcgccgatactaagggagtgaagcgaaagaccctcttccgagagaacgggtccaagcctagagctatcgtggtggatccggtccatggtttcatgtactggactgactggggaaccccggcgaaaatcaagaaaggtggactgaacggagtcgatatctactcgctggtcaccgaaaacatccagtggccaaacggcatcacgctggacttgctgtcgggccggctctactgggtggactccaagctgcattcgattagttcaattgacgttaacggaggaaaccgcaagactatcttggaagatgagaaacgcctggcgcatccgttctctctcgccgtgttcgaggacaaggtgttctggacggatatcatcaatgaggcgatcttcagcgcaaataggttgactggcagcgacgtgaatctgctggccgagaacctcctctcgcctgaggatatggtgctctttcataacctcacccagccacggggagtgaattggtgtgaacggaccaccctctcgaacggcggatgtcagtacctctgcctccctgccccacagatcaacccacactcgccaaagttcacgtgcgcatgcccggacggcatgctgctggcgagagacatgcggtcctgcctgactgaagccgaggccgccgtcgcgacccaagagacttcgactgtgcgcctgaaagtgtcctccactgccgtgcggactcagcacaccacgacccggccggtcccggacacctcccggctccctggcgcgactccggggctcaccaccgtggagatcgtgactatgtcccaccaggccctgggtgacgtggctggccggggtaatgagaagaagccgagctccgtgcgcgcgctgagcatcgttctcccgatcgtgcttctggtgttcctgtgcctcggagtgtttctgctctggaaaaactggcgactgaagaacatcaattcaatcaatttcgacaatccggtgtaccaaaagaccactgaggacgaagtccacatctgtcataatcaagatggatactcgtacccgtcacgccagatggtgtccctggaggacgatgtcgca

SEQ ID NO: 238 - DNA, 2580 bp, Artificial Sequence
  Description of Artificial Sequence: Synthetic Transcript Sequence
atgggaccttgggggtggaaacttaggtggaccgtcgcactgctgcttgcagctgccgggaccgccgttggagatcggtgcgagagaaatgagtttcagtgccaggacggaaagtgtatatcatacaaatgggtgtgtgatggttcggctgaatgtcaagacggctccgatgagtcgcaagagacttgtctgtcggtcacttgcaagtcaggcgacttctcctgcggtggtcgggtcaacagatgtattcctcaattctggagatgcgatggtcaagttgactgtgataacggatcggatgaacagggctgtccaccaaagacttgctcccaagacgaatttcgctgccacgatggcaagtgcatttcaagacaatttgtctgtgactcggatagggactgtcttgacggtagcgatgaagcatcctgcccagtccttacttgcggtcccgcctcgtttcagtgtaattcgtcgacttgcattcctcagctttgggcatgtgataatgatcccgattgtgaagatggaagcgacgaatggccacaacgttgtaggggactctacgtctttcaaggtgatagctcaccgtgttccgcattcgaattccactgcctgtcgggagagtgtattcatagcagctggcgctgtgacggaggaccggattgtaaggataaatccgatgaggagaattgtgcagtggccacctgtcgcccagacgaatttcagtgttccgacggaaactgtattcatggatcccgacagtgtgacagggagtacgattgtaaagatatgtctgatgaagtcggatgcgtcaacgtcactctgtgcgagggacccaacaagttcaaatgccattcaggagaatgcatcaccctcgataaggtgtgtaacatggcccgtgattgtcgagactggagcgatgaacccatcaaagaatgtggaacgaacgaatgtcttgataacaacggtggttgttcccatgtctgcaacgagttgaaaataggttacgaatgtctctgtcccgacggattccaactcgtggcacagcgtagatgtgaagatattgacgagtgccaggatcctgacacttgctcgcaactctgtgtcaaccttgagggaggctataagtgtcagtgtgaagaaggttttcagctggatccgcatactaaggcatgcaaggccgtcggttcgattgcgtatctgttctttactaacaggcatgaagtgcgcaaaatgactcttgaccgatcagaatacacttcactcataccaaacttgagaaatgtggtggcactggacactgaggtcgcatccaataggatatactggtccgatctgtcccagcggatgatctgttcgacccagcttgatagagcgcatggcgtgtcgtcatacgacactgtgatttcccgggatatccaagcacctgacggtcttgcggtggattggatacactcgaacatatactggactgacagcgtgcttggaaccgtctccgtggctgacaccaagggagtgaagaggaaaactctttttcgtgaaaatggatctaagccgagggcaatcgtggtcgatcctgtgcatgggttcatgtactggaccgattgggggaccccggcaaagatcaagaagggcggactgaatggcgtggatatctactcgcttgtgacggaaaacatccaatggcccaacggaatcactctcgacctcttgagcgggcgattgtactgggtggattcgaaacttcactccatttcttcgatcgacgtcaacggcggaaatcgtaaaaccattctggaggatgaaaaacgacttgcacacccattttcgctggcggtctttgaagataaggtgttctggaccgacattatcaatgaggccatcttttcagcgaaccgactgaccggctcggatgtcaatctgttggcggaaaacctgctgtcgccagaagatatggtcctttttcataatctgacccaacctcggggagtgaattggtgtgagcgtactacgctctcgaacggtgggtgccagtacctgtgtctgcccgcaccccagataaacccccactcccctaagtttacttgtgcatgtcctgatggcatgctcctggcgagagacatgagaagctgcttgacggaggcagaggccgctgtggctacccaggaaacttccactgtcaggctgaaggtttcgtccaccgcagtccgtacccaacacacgaccactagacccgtgcccgatacctcacgccttcctggagccactccagggcttaccaccgtggaaattgtcaccatgagccatcaagcacttggggatgtggcaggtcgggggaacgaaaagaaaccgtcgtcggttcgcgccctttcgattgttctgcctatcgtgcttcttgtgttcctgtgcctcggcgtgtttttgctgtggaagaactggcgccttaagaacatcaactcaatcaactttgataatccagtctaccaaaaaactacggaggacgaagtgcacatttgtcataaccaggacggatactcatatccgtcccgccaaatggtttccctcgaggatgacgtggcc

SEQ ID NO: 239 - DNA, 2580 bp, Artificial Sequence
  Description of Artificial Sequence: Synthetic Transcript Sequence
atgggcccttggggttggaagctgcgctggaccgtggcactgctcctggccgctgccggcaccgcggtaggtgataggtgcgaaaggaacgaattccaatgtcaggatggtaaatgcatctcatacaaatgggtgtgtgatggctcagctgagtgccaggatggttcagacgagagccaagagacatgtctcagcgttacctgcaaatcaggagacttcagctgcgggggtcgtgtaaataggtgcatcccacagttttggaggtgcgatggacaggtggactgcgacaacggatctgatgaacaaggctgcccaccaaaaacctgttcacaggacgaatttcgctgccatgatggcaaatgcatcagccgtcagttcgtgtgcgattctgatcgggattgcttagacggctcagatgaggccagttgcccagtgctgacctgcggcccagcctcatttcaatgtaactcgtctacctgtattcctcagctgtgggcatgcgataacgacccagactgtgaggacgggtctgacgagtggcctcagagatgcagaggtctgtatgttttccagggcgactcttccccttgctctgcattcgagtttcactgtctgtcaggcgaatgcatccattcttcctggagatgtgacggtgggcctgactgcaaagacaaatctgacgaggagaactgtgcggtggctacctgtaggcccgacgaattccagtgcagcgatggcaattgtatccacggttccaggcagtgcgatcgggagtacgactgcaaggatatgagtgacgaggtaggatgcgtgaacgtcaccctgtgtgaaggtcccaataaatttaagtgccatagcggggaatgtataacccttgacaaagtctgcaatatggccagggattgccgcgactggagtgacgaacctattaaagagtgtggaacgaacgaatgtctggataataatgggggctgctctcacgtgtgtaatgaattgaagatcggatatgagtgtctctgccctgatggatttcagctggtcgcacagcgacgttgcgaagacattgatgagtgtcaggatccagacacttgttctcaactatgcgtgaacctagaaggagggtataaatgccaatgtgaggagggctttcaactcgaccctcacaccaaggcttgcaaggctgtgggcagcatcgcatatctgtttttcacaaatcggcacgaggtgcggaagatgacattagacagatcggaatatacgtcccttatccccaacctcaggaacgtggtagccctggatacggaagtcgcctctaacaggatatattggagcgatctctctcaaaggatgatctgcagcactcagctggaccgggcacacggggtttcttcctacgacactgtcatctcccgagatattcaggcccctgatgggctggctgtggactggatccacagcaacatctattggactgattcagtgttaggcaccgtgagcgttgcggataccaaaggcgttaaaaggaagaccttatttcgggagaatgggagcaaaccaagagccatcgtcgtggacccagtccacggttttatgtactggactgactggggcacgccagctaaaatcaagaagggcggactgaacggcgtcgacatttactcactagttacagagaatatccagtggcccaatggcatcacgctcgacctcctttcaggcaggctgtactgggttgatagtaagcttcacagcatcagcagcatcgacgtaaatggaggcaataggaaaacgatcctcgaggatgaaaaacgactagctcacccatttagtttagccgtgtttgaagataaagtgttctggactgatattattaatgaagccattttctcagctaaccgcctgactgggtctgatgtaaacttactggcagagaatttattgagccctgaggatatggtgctgttccataatcttactcagccacggggagttaactggtgtgaacgcaccaccttgagcaacggaggatgccagtacctatgcctcccagcaccacagattaacccacactcaccgaagttcacttgtgcatgccccgatgggatgctcttggccagagacatgcggtcgtgtttaaccgaagcagaagccgccgttgccacccaagaaactagtacagttagactaaaagtaagctcaaccgccgtgcgcacacaacataccactacccgtcccgtgccggatacctcccgcctgcctggcgctactcctggactgactaccgtcgagattgtcaccatgtctcaccaagccctgggcgatgttgcaggcagaggaaatgagaaaaaaccatccagcgttcgtgcactatccattgtcctgccaatagtcctgctggtgtttctctgtctcggcgtcttcctattatggaaaaattggaggttaaaaaatatcaatagtatcaactttgataaccctgtctatcagaagacgactgaggatgaggtgcatatttgtcataaccaggacggatatagttacccttctagacagatggtgagtcttgaagacgatgtagct

SEQ ID NO: 240 - DNA, 2580 bp, Artificial Sequence
  Description of Artificial Sequence: Synthetic Transcript Sequence
atgggcccgtggggatggaagctgcgctggaccgtggcgctgctcctggccgccgcaggcactgccgtgggggacaggtgcgaacggaatgaatttcagtgccaagatggtaagtgcatcagctacaagtgggtgtgcgatggttcggccgagtgtcaggatggctcggacgaaagccaggaaacctgcttgagtgtcacttgcaaatcaggcgacttttcgtgcggaggcagggtgaatagatgtatcccacagttttggcgctgtgatggccaggtggactgcgacaacgggtcggacgagcaaggctgccctcctaagacttgcagccaggacgaattcagatgccatgatggaaagtgtatctcgcggcagtttgtgtgcgattcggatagagattgcctggacggatcggacgaagcatcctgcccggtgctgacctgcggacccgcctccttccagtgtaacagctcaacctgcatccctcagctgtgggcctgtgacaatgatccggattgtgaggacggatcagacgagtggccgcagagatgccgcggcttgtacgtgttccaaggagactcctcgccgtgctcagccttcgaattccactgcctcagcggagaatgcatccattcgtcgtggcggtgcgatggcggaccagactgcaaagacaagagcgatgaagagaactgcgccgtggcaacctgtcgtccggatgaattccaatgctccgatggaaattgcatccatgggtcgcgccagtgcgaccgcgaatatgactgtaaagacatgagcgatgaggtgggctgcgtgaatgtgaccctgtgcgagggcccaaataagttcaagtgccactccggtgagtgcatcaccctggacaaggtttgcaatatggcacgggactgccgggattggtcggatgagccgattaaggaatgcggcaccaacgaatgcttggacaacaacggaggctgttcgcatgtgtgtaatgagctgaagatcggatacgagtgcctgtgtcctgatggattccagctggttgcccaacggcggtgcgaggacatcgacgagtgccaagatccagacacctgctcccagctgtgtgtgaatctggaaggtgggtacaagtgccagtgtgaggaagggttccaactggacccgcacactaaggcctgcaaggcggtgggttccattgcgtacctgttcttcaccaaccggcacgaggtccggaagatgaccctcgatcggtccgagtacacttcactgatccccaatctgcgtaacgtggtggcgctcgacaccgaagtcgcatcgaaccgcatatactggagtgacctgagccaaaggatgatctgctctacccagctcgatcgggctcacggtgtctcgtcctacgatactgtgatctcccgcgacatccaggccccggatggcttggcggttgactggatccattcaaatatctactggactgacagcgtgctgggcactgtcagcgtggcggatacgaagggcgtgaagcggaaaaccctgttccgcgaaaacggcagcaagccaagggccatagtggtggatccggtccacggattcatgtattggaccgattggggaaccccagccaaaatcaagaaaggaggcctcaacggagtggatatctacagcctggtcactgagaacatccagtggccgaacggaatcaccctggatctcctgagcgggcgcctctactgggtcgactcgaaactccactcaatctcgtccatcgacgtcaacggcgggaatcgaaaaactatcctggaggacgaaaagcggctcgcacacccgttctcgcttgctgtgttcgaagataaggtgttctggaccgacattatcaacgaagcgatcttttccgcgaaccgcctgactggtagtgacgtcaacctgttggccgagaatctgttgtcaccggaggacatggtgctgttccataacctgacgcaaccgaggggagtcaactggtgtgagcggaccaccctgtctaacgggggttgccagtacctctgtctgccggcgccacaaatcaacccccattcgcccaagttcacctgcgcctgcccagacggaatgctgttggcacgggacatgcggtcctgtctgaccgaagccgaagctgccgtggcgactcaagaaacgtcaaccgtgagactcaaggttagctcgactgccgtgagaacccagcataccactactaggccggtcccggacaccagccggctgcccggggccaccccgggactcaccaccgtggagatcgtcactatgtcacatcaggcactcggtgacgtcgcaggaagagggaatgagaaaaagccgagctccgtgcgggccctgtcaatcgtgctgccgatcgtgcttctggtgtttctttgtctcggagtgttcctcctttggaagaactggcgcctgaagaacattaactcgatcaacttcgataacccagtgtaccagaaaaccacggaggacgaagtgcatatctgtcacaatcaggatggttactcctacccttccagacagatggtatccctggaggatgacgtggca

SEQ ID NO: 241 - DNA, 2580 bp, Artificial Sequence
  Description of Artificial Sequence: Synthetic Transcript Sequence
atgggaccttggggctggaaactccggtggactgttgccttgctactcgccgcagctgggactgccgtcggggatcgatgcgagaggaatgagtttcagtgtcaggacggcaaatgtatctcatacaaatgggtgtgcgatggcagcgccgagtgccaggacggcagcgacgagagccaggaaacctgcttatccgtaacttgcaaatcgggcgatttctcttgtggcggccgagtcaatcgatgtattccacagttctggcgatgcgatggacaagtagactgcgacaatgggtccgatgagcaaggatgtccccccaagacctgcagtcaagatgagttccggtgccatgacgggaagtgtatctcccgccagttcgtgtgtgattctgacagagattgcctggatggttccgatgaggcctcctgcccggtgctgacatgcgggcctgcttctttccagtgcaatagctccacgtgcataccgcaactttgggcatgtgataatgatcccgactgcgaggatgggtccgatgagtggccacagcgctgcagaggcttgtatgtttttcagggggactcctcaccctgctccgcctttgaattccactgcctctcaggcgagtgcattcactccagttggaggtgcgacggcgggcctgactgcaaagacaaatctgacgaagagaattgcgccgtggccacatgccgtcccgatgaatttcaatgtagtgatggcaattgcatccacggcagccgccagtgtgatcgggaatacgattgcaaagacatgtccgacgaagtggggtgcgtgaatgttaccctgtgcgaaggtcctaacaaatttaagtgtcactctggggagtgtattacgctcgataaggtctgtaacatggctcgggactgtagggactggtcggatgagccaatcaaggagtgcggcacaaatgaatgtctcgataacaatggagggtgtagtcatgtgtgcaacgagttgaaaatcggctacgagtgtctctgccccgatggattccagctggtggcacaaagaaggtgtgaggacatagatgagtgtcaggaccctgacacctgctcacagctttgtgtaaacctggaaggaggatataagtgtcagtgcgaggaggggttccagcttgaccctcataccaaggcgtgcaaggctgttggcagcatagcatacctgttttttacaaaccggcacgaggtccggaaaatgaccttagacagatctgaatacacatcactcataccgaacctgcggaatgtagtggccctagatacagaagtggcatccaaccgcatctactggtccgacttgtctcagcgcatgatctgtagcacccaactagaccgagctcatggcgtctcatcctatgatacagtcatctctcgagacatacaggctcctgacggtttggcagtggactggatacattccaatatatactggaccgattccgtattgggcaccgttagtgtagctgatacaaagggagtgaaacgcaaaaccctgttccgcgagaacgggagcaaaccgagagccatcgtcgtcgaccccgtccacgggttcatgtattggacggactggggaacacctgcaaagataaagaaggggggtctgaacggcgttgacatctacagtttggtgacagagaatatccagtggccaaatgggattaccttggatctgctgtcgggacgactctactgggtcgactctaaactccatagcatttcctccatcgacgtgaatggcggcaaccgtaagacaattctggaggacgaaaagaggctggcacacccattctcccttgccgtgttcgaggataaagttttttggaccgacatcatcaatgaggcaatcttctctgctaacaggctcaccggatccgacgtcaaccttttggccgaaaatctcttgtcacccgaagacatggttttgtttcacaacctgactcaacccaggggcgtgaattggtgtgaaaggactactctgtccaatggaggctgccaatatctctgcctgcccgcccctcaaattaatccccactcgcctaagtttacctgcgcctgcccggatggtatgctgctagctagggatatgcgttcctgcctaacagaggccgaagccgccgttgctacccaggaaaccagcactgtgcgactgaaagtgtcttccactgccgttcgcactcagcatacaactactcgacccgtccccgacaccagcagactcccaggcgcaacgcctggtttaacaaccgtggaaatcgtgaccatgtcacatcaggcacttggtgacgtcgctggtcgggggaacgaaaagaagcctagctctgtgcgcgctctgagcattgttctgcccattgttctgctggtttttctgtgtcttggagttttcctcctatggaagaactggcgattgaaaaacataaattccatcaactttgacaacccagtgtatcagaagacgacggaggacgaggtccatatttgtcacaaccaggatggctattcatacccttccaggcagatggtgtcactggaggacgatgtggcc

SEQ ID NO: 242 - DNA, 2580 bp, Artificial Sequence
  Description of Artificial Sequence: Synthetic Transcript Sequence
atgggcccatgggggtggaagctcaggtggacggttgctctgctgcttgctgccgcgggtacagcagtcggcgataggtgcgaaaggaacgaatttcagtgccaggacggcaaatgtatctcatacaaatgggtttgcgacgggagcgcggagtgccaagatggctctgatgaatctcaggagacttgcttgtccgtcacatgcaagagtggagactttagctgcggcggccgggtcaacagatgtataccccaattttggaggtgcgatggacaggtggactgcgataacggctcagacgagcagggatgccctccaaagacttgttcacaagatgagtttcgctgccacgacggtaagtgcatctcccgccagttcgtgtgcgactccgatcgggactgcctagacggcagcgacgaggcttcctgtcctgtgctcacctgcggacctgccagtttccagtgcaactctagcacttgtattccacagctttgggcctgtgataacgatccagattgtgaggatggcagcgacgaatggccacaacggtgtcgcggactttacgtgttccagggggactcttctccctgttccgcatttgaatttcactgcctaagcggagaatgcatccattcctcctggagatgcgatggtggccctgactgcaaggacaagtcagacgaggagaactgtgccgtcgcaacctgtcgccccgatgagtttcagtgctccgatggtaactgcattcacggatcaaggcagtgtgaccgtgagtatgattgtaaggacatgagtgatgaggtcggctgtgtcaatgttacactgtgcgaaggtcccaataagtttaagtgccatagcggggagtgcatcactttagacaaggtctgtaatatggcacgtgactgcagggattggtccgacgagcccatcaaggagtgcggtaccaatgagtgcttagataataacggtggatgttcccatgtgtgcaatgaactgaaaattgggtatgagtgtctatgtcctgatggatttcagctagtggcgcagcgccgttgcgaagatattgacgaatgccaggaccccgatacatgtagtcagctgtgtgtgaaccttgaaggtggctacaagtgtcagtgcgaggagggttttcagctagatccacacacaaaagcatgcaaggccgtgggaagcattgcctatctgttttttaccaaccggcatgaagttcggaagatgactttggaccgctccgagtacacgtcactgataccgaacctgcgaaacgtcgtagctctggataccgaggtagctagcaaccgcatctactggtcagatctctcccagcgcatgatctgcagcacgcagctggaccgtgctcacggcgtctcttcctacgacacagtgatttctagagacatacaagctccagatggcctggctgtggattggatacacagcaatatctactggacagactcggtgctagggacagtctcagtggcggataccaagggagtgaagaggaagacattgttccgagaaaatggctcaaaaccgagagcaattgtagtggatcccgttcacgggtttatgtattggacggactggggcaccccggccaagataaagaagggaggcctgaatggagttgatatttactctttagtgactgagaacattcagtggcccaacggaattaccctggatctccttagtgggcgcctgtactgggtggactccaagctgcacagcatctcgagcattgacgtgaacggcggcaatcggaagactattcttgaagatgaaaagagattggcacaccctttctcccttgcagtctttgaggacaaggtgttttggacagatatcatcaacgaggcaattttttcagcgaaccggcttacggggtctgatgtaaacttactggccgagaatctgctgtcaccagaagatatggtgcttttccataaccttacgcagccccgtggtgtaaattggtgcgaaagaactactctgtctaatgggggctgccagtatctttgccttccagctccccagatcaatccccatagtcccaagttcacttgtgcttgcccggatgggatgctccttgctagggacatgaggagctgtctgaccgaggccgaagcggcggtggctacccaggagaccagtactgtgcggttgaaagtcagctccaccgctgtgcggacgcagcacacgacgacaagaccagtcccagacacatcacgcctgcccggagctacgccggggttaaccactgttgaaatcgtaacaatgagccatcaagccctcggcgacgtcgctggacgcggcaacgaaaaaaaaccctccagtgtcagggcactatctatcgtactgcccattgttctccttgttttcctctgccttggagtgttcctgctttggaagaattggcgtcttaagaatataaatagcatcaacttcgataaccccgtttaccagaagacaaccgaggacgaggtccacatctgtcataatcaggacgggtactcttacccgtcccgccagatggtcagcctggaggatgatgtggcc

SEQ ID NO: 243 - DNA, 2580 bp, Artificial Sequence
  Description of Artificial Sequence: Synthetic Transcript Sequence
atgggaccttggggctggaagttgcgttggaccgtggccttgctgctggcggctgccggaactgctgttggggacagatgtgaacggaatgaattccagtgccaggacggaaagtgcataagctataagtgggtgtgcgatgggtctgccgaatgccaggatgggtctgatgaatcacaggagacttgtctctcagtaacatgtaagagcggcgatttcagctgcggcggcagggtgaaccggtgtatacctcagttctggcggtgcgacgggcaggtggattgtgataatggttctgacgagcagggttgcccccctaaaacatgtagtcaggacgaatttaggtgccatgatggcaaatgcatctcaaggcagtttgtttgtgacagcgatagagactgcttggatggctctgacgaggcatcatgcccagttttgacatgcggcccggcatctttccagtgcaacagcagtacctgcattccacagctgtgggcctgtgacaatgatccggattgtgaggacggctccgacgagtggcctcagaggtgtcgcggtctctatgtctttcagggcgattcctcaccctgcagcgcttttgagtttcactgcctctcaggagaatgcattcattcttcctggcggtgtgacggtgggcccgactgtaaggataaaagcgatgaggagaactgcgctgtggcaacatgccgtccagatgagtttcaatgctctgatggcaactgtatccacggttccagacagtgtgaccgggagtatgactgtaaggatatgtccgacgaagtggggtgcgtgaacgtgaccctttgcgaaggtcctaataagttcaagtgtcatagtggtgagtgtattactctggacaaggtgtgtaacatggcccgtgactgccgcgattggtccgacgaacccatcaaggaatgcggcactaacgaatgcctagacaacaatggtggatgttcacacgtgtgcaatgagctcaaaatagggtatgaatgcctatgtcctgatggttttcagctggtggcccaacggaggtgcgaagatattgatgagtgtcaggacccagatacgtgctctcagctgtgtgtgaacctcgaggggggctacaaatgtcagtgtgaggagggatttcaactggatccgcatactaaggcctgcaaagctgttgggtccatcgcttacttgttctttaccaaccggcacgaggttcggaagatgactctggaccgatctgaatatacaagtctgatcccaaacctccgaaacgtcgtggccctggatacggaagtcgcctcaaacagaatttactggtcggatctctcccagaggatgatctgctccacgcagttggatagggcacatggagtgagttcgtatgacacagtgatctctcgggacatccaggctcccgatggcttggcagttgactggatccatagcaatatatactggactgattctgttctgggcactgtgagtgtcgccgatactaagggggtgaaacgaaaaactctctttcgggagaacggaagcaaacctcgggcaattgttgtggatcctgtgcatggatttatgtactggaccgactgggggacaccagcgaagatcaagaagggcggtttaaatggggttgatatttatagccttgtaaccgagaatatccagtggcctaatggtattacgctggacctgctctcgggtcgtctgtactgggtcgattctaaattgcacagcattagcagcattgacgttaatgggggtaacaggaagactattctggaggatgagaagaggttggcgcatccgtttagtttggcagtcttcgaggataaagtattttggaccgacataataaacgaggcaatttttagtgcaaaccgattgactggatccgatgtcaacctgttggccgagaacctcctgagtcccgaggatatggtgttattccataacctgacacagcctaggggcgtcaattggtgtgagagaacaaccttaagcaacggaggctgccagtacctttgtttgcccgcaccccaaattaatccacactcaccgaagttcacatgcgcctgtcctgatggtatgctactagctcgagatatgcgcagttgcctgactgaagctgaggctgcggtggctactcaggaaacttccactgtaaggctgaaggtgtcgtcaacagcggtccgaacacagcacaccacaacccgacctgtccccgacacatcacgactgcccggcgcaacacctgggctgactactgtcgagatcgtgactatgtcccaccaggccttgggggatgtggcgggccgtggaaatgaaaaaaagcctagcagtgtaagggccctctctatcgtgctccccattgtcttgctcgtcttcttatgcttgggagtgtttctcctttggaagaattggcgactgaaaaacatcaatagcatcaacttcgataaccccgtgtaccagaaaacaacagaagacgaggtgcatatttgtcataaccaggacggttactcctatccatctcggcagatggtgtcactcgaagatgacgtcgct

SEQ ID NO: 244 - DNA, 2580 bp, Artificial Sequence
  Description of Artificial Sequence: Synthetic Transcript Sequence
atgggaccctggggatggaagttgagatggactgtggcacttctcctggcagccgccggtaccgcagtgggagatcggtgtgaaaggaacgaattccagtgtcaagatggaaagtgtatctcctataagtgggtgtgtgatggttccgcagaatgtcaggacggatcggatgagtcccaggaaacttgcctgtcggtgacttgcaaatcgggagacttctcgtgtggaggtcgcgtcaacagatgtattcctcaattttggagatgcgatggccaagtggattgtgacaacgggagcgatgagcaaggttgtccccctaagacttgctcccaagatgaatttcgatgtcatgatggaaaatgtatttcccgtcagtttgtgtgcgattcggaccgcgactgcctcgatggcagcgacgaggcgtcctgtccagtgttgacctgcggtcctgcatcgtttcagtgtaattccagcacctgtattccccaactctgggcatgtgacaacgaccctgattgtgaggacggttcggatgaatggcctcagagatgtcgcggcctttacgtctttcagggagactcctcaccttgttcggctttcgaatttcattgcctgtcgggcgaatgtattcactcgtcgtggcgttgtgacggcggacccgattgtaaggacaagtcggacgaggaaaactgtgcggtcgcaacctgccgcccagatgaatttcaatgttcggacggtaattgcattcatggaagccgtcagtgcgaccgtgaatacgactgcaaggatatgtcagatgaagtgggatgcgtcaatgttaccctgtgcgagggccccaacaagttcaagtgtcattccggagaatgtattactctcgataaggtttgtaacatggcccgcgactgtcgggactggagcgatgaacctatcaaggagtgtggtactaacgaatgccttgataacaatggcggttgttcccatgtttgtaatgaacttaagattggatacgagtgtctttgtcccgatggatttcaactggtcgcacagaggcgttgcgaggacattgatgaatgtcaagacccagacacttgctcgcaactctgtgtcaaccttgaaggagggtacaagtgtcagtgtgaagaaggttttcagctcgacccacataccaaggcatgtaaggcggttggatcgattgcgtacctgttctttactaaccgtcatgaagtgaggaaaatgactttggatagatcggaatacacctcgctgattcccaacctccgcaacgtggttgccctcgataccgaggtggcaagcaacagaatctactggtcggatctgtcccaacgtatgatctgctccactcagctcgatagagcacatggtgtctcatcctacgataccgtgatttcccgggacattcaagcacccgatggcttggcggtcgattggatccatagcaacatttactggactgattccgtgcttggaaccgtgtcagtggcagataccaagggcgtgaagcgtaaaaccctctttagagaaaatggttcaaaaccaagggccattgtagtggatccggtccatggatttatgtactggaccgattggggaaccccagcaaagatcaagaagggtggcctcaatggagtggacatctactctctggtcaccgagaatattcagtggcccaacggtatcactctggatctgctgtccggtaggctctactgggttgactccaagctgcactccatttccagcatcgatgtgaacggcggaaaccggaaaactattctcgaggacgagaagagactcgcgcatcctttcagcctggcagtgtttgaggataaggtgttttggaccgacatcataaacgaggccattttctcggcgaatagacttaccgggtccgacgtgaatctgcttgccgagaacctgctttcacctgaagatatggtgttgtttcataaccttacccaaccgagaggggtcaattggtgtgagcggaccaccctgtcgaatggaggctgtcaatacctgtgccttcctgcgcctcagatcaacccgcactcccccaagttcacctgcgcctgtcccgatggtatgctgctggcaagggatatgagatcctgccttaccgaggcagaagctgcagtggctactcaggaaacttcaacggtgcgccttaaggtgagctcgacggcagtccggactcaacatactaccaccagacctgtccctgatacttcgcgccttccaggagcaacgccagggctcactactgtggaaatcgtgaccatgagccatcaggcactgggagatgtcgccggtcgtggtaatgagaagaagccttcgagcgtcagggcactctcgatagtgcttcctatagtgctgctcgtgtttctgtgtctcggggtctttctgctttggaagaactggcgactgaagaatatcaactccatcaactttgataaccctgtctaccagaaaactactgaagatgaagtgcatatttgccataatcaggacggctactcttacccatcgagacaaatggtgtcactcgaggacgacgtcgca

SEQ ID NO: 245 - DNA, 2580 bp, Artificial Sequence
  Description of Artificial Sequence: Synthetic Transcript Sequence
atgggcccatggggttggaagttgagatggaccgtggcactgcttctggcggctgcggggactgcagtgggggaccggtgtgagaggaacgaattccagtgccaggatggaaagtgtatcagctacaaatgggtgtgtgacggttcagcagaatgtcaagatggttcggacgagtcccaggaaacctgcctgtccgtcacttgtaagtcgggcgacttttcgtgcggcggaagggtgaacagatgtataccacaattttggcgctgcgacggacaagtggactgtgataacggaagcgatgaacagggctgtccccccaagacttgctcgcaagacgaatttaggtgtcacgacggcaagtgtattagcagacaatttgtgtgtgattcggatcgtgattgtcttgatggctcagacgaagcatcctgccctgtgcttacctgtggcccggcctcgttccagtgtaattcatccacctgtattccccaactttgggcttgcgataacgacccggattgcgaagatggctcagatgagtggcctcagaggtgtcgggggctgtacgtgtttcagggtgactcatccccatgctcggcatttgaattccattgtttgtcaggggaatgcatccactcctcatggcgctgtgatggagggccagactgtaaggataaatccgatgaggaaaattgcgcagtcgcaacctgccgacctgatgaatttcaatgttcagacggtaactgtattcacggatctcgccaatgtgatagagaatacgattgtaaggacatgtccgatgaagtgggatgcgtgaacgtgactctctgtgaaggaccaaataagtttaagtgccactctggagaatgcattactctggacaaggtgtgtaatatggcaagagattgtcgggattggtcggacgagcctataaaggaatgtggaactaatgagtgtctggataacaacggtggatgttctcatgtgtgtaacgagctgaaaataggatacgaatgcctttgtcctgacggttttcaactcgtcgcacagagacggtgtgaagatattgacgaatgccaagatccagatacttgtagccaactttgtgttaaccttgaagggggctacaagtgtcaatgtgaagaaggctttcaactcgatcctcacactaaggcatgtaaagcagtcggcagcatagcctatcttttctttactaataggcacgaggtccgaaagatgacccttgaccgctccgaatacacttcgctgataccaaacttgcggaacgtggtggcactggataccgaagtggcatcgaaccgaatatactggtcggatctctcccaacgtatgatttgctcaactcaactggatagagcacatggggtttcttcctacgataccgtgatcagcagggatattcaagctcctgacggactcgcggtcgattggattcattcaaacatctactggaccgactccgtccttggtactgtgtcggtggcggatacgaagggcgtgaagagaaagaccctgttccgggaaaatggtagcaagccaagagcaattgtggtggatccggtgcatggttttatgtactggactgactggggcactccagcaaaaatcaagaagggtggcctcaacggagtggacatctacagcctggtgactgagaatattcaatggccaaacgggatcactctggatcttctctcgggaagattgtattgggtggattcaaaactccacagcatctcgtctatcgacgtgaacggaggaaaccgtaagactatccttgaggatgaaaaacgtcttgcccatcctttttccctcgctgtgtttgaggacaaggtgttctggaccgatatcattaacgaggcaatcttttcggccaatcgacttaccggttcggatgtgaacctcctggcagaaaatctgctttcacccgaggacatggtcctgtttcacaacctcactcagcctcggggagtgaactggtgtgaacgcaccactcttagcaacggaggttgccagtacctctgcctgcccgccccccagattaatcctcacagcccaaagttcacctgcgcatgccccgacggaatgcttcttgcacgcgacatgcgctcctgtctgactgaagcagaggcagccgtggcaactcaggaaacttccactgtgcgtcttaaagtgagctcgaccgccgtgaggactcaacataccaccaccagaccagtccctgacacgtccaggcttcctggggccactcctggtcttacgaccgtggaaattgtaacgatgtcccaccaagccctgggagacgtggcggggcgaggcaacgaaaagaaaccctcctcggtgcgcgcactttcaatcgtcctgcctatagtgcttctggtgtttctgtgtctgggagtgtttctcctctggaagaactggagactcaagaatatcaatagcataaacttcgacaatcctgtctaccaaaagaccactgaggatgaagtccacatctgtcataatcaggacggctactcttatccttcgcggcaaatggtatccctcgaggacgatgtcgcc

SEQ ID NO: 246 - DNA, 2580 bp, Artificial Sequence
  Description of Artificial Sequence: Synthetic Transcript Sequence
atgggtccatggggctggaaactgagatggaccgtcgctcttctgttggcggcggcaggtaccgccgtcggtgaccgctgtgaacgcaacgagttccagtgtcaagatggtaaatgtatttcatacaaatgggtgtgtgatggttccgcagagtgtcaggacggatcagacgaaagccaggaaacttgcctgtcagtcacctgtaaatccggggacttctcctgcggtggacgcgttaaccgctgcattcctcagttctggcgctgtgatggacaagtcgattgcgacaacggctcggatgagcagggttgcccaccaaagacttgctcgcaagatgaattccgatgccatgacggaaagtgcattagccggcaattcgtctgtgattccgatcgcgattgccttgatggaagtgatgaggcatcctgtcccgtattgacctgcggtcctgccagcttccaatgcaacagctccacctgtattcctcaactttgggcttgcgacaatgacccagattgtgaagatggatcagatgagtggcctcaaagatgccgaggactttatgttttccagggggattcctccccttgttcagctttcgaatttcactgcctttcgggtgagtgtattcattcgtcctggagatgtgacgggggtccagactgtaaggacaagtcagatgaggaaaactgtgccgtggcgacctgtagacctgacgaattccaatgcagcgacggaaattgtattcatggatcgaggcagtgtgatcgcgaatacgattgtaaggatatgtcggacgaggtcggatgtgtcaacgtcactctttgcgaaggcccaaacaagtttaagtgtcacagcggagaatgcataacccttgacaaagtgtgtaacatggctagagactgcagggactggtcggacgagccaatcaaagagtgcggtaccaatgagtgcctcgacaacaacggaggttgtagccacgtctgtaatgaacttaagattggatacgaatgtctgtgtccagacggattccaactcgtggcacagagacgatgcgaagatattgatgagtgccaagatcccgacacttgttcccaactgtgtgtgaatctggaagggggctacaagtgtcaatgcgaagaaggatttcaacttgaccctcatacgaaggcatgtaaggcagtgggatccattgcatacctgtttttcaccaatcgccacgaggtgaggaagatgactcttgatcgtagcgaatacactagcctgattcccaatcttcgcaatgtggtggcactcgataccgaagtcgcatccaacaggatctattggtcggacctctcacaacgcatgatttgttcaacccagctggatagagcccatggtgtgtcctcgtacgataccgtgataagccgcgacatccaagcaccggatggcctggccgtggactggattcattccaatatctactggacggactcagtcctcgggactgtctcggttgcggacaccaagggtgtgaagcgcaagaccctgtttcgggaaaacgggagcaagcctagagcgatcgttgtggaccctgtgcatggtttcatgtactggaccgattggggaactccagctaaaatcaagaaaggaggccttaacggagtggacatctactcacttgtgacggaaaacattcaatggccaaatggaattactcttgatcttctttcaggtcgtctgtactgggtggattcaaaactccattccatttccagcatagatgtgaatggaggaaacagaaagactattctggaggatgagaaacggctcgcccatccttttagcctggcggtttttgaggataaagtgttttggacggacattatcaacgaggcaattttcagcgcaaataggcttaccggttccgatgtgaaccttctcgcagaaaacctgctttcacctgaggacatggtcctgttccataatcttacccaacctaggggcgtgaactggtgtgaacgtactactctgtcgaacgggggttgtcaatacctgtgtttgccagcgccgcagattaatccccattcgcctaagttcacgtgtgcatgtccagacggcatgctgctggccagggatatgagatcgtgcctcacggaagcagaagcagccgtcgcaacccaggaaactagcaccgtgcggctcaaggtgtcctcgaccgcagtgcgcacccagcatacgactactcgcccagtccccgatactagcagacttcccggggcaaccccgggactgactaccgtggaaattgtgactatgtcccatcaggcactgggagatgtggcaggaagaggcaatgagaagaagccttcgtcagtgcgagccctctcgattgtgctgcctattgtgcttctggtgttcctgtgccttggagtgtttcttctctggaaaaactggcggctgaagaacatcaatagcatcaactttgataaccctgtctaccagaaaaccaccgaagatgaagtccatatttgtcataatcaggacggatattcgtaccctagccggcaaatggtgagccttgaagatgatgtggcg

SEQ ID NO: 247 - DNA, 2580 bp, Artificial Sequence
  Description of Artificial Sequence: Synthetic Transcript Sequence
atgggtccttgggggtggaagctccgttggaccgtcgcactgctccttgcagctgcaggtaccgcagtcggtgacaggtgcgaacgcaacgagttccagtgtcaagatggaaagtgcattagttacaaatgggtgtgtgatggctcagcagaatgtcaggacggttccgatgaaagccaggaaacttgcctctcggtcacctgtaagtctggagatttttcgtgtggcggcagagttaaccgatgtatcccacaattctggcggtgcgatggccaagtcgattgtgacaatggttcggatgaacaaggatgtcctccaaagacctgttcgcaagatgaatttcgatgccacgatggtaagtgcatttccaggcaatttgtgtgcgattcggatcgagattgtttggacggatcggacgaggcatcgtgccctgtgcttacttgtggccccgcatcgtttcaatgtaactcctccacttgcattccccagctttgggcatgtgataacgatccagactgtgaagatggctcagatgagtggccacagcgctgcaggggactgtacgttttccagggcgattcctcgccgtgttcggcatttgaatttcattgcctgtccggtgaatgcatacatagctcgtggcggtgcgacggtggtcctgactgtaaggataagtcagatgaggagaattgcgcagtggccacttgtaggccggatgaattccaatgctcagatggtaactgtattcacggctcgcgccaatgtgaccgagaatacgattgtaaggatatgtcagatgaagtgggctgtgtcaatgtcactctgtgtgagggacctaacaaattcaaatgtcactccggagaatgtattactcttgataaggtgtgtaacatggcaagggactgccgcgattggtcggatgagcccataaaagaatgtggtactaacgaatgtctggataacaacggaggttgttcacatgtgtgtaatgagctgaagatcggatacgaatgcctttgcccagatggctttcagctggtcgcgcagcgcagatgcgaagatatcgacgagtgtcaagatccagacacgtgttcgcaactgtgtgtgaatctggagggaggatacaagtgtcaatgtgaagaaggtttccagttggatcctcatactaaggcatgtaaggcagttggctccattgcctacctcttctttacgaataggcatgaggtccgcaagatgaccctcgatagaagcgaatacactagccttattcctaacctgcgcaatgtggtcgcccttgatactgaagtggcatcaaatcggatttactggtccgatctgtcacaacgaatgatttgctcgacccagcttgacagagcccatggtgtctcctcgtacgataccgtcatttcacgggatatacaggcaccagacggcctggcggtggactggatccactcgaatatctactggactgactccgtcctgggaaccgtgtcagtggcagacactaagggcgtgaagagaaaaaccctgttccgcgaaaacggatcaaaaccccgggcaattgtggtggaccctgtccacggatttatgtactggactgattggggaacgcccgcaaaaatcaagaagggtggactcaatggagtggacatctattcactggtgactgaaaacattcagtggcccaatggtataactttggatctgctgtcggggcgcctctactgggtggacagcaaacttcattcgattagctcgattgatgtcaacggagggaatcgaaagaccatccttgaagatgaaaaacgacttgcccatccattttcgcttgcggtgtttgaagataaggtcttttggaccgatatcattaacgaagcaatcttctcagcaaatagacttaccggtagcgatgtcaacctccttgcagagaacctcctgagcccagaggatatggtgctgttccataacttgacccagcctagaggagtgaactggtgtgaacgcactactttgtcaaacggaggctgccagtacctttgtttgcctgcaccccaaatcaatccccattctcccaaattcacctgcgcatgtccagacggaatgctgttggcccgagacatgcgctcctgtctgaccgaagcagaagcggcggtggctactcaagaaacctccactgtccggttgaaggtgtcctcaaccgccgtgcgtacccagcacaccactactcgccctgtgcccgacacctcccggcttccaggcgcgacgcccggactcacgaccgtggagatcgtgaccatgtcccatcaagcactgggtgatgttgctggcagaggaaatgagaagaagccctcaagcgtcagagccctgtccatagtcctccccattgtgctgcttgtgttcctgtgtctcggggtgtttcttctttggaagaactggaggcttaagaacattaactccattaactttgacaaccccgtgtaccaaaaaaccaccgaagatgaggtgcacatttgtcacaatcaggatggatactcctacccctctaggcaaatggtgtcacttgaagatgatgtggcc

SEQ ID NO: 248 - DNA, 2580 bp, Artificial Sequence
  Description of Artificial Sequence: Synthetic Transcript Sequence
atggggccttggggctggaaactccgttggacagttgcactgctactagccgcagctgggaccgctgttggggacaggtgcgagagaaatgagtttcagtgccaggatggcaagtgcatcagttacaagtgggtgtgcgatgggagcgccgaatgccaggacggaagcgatgaatcccaagagacctgtctgtccgtaacctgtaagagtggagacttctcctgtggcggccgtgtgaaccggtgtataccacagttctggcggtgtgacggccaggtggactgcgataatggcagcgacgagcagggctgccctccaaagacctgctcccaggatgaattccggtgccacgacggtaagtgcatatcacggcagttcgtttgcgattccgaccgcgattgtcttgatgggtcagatgaagcctcttgtcctgtattgacctgtggcccagcttctttccagtgtaattccagtacatgtattcctcaactgtgggcatgcgacaatgatccagactgcgaggacggatccgatgagtggccacagaggtgtagaggcctgtacgtgtttcagggggattccagtccatgctccgcctttgagtttcactgcctgagcggcgaatgcatccacagctcttggcggtgcgacggcggcccagactgtaaggataagagtgacgaggaaaactgcgccgtggcaacatgtagacccgatgaattccagtgtagcgacggcaactgcatacatggctcaaggcaatgtgatcgggagtacgactgcaaagacatgagcgacgaggtcggctgcgtcaatgttacactatgcgagggaccaaacaagtttaagtgccacagtggagaatgtataaccctggacaaagtttgcaatatggctcgtgactgcagagattggagcgacgaacctattaaagaatgtggtactaacgagtgcctagacaacaacggcggctgcagccacgtttgcaatgagctaaaaataggttatgagtgcctatgtcccgacggcttccagctcgtggcacagcggcggtgtgaggatattgatgagtgccaggaccctgacacttgctcccagctatgtgtgaatctcgaaggtggttataagtgccagtgtgaagaggggttccagttagacccacatactaaggcctgcaaggctgtgggatctattgcctatctcttttttaccaaccggcatgaggtgaggaaaatgacactggaccggtctgaatacaccagtctgatacccaacctacggaatgtagttgcactcgacactgaagttgcctctaatcgaatctactggagtgatctgtcacaacggatgatatgcagcacacagctggatagggcccacggcgtatcttcttatgataccgttatctcacgcgacattcaggccccagatggacttgctgtcgactggattcactccaacatctactggaccgattctgtgctggggactgtttccgtggcagataccaagggcgtgaagagaaagactctattcagggagaacggatctaagccacgggctatcgttgttgaccccgtgcacggctttatgtattggacagattgggggaccccagctaaaataaagaaaggcggcctgaacggagtcgatatatattccttagttaccgagaacatccagtggccaaacggaattactctggatttactttctggcagactgtactgggttgatagtaagctacactctatcagctccatagacgtgaacggtggcaaccgcaaaaccattctagaagatgaaaaacgtctggcccaccccttcagcttagctgtgttcgaagacaaagtgttttggacagacatcatcaacgaagccatttttagcgccaaccggctaaccggtagtgacgtgaacttactggcagaaaatttactgagcccagaggatatggtgctcttccacaacctgactcagccacgcggggtgaactggtgtgaaaggaccactctgagcaacggaggctgccagtatctttgtctgccggctccccagataaacccacactctccaaaattcacctgcgcatgccccgacgggatgctactggctcgggacatgcggagttgcctgacagaagccgaagcagcagtggccactcaggaaaccagtactgtcagactgaaagtgagcagcactgcagtgaggacccagcacactaccacccgtcctgttcccgacacctcccgcctgcctggtgccacacccggccttaccacagttgagatcgtcaccatgtcccaccaggcattgggagatgttgcagggcgcggcaatgaaaagaaaccaagttccgtgcgcgctctgagcatcgtgttaccaattgttctgctggtgtttctgtgtctgggcgtgtttttactgtggaagaactggcgcctgaagaatataaatagtatcaatttcgacaatccagtttatcagaaaaccaccgaagacgaggtacacatttgccacaaccaagacggttatagctaccccagcagacagatggtgtccctagaagacgatgttgca

SEQ ID NO: 249 - DNA, 2580 bp, Artificial Sequence
  Description of Artificial Sequence: Synthetic Transcript Sequence
atgggcccctggggctggaagttgagatggacggtagcgctgctattggcagccgccggcactgcagtgggggataggtgcgaacgaaatgaatttcagtgtcaggatggaaaatgtatctcctacaaatgggtctgtgatgggtccgccgaatgccaggacggcagtgacgagtcacaggagacatgcttgtctgtcacctgcaagtctggcgacttctcttgcgggggacgggtcaaccggtgcattcctcaattctggaggtgcgatggccaggtcgactgcgacaatggaagtgatgagcagggatgtcctccaaagacctgtagtcaggatgaattcaggtgtcacgacggcaaatgcattagccgacagtttgtttgcgattccgacagagattgtctcgatggatctgacgaggcctcttgtccggtcctgacatgcggccctgcctccttccagtgtaatagcagtacatgcatccctcagttgtgggcttgtgataacgatccagactgcgaggatggctctgatgagtggcctcaacggtgcaggggtctctacgtgttccagggtgattcttccccctgcagcgctttcgaatttcattgtctaagcggtgagtgtatacattcgagctggaggtgtgacggtggaccagactgtaaggacaagagcgacgaggaaaactgtgcggtcgcgacgtgtcgcccagacgagtttcagtgttcagatggcaactgcatacacgggtcccggcagtgtgatcgggagtacgattgtaaggacatgtctgatgaggttggctgcgtgaatgttactttgtgcgagggacccaacaagtttaaatgccattccggggaatgcataacactggataaggtatgcaacatggctagggactgtagagattggagcgatgagcccatcaaagaatgtggaacgaacgagtgcctcgacaacaatggggggtgttctcacgtctgcaatgaactgaagatcgggtacgagtgtctctgtccagatggctttcagcttgtcgctcaaagaaggtgcgaggatattgacgaatgccaggaccccgacacctgctcccaactttgcgtgaaccttgagggtggatataaatgtcaatgcgaggagggattccagttggacccgcacaccaaggcttgcaaagccgtgggctctatagcttatctgttcttcacaaatcgacatgaggttcggaagatgaccctcgataggagtgagtatacaagcctgatacctaacctgaggaatgtggtcgcactggacacagaggtggctagtaataggatatattggagcgacttatcacaaagaatgatctgcagcactcagctggacagggcccacggtgtctcgtcatatgacacagttataagtagggatattcaagctcctgatggcctagccgtggattggattcatagcaacatttattggacggacagcgttctgggcacagtgtcagtcgcagacactaaaggagtcaaacgaaaaaccctctttcgagaaaatggctcgaaaccccgcgcaatagtcgtcgatcccgtgcacggttttatgtattggactgattggggaacaccagccaaaatcaagaagggaggactaaatggggttgacatctattcacttgttaccgagaatattcagtggcccaacggcattaccctcgatctgctgagtgggcggctctactgggtggattcaaagctccattccatttcctccattgatgtaaacggaggaaaccgtaaaaccatcctggaggatgagaagcggctcgcccaccctttttcactcgcagtcttcgaggataaagtgttttggaccgacatcatcaacgaagccatcttcagcgctaaccgactcaccggatcagacgtcaatctgttggcagaaaacctgttgtctcctgaggacatggtgctgtttcataatctcacccagcccagaggggtcaactggtgtgagcgaaccaccctcagtaatggagggtgtcagtatctctgcctccccgctccccagatcaacccacactcaccaaaattcacctgcgcgtgtcccgatggcatgctgttggctcgcgatatgcgctcatgtctcactgaggcggaggccgcagtcgcaactcaagaaacaagtacagtgcggttaaaggtgagcagtaccgctgtccgaacccagcatacaacaacgcggcctgtaccagataccagtagacttccaggcgccactcctgggttaacgaccgtggagatcgtgacaatgagccaccaggctctgggcgacgttgcagggagaggaaacgagaagaaaccgtcgtccgttcgggcccttagcatcgtgctaccgattgtcttgctggtgtttctgtgccttggggtgtttctgttgtggaaaaactggcgtttgaaaaacatcaactcgattaacttcgataaccctgtgtaccagaaaaccacagaggatgaagtgcacatatgccacaaccaggatggatattcttacccatctcgccagatggtgagcctggaggacgacgtcgcc

SEQ ID NO: 250 - DNA, 2580 bp, Artificial Sequence
  Description of Artificial Sequence: Synthetic Transcript Sequence
atgggcccttgggggtggaagctgcggtggacggttgccctgcttctcgctgccgccgggacggccgtgggcgaccgatgcgaacgcaacgagtttcaatgccaggatggcaaatgcatttcctacaagtgggtgtgtgatggcagcgctgaatgtcaggatggctctgatgagtcccaggaaacctgtctgtcagtgacttgtaagagcggagactttagttgtggaggtagagtgaatcgctgtatcccccagttctggcgatgcgacggtcaagttgactgcgataatggctctgatgagcagggttgtcctccgaagacttgctctcaggatgaatttcggtgtcatgacggcaaatgtattagccggcagttcgtctgcgattcagacagggactgcctcgatggtagcgacgaggcaagctgccccgtgctgacctgcggccctgccagcttccagtgcaacagctctacgtgtatacctcaactgtgggcgtgcgataatgatccagattgcgaagacggctctgatgaatggccccagagatgtcgcggactgtatgtgttccaaggcgacagcagtccatgcagcgcttttgaatttcactgcttgagcggagaatgcatacatagctcttggcgatgtgatggtgggcccgactgtaaggataagtccgatgaggaaaactgcgccgtggccacctgcagaccggacgagttccagtgttcagatggcaattgtatccacggcagcaggcagtgtgaccgagagtatgattgcaaggatatgagtgatgaggtcggctgcgtcaacgtgaccttgtgcgagggacccaacaagtttaaatgtcactctggcgagtgcatcactctcgataaagtgtgtaatatggccagagattgccgcgattggtccgacgagcctatcaaggaatgtggcactaatgagtgcctggacaataatggaggatgctctcacgtctgtaatgagctcaagattggatacgaatgtttgtgcccagacgggtttcagctggtcgcacagaggcgctgtgaggacattgatgagtgtcaggatcctgacacatgttcacagctgtgtgtaaatctcgagggtggctacaagtgccagtgcgaggagggtttccagctggacccacatacaaaagcttgtaaagccgttggctcaatagcctacttgtttttcacaaatagacatgaggtgcgcaaaatgaccctggacaggtccgaatatacatctctcatccccaacctgagaaacgtggtcgcccttgacaccgaggtcgcctcaaacaggatttattggagtgatttgagccagcggatgatttgtagcacgcagcttgaccgagcacacggtgtttcatcttatgacaccgtaatctctagggacattcaggcccccgacggcctggcggtggactggatccatagtaatatctattggacagatagtgttctgggcactgtttccgtcgcggacacaaaaggggtgaaacggaaaaccttgttccgggaaaacggatcaaaacccagggctatcgtggtcgatccggttcatggtttcatgtactggaccgactgggggacgcctgccaagatcaaaaaaggcgggctcaacggcgtggatatctacagtctggtgaccgaaaacattcagtggcccaacggcatcacccttgacctgctgtctggcagactctattgggtggattccaaactccatagtatcagttccatagatgttaacgggggaaacagaaaaaccatcctggaggacgagaagagactggcccacccattttccctcgcagtcttcgaagacaaagtgttctggactgacatcatcaatgaagccatcttttcagctaatagactgacggggtctgacgtcaatctgctcgcagaaaacttgctgtcccccgaggatatggtgctgtttcacaacctcactcagccgaggggcgtgaattggtgtgagcggaccactctgtccaatggggggtgccagtacctgtgcttgcctgccccccagatcaaccctcatagccctaagtttacttgtgcgtgccctgatgggatgctgcttgcgcgggacatgagatcctgccttactgaggcagaggcggctgttgcgactcaagagaccagcacagttcgccttaaggtaagcagtactgccgtgaggacacagcataccactaccagacccgtcccggacaccagccggctgcctggagctacacctggcctgacaacagttgagattgttactatgagccaccaagcattgggggatgtagccggacggggcaacgagaagaagccttcatccgttcgcgcgcttagcatagtccttccaattgtgctgcttgtgttcctttgccttggtgtcttcctcttgtggaaaaactggaggctgaaaaatataaatagcataaatttcgacaatcctgtgtatcagaagacgacggaggacgaggtgcatatatgccacaaccaggatggatatagctatccctctaggcaaatggtttctttggaggacgatgtggcg

SEQ ID NO: 251 - DNA, 2580 bp, Artificial Sequence
  Description of Artificial Sequence: Synthetic Transcript Sequence
atgggaccgtggggatggaagctgcggtggaccgtggcactgctcttggccgccgccggaacggcagtcggcgacaggtgcgagagaaatgaattccagtgtcaggacggtaaatgtatcagttacaaatgggtgtgcgacggtagcgccgaatgccaagacggatcggacgaatcccaagaaacttgtctgtcagtgacctgcaagagcggagacttttcctgcggagggagagtgaatcgctgcatcccgcagttctggcggtgtgacggccaggtagactgcgataacgggagcgatgaacaggggtgcccgcctaaaacctgcagccaggatgaatttcggtgccacgatggcaagtgcatctcacgacaattcgtttgcgactcggacagggattgtctcgatggatcggatgaggcaagctgtccggtgcttacgtgcggcccggcttcgttccagtgcaattcgagcacctgtatccctcaattgtgggcgtgtgataacgacccagactgcgaggacggaagcgatgagtggccgcaaaggtgccgcggactgtacgtgttccagggagacagctcgccgtgttccgcgttcgaatttcactgcctgtcgggagaatgcatccatagctcctggagatgcgacggcggaccagattgcaaagacaagtccgacgaggagaactgtgctgttgcgacttgtcgcccggatgagtttcagtgctcggatggcaattgcatccacggttcccgccaatgtgaccgggagtacgactgtaaagatatgtcggacgaggtcggatgcgtgaacgtgactctgtgcgagggaccaaacaagttcaagtgccactcaggcgaatgcattaccctcgacaaagtgtgcaacatggccagagattgtcgggactggtcggatgaaccgatcaaagaatgcggaactaatgagtgtcttgacaacaatggcggatgttcgcatgtctgcaatgaactgaagatcggatacgaatgcctctgcccagacggtttccaattggtcgcccagcggcgttgcgaggacattgacgagtgccaagaccccgacacgtgttcccagctgtgtgtgaatcttgaaggtggatacaagtgccagtgcgaagagggattccagttggatccgcatactaaggcttgcaaagcagtgggttccatcgcgtacctgtttttcactaaccgccacgaagtccgcaagatgaccttggaccgctccgagtacacttcgctcatacctaaccttaggaacgtggtcgccttggatacggaagtggcctccaaccggatctactggtccgatctgtctcaacgaatgatctgctcaacccagctcgacagagctcatggggtgtcgtcctacgataccgtgatctcgagagatatccaggcccccgacgggctggcagtggactggatccattcaaacatctactggaccgactcagtcctgggaaccgtctcagtggccgacacgaagggtgtcaagcgcaagacccttttccgggaaaatggctcaaagcctcgggctatcgtggtggaccccgtccacggattcatgtattggactgattggggcactcccgcgaagatcaagaagggaggcctcaacggggtggatatctactcccttgtgaccgaaaatattcagtggccaaatgggattaccctggacctgctgtctggccgcctgtactgggtcgatagcaagctgcatagcatttcctcaatcgacgtgaatggaggaaaccggaaaaccatcctggaggatgaaaagcggctggcacaccctttcagcctcgcagtgttcgaagataaggtcttttggaccgacatcatcaacgaggccatcttctcagctaacaggttgaccggaagcgacgtgaacctcctcgcggagaacctgctttcacctgaagatatggtgctcttccataacctgactcaaccacgcggggttaattggtgcgaaagaactactctgtccaatggaggatgccaatacctgtgcctgccggcgccacagatcaacccgcactcccccaagttcacctgcgcatgcccggacggaatgctgctggcgcgcgacatgcgctcctgcctgactgaagccgaagcggccgtggccacccaggagacttcgaccgtgagactgaaggtgtctagcactgccgtccgcacccagcatactaccactcggccggtcccggacacgtcccggctcccaggcgcgacccccggcctgactaccgtggagatcgtgactatgtcgcaccaggctctcggagacgtcgccggtagagggaacgaaaagaaaccatcaagcgtgcgcgccctgtccatcgtcctgcctattgtcctcctcgtgtttctgtgcctgggcgtgttcctcctctggaagaactggcgcctgaagaacatcaactcgattaatttcgataacccggtgtaccaaaaaaccactgaagatgaggttcacatctgccacaaccaagatggatattcgtacccatcgaggcagatggtgagcctcgaggatgacgtggct

SEQ ID NO: 252 - DNA, 2580 bp, Artificial Sequence
  Description of Artificial Sequence: Synthetic Transcript Sequence
atgggaccatgggggtggaagctcagatggactgtggcgctcctgcttgcggccgctggcactgccgtaggagatagatgtgagaggaacgaattccaatgtcaggatggtaaatgcatcagctacaaatgggtgtgcgacggaagcgctgagtgtcaagatggtagcgacgaatcgcaagaaacgtgcctgtccgttacttgtaagtcaggagacttcagctgcggcgggcgagtcaacagatgcataccgcaattctggaggtgcgatggacaggtggactgcgacaatgggtccgacgagcaaggatgcccgcctaagacgtgctcacaggacgagtttcgctgccacgatggaaagtgcatttcccgccagttcgtgtgtgacagcgaccgcgattgcctcgacggctccgacgaagcatcgtgtcctgtgttgacctgcggaccggcatcatttcagtgcaactcctctacctgcatcccccagctgtgggcgtgtgataacgaccctgactgcgaggacgggtcggatgaatggcctcaacggtgcagaggactgtacgtgtttcaaggcgactcatccccatgcagcgcgttcgagttccattgcctctccggtgagtgcatccactcgtcatggcgctgcgatggagggcccgactgcaaagataagtcagacgaagaaaactgcgcagtggccacctgtcgcccagacgaattccagtgctctgacggaaactgcattcacggatctcggcaatgcgatcgagaatacgactgtaaggacatgtccgatgaagtgggctgtgtcaatgtgacgctgtgtgagggaccgaacaagttcaagtgccactcaggcgaatgcatcactttggacaaggtttgcaatatggctcgggattgccgcgactggtcggacgaacccatcaaagaatgcggaaccaatgaatgtctggacaacaatggaggctgcagccacgtgtgtaacgagctgaagatcggctacgaatgcctgtgcccagatggttttcagctcgtcgcgcagagaagatgtgaggacatcgatgaatgccaggaccctgacacttgttcgcagctttgcgtcaacctggaaggtgggtacaaatgtcagtgcgaagaaggatttcagttggatccacacactaaggcgtgtaaggcggtgggctccatcgcttatctgttcttcacgaataggcacgaggtgcggaaaatgactctggaccggtcagagtacacctccttgatccctaatctgcggaacgtcgtggctctggacaccgaagttgcctcgaatagaatctactggtcagacctgtcccagcggatgatctgctcaacccagctggatagggcccacggggtgagctcatatgacacggtaatctcgcgggacatccaggcccccgatggacttgctgtggactggatccatagcaatatctactggaccgattcagtgctgggcaccgtctctgtagccgatactaagggagtgaaaagaaaaactctgttccgggaaaatgggagcaaaccacgtgccattgtcgtggatccggtgcatggtttcatgtactggactgactggggaacgccggccaagataaagaagggcggactgaacggagtggacatctactcgctggtgaccgagaacatccagtggccgaacggaattaccctggacctcctttcgggtagactctactgggtcgactccaagctccattcaatcagctccatcgatgtgaatggcggtaaccgcaagactatcctggaggacgagaaacgcctcgcccatccgttcagcctggccgtgttcgaggataaggttttctggactgatatcatcaacgaggcaatcttcagcgcgaaccggctcacggggtccgatgtgaacctgctggctgagaacctgttgagcccagaggacatggtactgttccataacttgactcagccccgcggagtcaattggtgcgaaaggaccaccctctccaacggtgggtgtcaatacttgtgccttcctgccccgcagattaacccgcacagccccaagttcacctgtgcgtgccccgatggaatgctgctcgcacgtgacatgcggtcgtgcctcaccgaagccgaagctgcggtggcgactcaagaaacttcaaccgtccgcctgaaagtgtcgtcgaccgcggtgcgcactcagcacacgaccacccggccggtgccagataccagccgcctcccaggagccactccggggctgaccaccgtggaaattgtcactatgtcgcatcaagctctgggtgacgtggcaggccgcggaaacgagaagaagccgagcagcgttcgggcgttgagcatcgtcctcccaatagtgctgcttgtctttctctgcctgggtgtctttttgctctggaagaattggcgcctgaagaacatcaactcgatcaatttcgataacccggtttaccaaaaaaccactgaagatgaggtgcacatctgtcacaatcaggatggatattcgtacccttccagacagatggtgtcgctcgaggacgacgtggcc

SEQ ID NO: 253 - DNA, 2580 bp, Artificial Sequence
  Description of Artificial Sequence: Synthetic Transcript Sequence
atgggtccttggggttggaagctgcggtggaccgtggcactccttcttgcggctgcaggcaccgccgtgggagacagatgtgagagaaatgagtttcaatgccaggatggtaagtgcatttcgtacaaatgggtctgcgacggctctgcagaatgccaagatgggtcggacgaatcgcaagagacttgtctcagcgtgacttgcaaatccggagatttttcgtgtggtggaagagtcaacaggtgtattcctcagttctggcgctgtgatggtcaggtcgattgtgacaacggctcggatgaacagggatgccctcccaagacctgttcgcaagacgagtttcgatgtcatgatggcaagtgtatctcgcgccagtttgtctgcgactccgatagagattgtcttgatggctctgatgaggcctcctgtcctgtgcttacttgtggtcccgcatcctttcaatgcaactcctctacctgcatcccacagttgtgggcgtgcgataatgatccagattgtgaggacggatcagacgagtggccgcagcggtgtaggggactgtacgtgtttcaaggagactcgtccccatgttcggcatttgagtttcactgcctctccggggaatgtattcattcttcctggcgttgcgacggaggccctgattgtaaagataagtccgacgaggaaaactgcgcagtggccacgtgtagaccagatgagtttcagtgttcggatggcaactgcattcatggcagccggcaatgtgatagggaatacgactgtaaggatatgtcagatgaggtcggctgcgtgaacgtgacgctgtgcgaaggcccaaacaaattcaaatgtcacagcggtgaatgtattaccctggacaaggtctgtaacatggcccgtgactgtcgcgattggtcggacgagcccattaaggaatgcggtaccaatgaatgcctcgataacaatggcggatgctcgcacgtgtgtaacgaactgaaaatcgggtacgagtgtctttgtccggacggttttcagttggttgcacagcgcaggtgtgaagatatagatgagtgtcaagatcccgatacttgctcacaactgtgtgtcaacctggagggtggctacaaatgtcagtgtgaggaagggtttcaactggaccctcataccaaggcatgtaaggcagtggggtccatcgcttacctcttctttaccaaccgccatgaagtccgcaagatgaccctcgaccgatctgaatacacgagcctgatccctaacctgaggaatgtcgtggcacttgatactgaggttgcaagcaaccgtatctactggagcgatctcagccaaaggatgatttgcagcactcagcttgatagagcacacggagtgtcctcatatgataccgtcatctcgcgggacattcaggctcccgacggtctggcggtggactggatccattccaacatttactggacggacagcgttctggggaccgtgagcgtggcagatactaaaggggtgaagcgaaagactcttttcagggaaaacggatcgaagcccagggccatcgtggtcgatcctgtgcacggttttatgtactggaccgattggggcaccccagccaagatcaagaaaggtggacttaacggagtcgacatatactcgctcgtgactgagaacattcagtggcctaacggcattactctcgacctgctttcaggccggctctactgggtcgactcaaagctccattcaatctcgtcaatagacgtaaatggcggaaaccgcaagacgattctggaagatgaaaagagattggcgcatcccttttcgcttgccgtgttcgaggataaggtgttttggaccgatatcatcaacgaagcaatcttttcagcaaatcggcttaccggatccgatgtgaacctgcttgcggaaaacctgctctcacctgaggacatggtgctgtttcataacctgacccaaccgaggggggtaaattggtgtgaaagaactaccttgtcgaatggtgggtgtcaatacctgtgccttcctgcgccgcagattaaccctcactcaccaaaattcacgtgcgcgtgtccagacggtatgctgctcgcacgagacatgagatcctgcctgactgaggcagaagccgccgtggccacgcaggaaactagcactgtgagacttaaggtcagctcgaccgccgtcaggacgcagcataccaccactcggcctgtgccagatacgagccgacttccaggagcaactcctggactgactaccgtggagatcgtgacgatgtcgcaccaagctctcggtgatgtggcaggacgagggaatgagaagaagccttcgtccgtccgggcactctcaatcgtgcttccaattgtgctgcttgtgtttctgtgtttgggcgtctttttgctctggaagaattggcgactcaagaacattaactcaattaacttcgacaaccccgtgtaccaaaagactaccgaagatgaggttcatatttgtcataaccaggacggttacagctaccctagccggcaaatggtgtcgctggaggacgacgttgca

SEQ ID NO: 254 - DNA, 2580 bp, Artificial Sequence
  Description of Artificial Sequence: Synthetic Transcript Sequence
atgggcccatggggatggaaactgaggtggactgttgccttgctgcttgccgctgcggggacagcagtcggtgatcggtgtgaacggaacgaatttcagtgccaggacgggaaatgcatttcctacaaatgggtgtgtgacggttctgctgagtgtcaggacgggagtgatgagagccaggagacctgtctgtccgtcacgtgtaaatcaggagatttcagctgcgggggacgcgtgaatcgatgtattcctcagttctggcgctgtgatggtcaggtcgactgcgataacggcagcgatgagcagggatgcccccctaaaacttgctcccaggatgagttcaggtgccacgatggcaagtgcattagcagacagttcgtctgcgactccgatagagattgcctcgatggctccgacgaggcttcctgtccagtactgacatgcggccctgcaagttttcaatgtaatagttctacctgtattccacagctgtgggcatgcgacaatgacccagattgcgaggatggtagtgatgaatggccacaaaggtgcaggggattgtatgtgttccagggagattcctcgccttgctccgccttcgaattccattgcctaagcggtgagtgcatccatagcagctggaggtgtgacggcgggcctgactgtaaggataagagcgatgaagaaaattgcgcagtggccacttgcaggcctgatgaattccagtgttctgatggcaactgcatacatgggtcccggcagtgtgaccgggagtatgactgcaaggatatgagtgatgaggtaggttgcgtgaatgtaaccttgtgcgaaggaccgaataaatttaaatgccactccggagaatgcatcacattagacaaggtctgtaatatggctcgggattgtcgggactggagcgacgaaccgattaaggaatgcggcactaacgaatgtttagacaacaatggtggctgctcccatgtgtgtaatgaactaaagatcgggtacgagtgcctgtgtcccgacggttttcaactggtcgcacagcggaggtgtgaagatattgacgaatgccaggaccctgacacttgttcgcaactgtgtgtgaatttggagggagggtacaagtgtcagtgcgaagaggggtttcagctcgacccacacacaaaggcctgcaaggcagtcggctctattgcttatctgttctttactaaccgccacgaggtgcgaaaaatgacacttgatcgtagcgagtatacctccctgattcctaacctccgcaacgtggtggccctggatacagaagttgcttcaaatcgtatttactggagtgacctttcccaaagaatgatatgtagcactcagctggatcgggcccatggggtctccagttacgacactgttatctcaagggacattcaagcgccagacggccttgccgtggattggatccatagcaacatttactggaccgatagtgtgctcggaaccgtgagtgtggccgacaccaagggggtcaagcggaagacactgtttcgggagaatgggtcgaagcccagagctatagtggtcgacccagtccacggcttcatgtattggaccgattggggcacgcccgccaagatcaagaagggaggtcttaacggggtagatatatactcccttgtgaccgagaacattcagtggcccaacggaattactctcgacctactgtcgggacggttatactgggtcgacagtaaactgcatagtatcagctccatcgatgttaatggaggaaacagaaagaccatcttagaggatgaaaaaaggctggctcacccatttagtctcgcagtgtttgaggacaaggtgttttggacggacatcattaacgaggccatcttctcggccaacaggttaaccggaagcgatgtaaacttgttagccgagaatctgctgagcccagaggacatggtgctgtttcacaacctcacacagccccggggagtgaattggtgcgagaggactaccctgagtaatggcgggtgccagtatctttgtctgccagcacctcaaatcaacccccacagcccaaagttcacctgcgcctgtccagacggaatgttgttagctcgtgatatgcgcagctgtctgaccgaagctgaagccgccgttgccacccaggaaacctccacagtgagattgaaggtgtcaagtacagccgtgcgaacccagcatactacaacccgccccgtacctgatacaagtcggctgccgggcgcaaccccgggcttaacaactgtggagatcgttacaatgtctcaccaggccctaggtgacgtagctgggagaggcaacgaaaagaagccttccagcgtaagagctctttccatcgtgctgcccatagtgttgcttgtctttctgtgtctcggggtgttccttctgtggaagaactggagactgaagaatattaattctataaacttcgataacccagtatatcagaagacaaccgaggatgaggtgcacatatgtcacaatcaggatggatacagttacccatcccgccagatggttagccttgaagatgacgtggcc

SEQ ID NO: 255 - DNA, 2580 bp, Artificial Sequence
  Description of Artificial Sequence: Synthetic Transcript Sequence
atggggccttggggatggaaattgagatggacagtagccctcttactcgctgcagcagggactgctgttggtgacagatgcgaacgcaatgaatttcaatgtcaggatggtaaatgtatttcctacaagtgggtttgtgacggaagtgctgaatgccaggacggatccgacgagagtcaagagacttgtttaagcgttacttgtaagtccggtgattttagttgcggtggacgcgtgaataggtgtattccacagttttggaggtgtgatggtcaagtggattgcgataacggatcagacgaacaggggtgccctcctaagacttgctctcaagatgagttcaggtgtcacgacggaaagtgcatttctaggcaatttgtttgcgatagcgatagggattgcttggatgggtcagatgaagccagctgcccggtccttacttgcggccctgccagcttccaatgtaactcgtcgacttgcatcccccaactctgggcttgtgataacgatccagattgtgaagatggtagtgacgagtggcctcagcgttgcagaggactttatgtattccaaggcgattcttcgccatgttcagctttcgaatttcattgccttagtggagaatgcattcattcctcatggagatgcgatgggggtcccgattgtaaagacaagtcggatgaagagaattgtgctgtggcaacctgtagaccagatgaatttcagtgctccgacggtaattgcatccatggttccagacagtgtgatcgtgagtatgactgtaaagacatgtctgatgaagtcggttgtgtcaacgttaccctttgtgaaggcccaaataagtttaagtgtcactccggagagtgcattacattggacaaagtttgcaatatggctagggattgtagggattggtccgacgaacctatcaaggagtgcggaacaaacgagtgcttagataacaacgggggttgtagccatgtatgtaacgaactgaaaataggatatgagtgcttgtgtccagatggctttcagcttgttgcacaacggcggtgtgaggatatcgatgaatgccaagacccggatacttgctctcaattatgcgttaatctggaaggggggtacaagtgtcagtgcgaggagggcttccagctagatccacatacaaaagcatgcaaagctgtaggaagtattgcttatcttttttttacgaaccggcacgaggtacgcaagatgactcttgacagatccgagtacacatccctaatcccaaatttaagaaatgtcgttgctctagacactgaggtggccagcaatagaatctattggtccgatctttctcaaaggatgatttgctcgacacaacttgacagagctcacggtgtgagttcgtatgacacggttatcagtagggatatacaagctccagatggcctggccgttgattggatccattctaatatttactggactgatagtgtgttgggaactgttagtgtggcggataccaagggagtaaagcggaaaactctttttcgcgagaatggttccaagcctagagcgattgttgtcgatcctgtgcatggctttatgtactggaccgattgggggactccggcaaaaattaagaagggcggattgaatggcgtcgacatctacagtctggttacggagaacatccagtggcctaacggcattactctagatctcctatcaggtcgtttatactgggttgattctaagcttcacagtatctcctccatcgacgtaaacgggggaaacagaaaaaccatattggaggatgaaaaaagactcgcacatcctttcagtctcgcagtttttgaggataaagtgttttggacagacatcataaatgaagctattttctccgccaataggctcacaggtagtgatgtgaatcttttggcagaaaatttactatcacctgaagatatggttttgtttcataaccttactcaaccaaggggggtcaattggtgtgaaaggaccactctctcgaacggtggatgccagtacttgtgtcttcctgctccacagattaacccccactcgccaaaattcacatgtgcttgtccagacggaatgcttctagcacgcgatatgcgtagttgcttgacagaagctgaagcggctgttgccacccaagaaacatctactgttcgattgaaggttagttccaccgctgtccggacgcaacacacgacgaccaggcccgttcctgatacaagtaggttgcctggtgccacccccggacttactacggtggaaatcgtgactatgtcgcatcaagcactaggagacgtagcaggtagaggaaacgaaaagaaaccatcttcagtgagggcgttatcgatcgtgttgcctatcgttctgttggtgtttttgtgtctgggcgtttttttactctggaaaaattggagacttaagaacatcaatagtattaatttcgataacccagtgtatcaaaagacaactgaggatgaggtccatatttgccataaccaggatgggtatagctatccatcccgccaaatggtgtcattggaagatgatgtagct

SEQ ID NO: 256 - DNA, 2580 bp, Artificial Sequence
  Description of Artificial Sequence: Synthetic Transcript Sequence
atgggtccttggggctggaaactcaggtggactgtcgccctgcttctcgccgccgcagggaccgccgtgggcgataggtgtgagcggaacgaatttcagtgtcaggatgggaaatgtataagctataagtgggtgtgcgatggaagtgccgagtgccaggacggtagcgatgaatcgcaggaaacatgcctgagtgtgacctgtaagtccggagacttctcatgcggaggacgcgttaaccggtgcataccccagttctggagatgcgacggtcaagtcgactgcgacaatggatcagatgagcaaggctgtcctcctaaaacctgctctcaggacgagttcaggtgccatgatgggaagtgtatttctcggcagttcgtatgtgattcagaccgggattgcctagatggttcagacgaagcctcctgtccagttctgacctgtgggccagctagctttcagtgtaacagctcaacatgcatccctcaattgtgggcatgcgacaatgatcccgactgcgaggatgggagcgacgagtggccacagcggtgtcgggggctgtacgtgtttcagggggattcttccccatgttcagcgtttgagtttcactgtttatctggagagtgcatccacagtagctggcggtgtgacgggggaccggactgcaaggacaagagcgacgaggagaattgtgcagtggccacgtgccgtcccgatgagtttcagtgttccgacggcaactgtatacatggtagtaggcaatgcgaccgggagtacgattgtaaagatatgtcagacgaagtcggctgtgttaatgtcactctgtgcgagggccccaataagttcaagtgtcactcaggtgaatgtattacccttgacaaggtgtgcaacatggcccgtgattgtcgagattggtcagacgagcccatcaaggagtgcggaactaatgagtgcctggacaataatggcggatgctcgcatgtatgcaacgagctcaaaataggttatgaatgtctgtgtcccgatggatttcagctagtggcacagaggcggtgtgaagatattgatgaatgccaggaccctgacacctgtagccagctgtgcgtaaacctggaaggcggctacaagtgccagtgtgaagaggggttccagttagacccgcacactaaggcatgtaaagccgtaggttcaatcgcgtacctttttttcacaaacagacacgaagtcagaaaaatgaccttagaccgctctgagtacacctctctcataccaaacctaaggaatgtagtcgctcttgacaccgaggttgctagcaatagaatctactggtccgatctatctcagagaatgatttgctccacgcagctggatcgcgcacacggggtgtccagttatgatacagttatatcgcgcgacatacaggcacctgacggtctcgccgttgattggatccactctaacatttactggactgactccgtgctgggtaccgtgagcgtggccgacacaaaaggtgtgaagagaaagaccctgttcagagaaaatggttctaaacccagggcaatcgtcgtggatccagtgcatggtttcatgtattggactgactggggtaccccggctaagatcaagaaaggcgggttgaacggtgtagatatatattctttagtcacagagaacattcaatggcccaatggcattactctggacctgctgagcgggcgactgtactgggtcgactccaaattgcactctatctcaagcatagacgtgaatggcggtaataggaaaacgattctcgaggacgaaaagcgcctcgcccatccgttcagcctggccgtcttcgaggacaaggtattctggactgatatcataaatgaggcaatattctcagcaaaccgacttaccggttctgacgtcaacctgctcgccgagaatttactctcccctgaagatatggtgctcttccataacttgacccagccacggggcgtgaattggtgcgagcgcacaactctgtccaatggaggttgtcagtacctctgtctaccggcgccccagatcaatccccactctcctaagttcacttgtgcttgcccggacggtatgttactggcgcgggacatgaggtcatgtttgaccgaggcagaggccgctgtggccacccaagaaacaagcaccgtgcgactgaaagtttctagtactgcagtgagaacccagcatacaacaaccagaccagtgcccgatacaagcagattacctggggcgactcccggtcttaccacagtggaaatcgtcaccatgagtcaccaggccctgggtgacgtggccgggcgcgggaatgaaaagaaaccgtcatccgtgagggcactttctattgtgttacctatagtccttctcgtgtttctgtgtctgggcgtgttcctgctatggaaaaactggcggcttaaaaacataaattcgatcaatttcgacaatccagtgtatcagaagaccacagaggacgaggtgcacatttgtcacaaccaagatggttatagctacccatctcggcagatggtgagtctcgaagatgatgtagct

SEQ ID NO: 257 - DNA, 2580 bp, Artificial Sequence
  Description of Artificial Sequence: Synthetic Transcript Sequence
atggggccatggggatggaaattgcggtggaccgtggctcttctcttggccgccgctgggacggccgtgggggaccggtgtgagagaaatgaattccagtgtcaggacggtaaatgcatcagctacaagtgggtgtgtgatggcagtgccgagtgccaggatggctctgatgagtcccaagagacatgcctgtccgttacctgtaagtctggggactttagttgtggcggacgggtgaaccgttgcatccctcagttctggcgctgtgatggtcaggtggattgcgataacggctctgatgagcagggttgtcctccgaaaacctgtagtcaggacgagtttcgatgtcatgatggaaagtgtatctcccgccagttcgtgtgtgatagcgatcgggactgtctggacgggtctgacgaggcaagctgtccggttctcacatgtggccctgcgtcctttcaatgtaattcaagcacctgtatcccgcagctctgggcatgcgataatgatcccgactgtgaggatggatccgatgagtggccgcagcgatgccggggcctttacgtctttcagggagactcaagcccatgttctgcctttgagttccactgtctgtccggcgagtgcatccactcatcctggcggtgtgacggcggccctgattgtaaagacaaatcagacgaggagaactgcgctgtcgccacctgccggcctgacgagttccagtgttcagatggcaactgcatccatgggtcccgtcaatgtgaccgcgagtacgactgtaaggatatgtccgatgaagtcgggtgcgtaaacgtcactctctgcgagggtcccaacaagtttaaatgccacagcggggagtgtatcaccttggataaggtctgtaacatggctcgagattgcagagactggtctgatgagccgattaaggaatgcggtaccaatgagtgcctggataataatggtgggtgttcacacgtgtgtaatgaactgaagatcggatacgagtgtttatgtcctgacggatttcagctcgtggctcagcgccggtgcgaagacattgatgagtgccaagacccggacacatgtagccagctctgtgtgaatttggagggaggttacaagtgtcaatgcgaagaaggtttccaactcgacccacatactaaggcctgcaaggccgtggggtctatcgcctacctcttctttaccaaccgccacgaagtcaggaagatgacccttgaccggagcgaatatacctccctcattcccaatttgagaaacgtagttgccctggacaccgaagttgcgtcaaataggatctactggagtgatctaagccaaagaatgatctgcagcacgcaactggacagagcgcacggggtatccagttatgataccgtcatctcccgcgacatccaggctcccgacggtctcgccgtggactggatccatagcaacatctattggaccgattcagttcttggaacagtgtctgtggcagataccaaaggcgtgaagaggaagaccctgttcagggagaatggttccaaacctcgagccatcgtagtggacccagtgcacggatttatgtattggaccgattggggcacacctgccaaaataaagaagggaggcctgaacggagtggacatttactcactggttacagaaaacatccagtggcccaacggcattacccttgacctattatccggtcgcctctattgggtggatagcaagctccactctatcagttcaatcgacgttaacggagggaaccgaaaaacgatcttggaggacgagaaaagactcgctcaccccttctccctcgccgtatttgaagacaaggttttttggaccgacatcattaatgaggcaatttttagcgccaacagacttactgggtccgacgtcaacctgctggcagagaatttgctaagtccagaagatatggtcctattccacaatttaacgcaacctagaggggtgaactggtgcgaacgcactaccctgtccaacggaggctgccagtatctgtgcctgccggctccacagataaatccacacagccctaaattcacatgtgcttgtcccgatggaatgctgctggcacgcgatatgagatcttgtctgacagaggccgaagcagcggtggctacacaggagacatccactgttcggctgaaggtgtcctctaccgccgtgcgaacacagcacaccactacccgtcctgtgcccgacacatcccgcttacctggtgcaaccccaggcctgaccacagtggaaattgtcacaatgagccaccaggcccttggagacgttgcaggacgtggaaatgaaaagaagcccagttcagtcagagccttaagcattgtgctgcccattgtcctgctcgtgttcctctgtctcggggtattcctattgtggaagaattggcgacttaagaacattaacagtattaatttcgacaacccagtttaccagaagacaacagaggatgaggtgcatatatgccacaatcaagacggctactcttatccgtcaaggcagatggtgtctcttgaagatgatgtagcc

SEQ ID NO: 258 - DNA, 2580 bp, Artificial Sequence
  Description of Artificial Sequence: Synthetic Transcript Sequence
atgggtccgtggggctggaagctcagatggacagtggcgctattgttggccgccgctggcacggcggtcggtgataggtgcgagaggaacgagtttcagtgccaggacgggaagtgcatctcctataagtgggtctgcgacggcagcgccgaatgccaggatggcagcgacgagtcgcaggagacctgcctatccgtcacgtgcaagagcggcgatttttcctgtggcggccgtgtgaaccgatgcatcccccaattttggcgatgtgatggacaggtcgactgcgacaacggctcggatgagcaaggatgcccccccaaaacatgtagccaagacgaattccggtgccatgacggtaagtgtatcagtcgccagttcgtctgcgactcggatagggactgtctagatggctcagatgaggcctcgtgcccggtccttacgtgcggccccgcctcatttcaatgcaactccagcacatgcattccacagctgtgggcgtgcgacaatgatccggactgtgaggacggatccgacgagtggccgcagaggtgtcgaggcctgtatgtgttccaaggagactcgtcgccatgctcggcctttgaatttcactgcttgtccggagaatgcatccatagcagctggcgatgcgacggcggccctgattgcaaggacaagagcgatgaggaaaactgcgcggtggcaacgtgccgcccagacgaatttcagtgctcggatggcaactgcatccacggctcgcgtcagtgtgaccgcgaatatgactgcaaggacatgtcagacgaggtcggctgcgtcaacgtgacactgtgcgagggccccaataagttcaagtgccactccggagagtgtatcacattagataaggtttgcaacatggcccgcgattgccgcgactggtcggacgagccaatcaaagagtgtggcactaatgagtgcctggacaataatggcggatgttcccacgtgtgtaacgagttgaagattggttatgagtgcttgtgtccagacgggttccagcttgttgctcagaggagatgcgaagatatcgatgagtgccaagacccggacacatgtagtcaactctgtgtcaacctggagggcggctacaaatgtcagtgcgaagagggatttcagttggatccgcataccaaggcatgcaaagctgtcggctcgatcgcgtacctattttttacgaaccgtcacgaagtccgtaaaatgactttggatcgctccgagtacacatctctaatccccaaccttcgcaatgtggtcgcgctggacactgaggtagccagcaataggatctactggagcgatttgtcccagcgcatgatatgctcgacacaattggatagggcacacggcgtcagttcgtacgacaccgtgatttcgcgcgacattcaggccccagatggccttgccgtcgattggatacattctaacatctactggacagactccgtgctaggcacggtaagcgtcgccgatacgaagggagtgaagaggaaaaccctgttccgcgagaacggcagcaagcctcgcgctatagtcgtggatccggttcacggattcatgtattggacggactggggcactccggcaaagatcaaaaaaggcggactgaatggtgtagatatttatagtcttgtgactgagaacatccaatggcccaatggcataaccttggacctcctctcaggccgcctgtattgggtagacagcaaactgcacagcatttcaagtatagatgtgaacggaggaaaccgtaagactatcctggaggacgaaaaacgtctcgcccacccctttagccttgctgtgttcgaggacaaagttttctggacagatataatcaatgaggccatcttcagcgctaatcgcctcacaggctccgatgtgaatctgctagctgagaacctactgtccccggaggatatggtcctgtttcacaacctaacccaaccacgtggtgtgaactggtgcgagaggaccaccctgtccaacggaggctgccagtacttgtgccttccggcaccccaaatcaatccccatagcccaaagtttacatgcgcgtgccccgatggtatgctgcttgccagggacatgaggagctgcctgaccgaggcggaggccgccgtggccacccaggaaacatcgaccgtccgcctgaaagtaagtagcaccgcggttaggacgcaacacaccacaacccgtcccgtccccgacaccagccgtttgcccggcgccacgcccggtctgactaccgttgagatagtgacaatgagccaccaagcgttgggagacgtagcaggacgaggaaacgagaagaaaccgagctcggtaagagccctgagcatagtactccctatagtgctactggtgttcctgtgtctgggggtgttcctgctgtggaagaactggcggttgaagaatattaacagtatcaacttcgacaacccagtgtaccaaaagaccacggaggacgaggtgcacatctgccacaatcaggatggttatagttatccgtcccgccagatggtgtctctcgaagacgacgtggcc

SEQ ID NO: 259 - DNA, 2580 bp, Artificial Sequence
  Description of Artificial Sequence: Synthetic Transcript Sequence
atgggcccctggggttggaaacttcgctggactgtggcgctgctgctggccgccgcaggtacagcagttggagataggtgcgaacgtaatgagtttcagtgccaggatggaaaatgcatcagctacaagtgggtgtgcgatggtagtgcggaatgtcaggacggatctgatgaaagccaagaaacctgtctctccgtgacttgtaaatccggagacttctcttgcggcggtagggtgaaccgatgtataccccagttctggagatgcgatggacaggttgactgcgataacggttctgatgagcaagggtgtccacccaagacctgctcacaggacgagtttcggtgccacgacggaaaatgtattagtagacagtttgtgtgcgactctgaccgtgactgcttagatggaagtgacgaggcgtcctgccccgtcttgacctgcgggcccgctagttttcagtgcaacagctccacgtgtattccccagctctgggcctgcgataacgatcctgactgtgaagacggcagcgatgagtggcctcagcggtgccgggggctgtacgtgtttcaaggggacagtagcccctgcagcgcatttgaatttcattgcttaagcggcgagtgtatccactcatcctggaggtgcgatgggggcccagactgcaaagacaagagtgatgaggagaattgcgccgtagcgacatgccgtcctgatgaatttcagtgcagcgatggcaactgcatccacggcagcaggcagtgcgacagagagtatgactgtaaggacatgtctgacgaggtggggtgtgttaatgtgacattgtgcgagggtcccaacaaattcaagtgccactcaggggagtgtattaccttggacaaggtgtgcaatatggcccgagattgccgcgactggtctgatgagcccattaaggaatgtggcacaaatgaatgtctggataacaacgggggctgctctcatgtctgtaacgaacttaaaataggatacgagtgtctctgccccgatggtttccagttggtggcacagcggcggtgtgaggacattgatgagtgccaggatcccgacacctgctcccagctctgtgtcaatctagaaggggggtataaatgccaatgtgaggaaggctttcagctcgacccacacacaaaggcctgtaaggctgtgggcagtatagcatacctgttctttactaaccggcacgaggtccgcaagatgacgttagacagaagcgagtatacaagcctcatccccaatctgcggaacgttgtggcacttgacacagaagttgcgagcaatagaatctattggagtgatctgagtcagagaatgatttgttctacccagctggaccgggcccatggggtaagtagctatgacacggtcatcagtagagatatccaagccccggacggacttgccgttgattggatccactccaatatatactggacagattctgttcttgggaccgtctcggttgccgacaccaagggagttaagcgcaagaccctgttccgcgagaatgggtctaagccaagagcgatagtggttgacccggttcacggcttcatgtactggactgattggggaacacctgccaagattaagaaaggggggctaaacggggtagatatctattctctcgtgactgagaacatacaatggcctaacgggatcactctggacctcctaagcggtcgactctactgggtggattcgaaacttcattcaatcagttccatagacgtgaacggcggaaaccgaaagactattttggaagatgagaagcgccttgcccatcccttctcactggcggtatttgaggacaaggtattctggacagacataatcaatgaagccatattttcagcgaatcgcttaacaggttcggacgtgaacttgcttgccgaaaatttactgagtcccgaggatatggttctgtttcacaatctgacacaaccccgaggagtcaattggtgcgaaaggactacgttatccaacggaggctgtcagtacttatgtcttccggctcctcagatcaatccccattctcccaaattcacctgtgcctgccccgatggcatgctcctggcaagagatatgcggagttgcttgacagaggcagaggcagcagttgcaacacaggagaccagcactgtaaggctgaaagttagttccactgccgtgcgtactcagcatactaccactcgccctgtccccgacaccagcagactcccaggagcgactcccggactgactaccgtggagattgtgaccatgtctcaccaggctcttggagacgttgcaggccggggtaacgagaaaaaaccttctagcgttagggcccttagtatcgtccttcccattgtactcttggttttcctatgcctgggcgtgttcctactgtggaagaactggagacttaagaacattaatagcataaatttcgacaacccggtgtaccagaaaactacggaagacgaggtgcacatatgtcacaatcaagacgggtatagttatccttctaggcaaatggtgagcctcgaagatgatgttgcg

SEQ ID NO: 260 - DNA, 2580 bp, Artificial Sequence
  Description of Artificial Sequence: Synthetic Transcript Sequence
atgggaccatggggctggaaactgagatggaccgtggcgctactattagccgctgcgggaacagctgtcggcgatagatgtgaacggaacgaattccagtgccaggatggcaaatgcatctcgtataagtgggtctgcgatgggagtgcagaatgtcaggatggctccgacgaatcgcaggaaacatgtctttctgtgacctgcaaatctggggatttctcatgtggtgggagagtgaaccgttgtattcctcagttctggaggtgtgacgggcaggtggattgtgacaatgggagtgacgaacagggttgcccgcctaagacgtgtagtcaggacgaattccggtgtcatgacgggaagtgcatatcaaggcagttcgtctgtgacagcgatcgcgattgtctggatggcagtgacgaggcttcttgccccgtgctcacgtgcggccccgcttcattccagtgtaactcttctacgtgcatcccccagctttgggcctgcgacaatgatcccgactgcgaggacggttcagacgaatggccccagcggtgcaggggtttgtatgttttccaaggcgattcctctccatgtagcgcctttgagttccactgcctctccggggaatgcatccactctagttggcgatgtgatgggggaccagactgcaaggataagtccgatgaagagaactgcgccgtcgctacatgtcggcccgacgaatttcagtgctctgacgggaattgtatacacggttctcggcagtgcgatagagaatacgactgcaaggacatgagcgatgaggtcggctgcgtgaacgtgaccctgtgcgaaggacccaacaagttcaaatgccactctggcgagtgcataactctcgacaaagtgtgtaacatggcccgcgactgtcgggactggtcagacgagcccataaaggaatgcggaacgaacgaatgcctagacaacaacggggggtgctctcatgtgtgtaacgaactgaagattggctacgaatgcctgtgtcctgatggcttccaacttgtcgcacagagaaggtgcgaggacatagacgagtgccaggaccctgacacatgcagccagctgtgcgtgaatttagaaggtggatacaagtgtcagtgtgaggaaggatttcaactcgatccacatactaaggcatgcaaagcagtgggctcaatcgcttatctcttctttaccaatcgccacgaagtaagaaaaatgaccctggaccggtcggagtatacctcattgatccctaatctgaggaatgtagtcgccctcgataccgaggtggcctcaaacaggatctattggtccgacctgagtcagaggatgatctgctctacccaacttgatcgggcacacggtgtttctagctacgacacggtcatctcaagggacatccaggctccagacggtctagcagtggactggatacacagcaacatatactggaccgattctgtacttggtacggtatcagtggcagacacgaaaggagtgaaacggaagacccttttcagggagaatgggtctaagccccgcgccatcgtggtggaccccgtacatgggttcatgtactggacagattgggggactcctgcaaagatcaaaaagggcggactgaacggagtcgacatctacagtctggtcacagaaaacattcagtggccaaacggaataaccctggatctcctgtccggtaggctgtactgggtagactctaaattgcactctataagctcaatagacgtgaatggcgggaatcggaagaccatcttagaggatgagaagaggctagcacaccccttctcactagctgtcttcgaagataaggtcttctggaccgacatcataaatgaagcgattttttcagctaatagattaaccggcagcgatgtgaacctactcgcggagaatctcttatcacccgaggacatggtgctttttcataatctcacacagcctcggggggtgaactggtgcgaacgtactaccctgagtaacggtggatgccaatacctttgcttgccggcgccacagataaacccccactccccaaaattcacgtgcgcttgtccggatggcatgctgctagcgcgtgacatgaggagctgcctcactgaggcagaagctgcagtggccacgcaggaaacatctaccgtgcggctgaaagtttctagcaccgccgtgaggactcaacatacaaccacgcgtcccgtccctgacacgtcacggctcccaggtgccacccccggattgacaaccgtggaaatagtgaccatgtctcatcaggctctcggagacgtagcgggccgagggaatgaaaagaagccgtcaagcgtccgggcccttagcatagtgctccctattgtgctcctcgtatttctatgtctgggggtcttcctcttgtggaagaattggcggctgaagaatatcaatagtattaatttcgacaaccctgtctatcagaaaacaacagaagacgaggtgcacatctgccacaatcaagacgggtacagttatccttcaaggcagatggttagtctggaggacgacgtggcg

SEQ ID NO: 261 - DNA, 2580 bp, Artificial Sequence
  Description of Artificial Sequence: Synthetic Transcript Sequence
atgggaccctggggctggaaactcaggtggaccgtagcgctgttgctggcggccgcaggcactgcagtgggcgaccggtgcgagcgcaatgagtttcagtgccaggacgggaaatgcatatcgtacaagtgggtctgcgatggctctgcagaatgtcaggacggaagcgacgaaagtcaggagacctgtctgtctgtgacgtgcaaaagcggcgatttttcttgtgggggacgggtcaatcggtgcattccacagttttggcgctgcgacggtcaggtcgactgtgacaatgggtcagacgaacaaggctgtccacctaagacatgttcccaggatgagttccgatgtcacgatggcaagtgtatttctcgccagttcgtatgcgattcggaccgcgactgtctcgacggatccgacgaagcatcttgccctgtcctgacgtgtggaccagcttcctttcaatgcaactcttctacctgtattccacagctttgggcctgtgacaacgatcccgactgcgaggatggttctgacgagtggccgcaaaggtgtcgtggactctatgtgtttcagggcgatagctccccctgttccgctttcgaattccactgtctctcaggggaatgcatccacagctcctggaggtgcgacgggggtcctgactgtaaggataagtccgatgaagaaaattgtgctgtggctacgtgtcggcctgatgaatttcaatgttccgatggcaactgtattcacgggtcccgacagtgtgatcgtgaatatgactgcaaggatatgagtgatgaggtcgggtgtgtcaacgtgaccctgtgtgaaggtcccaataagtttaaatgtcattccggcgagtgtatcacgctcgataaagtctgcaacatggcacgtgactgcagagactggagcgatgagcctataaaggaatgtgggaccaacgagtgcctggacaataacgggggatgcagtcacgtatgtaatgaattgaaaattggctacgagtgcctatgcccagacggcttccagctggtggcccaacgtcgctgcgaggatatcgatgaatgccaggaccctgatacatgctctcaactgtgtgtgaatctggaaggaggctataaatgtcagtgcgaagaagggtttcagctggacccacacaccaaggcatgtaaggcggtcggtagcatcgcttacctgttctttactaatcggcatgaggtgcgcaagatgaccttagatcggtccgaatacacctccttaatcccgaacctcaggaacgtggtcgcccttgacaccgaagtggcttcaaatcgaatctactggtctgatctgtcccagcgaatgatctgtagtacccagctagatcgggcccatggagtctcctcctatgataccgtgatctcaagagacatccaagcaccagatggcttagctgtcgattggatccactcaaacatctattggaccgactcagttttaggaacagtttccgtcgcagacaccaagggtgtcaagcgcaaaaccctctttcgcgaaaatggaagtaaacctcgcgcgattgtcgtggatccggtccacggatttatgtactggaccgactggggcacaccggcgaagattaagaaggggggactgaatggagtagatatctattcactcgttacagagaacattcagtggcccaacggcattacactagacttgctgagcggccgcctgtattgggtcgattccaaactgcactccatcagcagtatcgatgttaacggagggaatcgcaaaactatactcgaggacgaaaagagactggcacacccctttagcttggccgtcttcgaagacaaggttttctggaccgacattatcaatgaggcaatcttcagtgcaaatagacttacagggagtgacgtgaacttgctggcagaaaatttgctgagccctgaggacatggttctgttccataacctgacacagccacgaggagtgaactggtgtgagagaaccaccctttccaatggtggctgtcagtatctctgtttgccagctccacagattaacccacacagcccgaagtttacatgtgcatgccctgacgggatgctgctcgcacgcgacatgagaagctgcctgacggaggccgaggcggccgtggccacccaagagacaagcaccgtcagactgaaggtgtcctctaccgccgttaggacgcagcatacaacaaccaggccggtgccagataccagccgcctgcctggcgccacacctgggctgacaactgtggagatcgtaaccatgtcccatcaagcactgggagatgtcgctggccgcggaaatgagaagaaacctagctccgttcgggcgctttccatagtactcccgatcgtccttctggtttttttgtgcttaggagtgttccttctctggaagaactggcggctgaaaaatatcaactctataaattttgacaatccagtctaccagaagaccacagaagacgaggttcacatctgtcataaccaggatggctactcctacccgtcccgtcagatggtctccctggaagatgacgttgcg

SEQ ID NO: 262 - DNA, 2580 bp, Artificial Sequence
  Description of Artificial Sequence: Synthetic Transcript Sequence
atgggtccgtggggttggaaattacgatggacggttgcgttattattagcggcggcgggtacggcggtaggtgatcgatgtgaacgtaatgaatttcaatgtcaagatggtaaatgtatatcgtataaatgggtttgtgatggttcggcggaatgtcaagatggttcggatgaatcgcaagaaacgtgtttatcggtaacgtgtaaatcgggtgatttttcgtgtggtggtcgagtaaatcgttgtataccgcaattttggcgatgtgatggtcaagtagattgtgataatggttcggatgaacaaggttgtccgccgaaaacgtgttcgcaagatgaatttcgatgtcatgatggtaaatgtatatcgcgtcaatttgtatgtgattcggatcgtgattgtctagatggttcggatgaagcgtcgtgtccggttctaacgtgtggtccggcgtcgtttcaatgtaattcgtcgacgtgtataccgcaactatgggcgtgtgataatgatccggattgtgaagatggttcggatgaatggccgcaacgatgtcgaggtttatatgtatttcaaggtgattcgtcgccgtgttcggcgtttgaatttcattgtttatcgggtgaatgtatacattcgtcgtggcgatgtgatggtggtccggattgtaaagataaatcggatgaagaaaattgtgcggttgcgacgtgtcgtccggatgaatttcaatgttcggatggtaattgtatacatggttcgcgacaatgtgatcgagaatatgattgtaaagatatgtcggatgaagtaggttgtgttaatgttacgttatgtgaaggtccgaataaatttaaatgtcattcgggtgaatgtataacgttagataaagtatgtaatatggcgcgtgattgtcgagattggtcggatgaaccgataaaagaatgtggtacgaatgaatgtctagataataatggtggttgttcgcatgtatgtaatgaactaaaaataggttatgaatgtttatgtccggatggttttcaattagtagcgcaacgacgttgtgaagatatagatgaatgtcaagatccggatacgtgttcgcaattatgtgtaaatctagaaggtggttataaatgtcaatgtgaagaaggttttcaattagatccgcatacgaaagcgtgtaaagcggttggttcgatagcgtatttattttttacgaatcgtcatgaagtacgtaaaatgacgctagatcgatcggaatatacgtcgctaataccgaatttacgaaatgtagtagcgctagatacggaagttgcgtcgaatcgtatatattggtcggatttatcgcaacgaatgatatgttcgacgcaactagatcgtgcgcatggtgtatcgtcgtatgatacggttatatcgcgtgatatacaagcgccggatggtttagcggttgattggatacattcgaatatatattggacggattcggttttaggtacggtatcggttgcggatacgaaaggtgttaaacgtaaaacgttatttcgtgaaaatggttcgaaaccgcgtgcgatagtagttgatccggttcatggttttatgtattggacggattggggtacgccggcgaaaataaaaaaaggtggtctaaatggtgtagatatatattcgctagtaacggaaaatatacaatggccgaatggtataacgttagatctattatcgggtcgtctatattgggtagattcgaaattacattcgatatcgtcgatagatgtaaatggtggtaatcgtaaaacgatattagaagatgaaaaacgtctagcgcatccgttttcgctagcggtatttgaagataaagtattttggacggatataataaatgaagcgatattttcggcgaatcgtctaacgggttcggatgtaaatctactagcggaaaatttactatcgccggaagatatggtactatttcataatttaacgcaaccgcgtggtgtaaattggtgtgaacgtacgacgctatcgaatggtggttgtcaatatctatgtctaccggcgccgcaaataaatccgcattcgccgaaatttacgtgtgcgtgtccggatggtatgttactagcgcgtgatatgcgatcgtgtctaacggaagcggaagcggcggttgcgacgcaagaaacgtcgacggttcgattaaaagtttcgtcgacggcggtacgtacgcaacatacgacgacgcgaccggttccggatacgtcgcgtctaccgggtgcgacgccgggtttaacgacggttgaaatagtaacgatgtcgcatcaagcgctaggtgatgtagcgggtcgaggtaatgaaaaaaaaccgtcgtcggtacgtgcgttatcgatagttttaccgatagtattattagtatttttatgtttaggtgtttttttattatggaaaaattggcgtctaaaaaatataaattcgataaattttgataatccggtttatcaaaaaacgacggaagatgaagtacatatatgtcataatcaagatggttattcgtatccgtcgcgtcaaatggtatcgttagaagatgatgtagcg

SEQ ID NO: 263 - DNA, 2580 bp, Artificial Sequence
  Description of Artificial Sequence: Synthetic Transcript Sequence
atgggaccttggggttggaagttgagatggactgtggccctgttgttggcggcggctggcaccgcggtgggagacagatgtgagagaaacgaattccaatgccaggatggcaagtgtatctcttataagtgggtctgcgatggttccgcagaatgccaagatggctctgacgagagccaggagacatgcctctctgtgacctgtaaaagcggagatttcagctgtgggggtcgcgtgaatcgttgcatcccacaattttggcggtgtgatggacaggtggattgtgacaacggtagtgacgagcaaggctgtccccctaagacctgttcccaagacgagttccgctgccatgacggcaagtgcatcagtaggcagtttgtttgcgattcagatagggactgtctggatggatctgacgaggccagttgtccagtgttaacctgcggcccggcgagcttccaatgtaatagctctacttgtataccccagctttgggcttgcgataatgacccggactgcgaagatggcagtgatgaatggccacaaagatgcagaggattgtacgtcttccagggagactctagtccttgcagcgcctttgagttccactgtctgagcggtgagtgcattcattctagctggcggtgcgacggcggacctgattgtaaggacaagagtgatgaggagaactgtgccgtggcgacatgtcgcccggatgagttccagtgctccgatggaaactgtatccacggatcacgacaatgcgacagggaatacgattgcaaggatatgagtgacgaggtagggtgcgtgaacgttacactttgcgagggaccaaacaaatttaaatgccattctggcgagtgtatcacactggataaagtctgcaacatggcccgcgactgtagggattggtccgacgagccaatcaaagaatgtggcacaaacgagtgtctcgacaacaacgggggttgcagccacgtttgcaacgagctgaaaatcggttatgagtgtctgtgccctgatggcttccagctggtggcgcagcggagatgtgaggacattgatgaatgccaggatccagatacatgttcccaactctgtgtcaatctggagggcggctataagtgccagtgtgaagaaggattccagctcgatccgcacacaaaggcgtgcaaagctgtaggatccatagcttatcttttcttcactaatcggcatgaggttagaaagatgaccctggatcgctcggaatatacctctctgatccctaacctccgcaacgtggtggcgcttgacaccgaggttgccagtaacagaatctactggagcgacctcagccagcgcatgatctgttcaacccagcttgacagggctcatggcgtgagcagctatgacacggttataagtcgagacattcaggctcccgatgggctggccgtggattggatccacagcaacatttattggaccgacagtgttcttggcactgtgagcgtggctgataccaagggggtgaaaaggaagaccctctttagggaaaacgggagcaagccccgtgccatcgtggttgacccggtccatggattcatgtactggaccgactggggaaccccagctaaaataaagaaaggaggactgaatggcgtggacatctactcactcgtgaccgagaacatccaatggcccaacggcatcacactagatctgcttagcgggcgcttgtactgggttgattccaaactgcacagcataagcagcatcgacgtgaacggaggaaaccgaaaaacgatactcgaggatgagaaacgcctggcacatcctttcagcctggcggtgtttgaagacaaggtgttctggaccgacatcattaatgaagctattttctctgcaaacagactcaccggaagcgatgtgaatcttcttgctgaaaacctgctgagtccagaagatatggttctgtttcataatctgacacagcctaggggagtcaactggtgtgaacggaccaccctctccaacgggggttgtcaatatttgtgcttgccagctcctcaaataaatccacatagccccaaatttacatgtgcctgccccgacggcatgctgctggcacgagatatgcggagctgcttgaccgaggcagaggcagccgtggctacacaggagacatctaccgtgcggctgaaagtgagtagtacagcagtcagaacccagcatactaccacccggccagtgccagatacttcaagactgcccggcgcaacacccgggctgacaacagttgagatagtgacaatgagccaccaggccctcggcgatgtggcaggacgcgggaacgagaagaaaccttccagcgtgagggccctcagcatcgtgttgccaatagtcctgttggtctttctgtgcctgggggtgttccttctctggaagaactggaggctgaaaaacattaactctatcaacttcgataatcctgtgtaccagaaaacaaccgaagacgaggttcacatttgtcacaaccaggacggatattcctaccccagccgccagatggtctcactggaggatgacgttgca

SEQ ID NO: 264 - DNA, 2580 bp, Artificial Sequence
  Description of Artificial Sequence: Synthetic Transcript Sequence
atgggcccgtggggctggaaactccggtggacggtggccctgttgctggccgccgcaggaaccgcggtgggagatcgctgcgaacgcaacgagttccagtgtcaggacggtaagtgcatctcctacaagtgggtgtgtgacggatccgccgaatgtcaagacggatcagatgagagccaggaaacctgtctgtccgtgacctgcaagtcgggcgacttctcgtgcggaggccgggtcaatcgctgcatcccacagttttggcggtgtgatggacaagtggactgtgataacggaagcgacgaacagggatgtcccccaaagacttgttcgcaagacgaatttcgatgccacgacggcaaatgtatctctaggcaatttgtctgcgattccgaccgggattgcctggacggatcggatgaagcgagctgccctgtcctgacttgtggaccagcgagctttcaatgtaactcctcgacctgtatcccgcagctgtgggcctgtgataatgatccggactgcgaggatggctccgacgaatggcctcaaagatgccgcggcctgtacgtcttccagggtgatagctccccctgctccgcttttgagttccactgcttgagcggagaatgcattcattcaagctggcgctgtgacggcggtccagattgtaaggataagtcagatgaggagaactgcgccgtggccacttgccgcccggatgaattccagtgcagcgacggcaactgcattcacggatcgagacagtgcgaccgcgagtacgactgtaaagatatgtcggacgaggtgggctgcgtgaacgtcaccctgtgcgagggacccaacaaattcaagtgtcactcaggcgaatgcatcactcttgataaggtgtgcaatatggcgcgggactgtcgggactggagcgatgaaccgatcaaggaatgtggcactaacgagtgcctggacaacaacggaggatgctcccatgtgtgtaacgaactgaagatcggatacgaatgcctgtgcccagatggttttcagctggttgctcagcggcgctgcgaagacatcgacgagtgccaggatccggatacctgtagccagttgtgcgtgaacctcgaaggcggatacaagtgccagtgcgaggagggatttcagctcgaccctcataccaaggcgtgtaaggcggtgggatcaatcgcctacctctttttcaccaatcgccacgaggtgcgaaagatgaccctggatagatccgaatacacttcgctcattcctaatttgcggaatgtcgtcgccctggatactgaggtggcatcaaatcggatctattggagcgatctctcacagcggatgatctgttcgactcaactcgaccgcgcccacggagtcagctcgtacgacaccgtgatatcgagagatatccaagcccctgacgggctggcagttgactggatccattccaacatctattggaccgactccgtgctgggtaccgtgagcgtggcagacactaaaggagtcaagcggaagaccctgtttagggagaacgggagcaaacctcgggccatcgtggtggacccggtgcacggatttatgtactggaccgattggggcaccccagctaagatcaagaaaggagggcttaatggagtcgacatctactcgctggtgaccgagaatatccagtggcccaatggcatcactctggacttgctgtctggccggctctactgggtggactccaagctgcactcgatctccagcatcgatgtgaacggcggtaacagaaagaccattctcgaagatgaaaagcgcctcgctcacccattttcgctcgcagtctttgaagacaaggtgttctggactgacatcatcaatgaagctatcttttcggcgaataggctgaccggctcagatgtgaacctccttgcggagaaccttctttcgccagaagacatggtgctcttccataatcttacccagccacgcggcgtgaactggtgcgaaaggactactctcagcaatggtggatgccaatacctctgccttccggccccgcagatcaatcctcactcgccgaagttcacttgcgcgtgcccagacggcatgctgctggcgagggacatgaggtcctgtctgactgaggcggaggcggccgtggccacgcaggagacttcaactgtgcgcctgaaggtgtcctccaccgccgtgcggacccagcataccactacccgtccggtgccggacacgtcacggctgccgggagcgaccccggggcttactaccgtcgagattgttaccatgtcccaccaggcactgggagatgtggccgggcgcggaaacgagaagaaaccaagctccgtgcgcgctctgtcaattgtgctgcctattgtactgctggtgttcctctgtctgggagtgtttctcctgtggaaaaactggagactgaaaaacattaacagcattaacttcgacaacccagtctaccagaaaaccactgaagacgaggtgcacatttgtcataaccaggacggatacagctacccatcccggcagatggtgtcgttggaggacgacgtggcc

SEQ ID NO: 265 - DNA, 2580 bp, Artificial Sequence
  Description of Artificial Sequence: Synthetic Transcript Sequence
atgggcccatggggctggaagctgcggtggactgtggcgcttctcctggcggcggcgggaactgcagtgggagatagatgtgaacgtaacgaatttcagtgccaagacggcaagtgtattagctacaagtgggtgtgcgacggttccgcagaatgtcaggacggatccgacgaatcgcaggagacttgtctctcagttacttgtaagtcgggagatttctcatgtggtggacgcgtgaatcgctgtattccgcaattctggagatgtgatggacaagtcgattgtgacaacgggagcgacgaacaaggatgccctccaaagacttgttcacaggatgaattccgttgtcacgacggaaagtgcatatccagacagtttgtgtgtgacagcgatcgggactgtcttgatggttcggacgaagcctcctgtccagtccttacttgtggacccgcgagctttcaatgtaatagctcaacgtgtatcccgcaactgtgggcgtgcgacaatgatccagactgtgaagatggaagcgacgaatggcctcagcgctgtagaggcctgtatgtgtttcaaggggattccagcccttgttcagcctttgagtttcattgcttgagcggcgaatgtattcattcctcatggcgctgtgatggagggcctgactgtaaagataaatccgatgaagaaaactgcgcagtggcaacttgccgtcccgatgagttccaatgcagcgacggcaattgcatacatggaagccgtcagtgtgatcgcgaatacgattgcaaagatatgtccgacgaagtgggatgtgtgaatgtgaccctgtgtgagggcccgaataagttcaagtgtcactcaggagagtgtattacgctggataaggtgtgtaacatggcccgtgattgtagggactggtcggatgaaccaatcaaggagtgtggtactaatgaatgtctggacaacaacggaggttgcagccatgtgtgtaacgagcttaagatcggttacgagtgcctgtgtcctgatggtttccagctggtggcacagcgacgctgtgaggacatcgacgagtgccaggaccccgacacctgctcgcagctttgcgtcaatctcgaaggcggatacaagtgtcaatgtgaagaaggatttcaactggacccccatactaaagcatgtaaagcagttgggtctattgcatacttgttctttaccaaccgtcacgaagtccgaaaaatgacgctggataggtcggaatacaccagcctcattccaaatctgcgcaacgtggtggcgctggataccgaggtggcatcgaataggatttactggtcggacctctcccaacgcatgatctgtagcacccagctcgatagagctcacggggtgtcatcttacgatactgtgatttcccgtgatattcaggcccctgatggcttggctgtcgactggatccatagcaacatatactggaccgattcggtgcttggtactgtctcggtggcagacaccaaaggcgtgaagaggaaaacgctttttagagagaacggatccaaacctagagcaatagtcgtcgatcccgtacacgggtttatgtattggacggactggggtacgcccgcaaaaatcaagaaaggaggcctcaacggcgtcgatatctactcgctggtgactgaaaacattcagtggcctaatgggatcacccttgatctgctttcagggcggctttactgggtggatagcaagctgcactcgataagctcgatagacgtgaacggcggaaatcgtaaaactatactcgaggatgaaaagcgattggcacatcctttctcactggcagtctttgaggataaggtgttttggaccgatatcatcaacgaagcgatcttttccgcaaacagacttaccggttcggacgtgaacctcctggcggaaaacctcctttcgcctgaggatatggtgttgtttcataacctcactcaaccaagaggcgtgaattggtgcgagaggaccacgttgtcaaatggaggatgccaatacctgtgtctcccggccccacaaatcaaccctcactcccccaaattcacctgcgcctgcccagatggtatgctgcttgccagagatatgcgaagctgcttgaccgaggccgaagcagcagtcgcgacccaagaaacttctactgtgaggctgaaggtatcgtctaccgcagtcagaacgcaacataccaccactagaccagttcctgatacctcgcggcttccgggggccaccccaggtctgacgacggtcgaaattgtgactatgtcgcatcaagcgcttggagacgtggcaggtcgcggaaacgaaaagaagccgagcagcgtccgggctctgtccattgtcctccccatcgtgcttcttgtgtttctttgcttgggagttttcctgctctggaagaactggagactgaaaaacatcaatagcattaacttcgataacccagtgtaccagaaaaccactgaagatgaagtccacatttgtcataaccaggacggttactcgtacccttctcgtcaaatggtgagcttggaggacgatgtggcg

SEQ ID NO: 266 - DNA, 2580 bp, Artificial Sequence
  Description of Artificial Sequence: Synthetic Transcript Sequence
atgggaccatggggatggaaactcaggtggacggtggctcttctattggccgcggcagggaccgcggtcggtgatagatgtgagcggaatgaattccagtgtcaggacggcaagtgtatctcttacaaatgggtctgtgatgggtctgcagagtgccaagatgggagcgacgagtcacaagagacatgtttgtccgttacgtgcaaaagcggcgatttctcgtgtggtggccgagttaatcgctgtatcccacaattttggcgttgcgatggacaggtcgattgcgataacggctcggacgagcagggttgcccgcctaaaacttgcagccaggatgagtttcgatgccatgacggcaagtgtatctcccgccagttcgtctgtgattccgatagagattgcctcgatgggtcagatgaagcatcctgcccagtgctgacctgtggcccggcatctttccagtgtaattcttctacatgcattccgcagctgtgggcatgtgataatgatccggattgtgaggatggctcggatgaatggccgcagcgctgccgcggactgtatgtcttccaaggtgattcctccccatgcagcgcgttcgagttccactgcctatccggagagtgtatccactcgtcgtggcggtgcgatggtggaccagactgtaaagacaaatcagatgaagagaactgtgctgttgctacctgcagacccgacgagttccagtgtagcgatggaaactgcatccacggcagccggcaatgcgatcgagaatatgattgtaaagatatgtcagacgaagtgggctgcgttaacgtcacactctgtgaagggccaaacaaatttaagtgccatagtggtgaatgcattaccctggataaggtatgcaatatggcacgcgattgccgggattggtcggatgagcccatcaaggaatgcggcactaacgagtgccttgataacaatggcggatgcagccatgtctgcaatgaacttaagatcggctacgaatgtctttgtccagatggatttcaactagttgctcaaaggcgatgcgaggacattgatgaatgtcaagaccctgacacttgtagccagctgtgcgtcaatctcgaaggtggctacaagtgtcagtgtgaggaaggttttcaacttgacccccacaccaaagcgtgcaaggcggtgggttccattgcctatttgttctttacaaatcgtcatgaggttcggaaaatgacgcttgaccgctctgagtataccagtcttataccaaacctccgcaatgtggtcgctctcgatacagaggtggcctccaatcgtatttactggtccgatttgtcccagcgaatgatttgttctacccagttggaccgggctcacggcgtctcttcctacgataccgttataagccgggacattcaggcccccgatgggttggccgtcgattggatccattcgaacatttactggaccgattctgtattgggcactgtctcggtcgctgacacaaagggtgtgaaacggaaaacgctgttcagagagaatggatccaagcctcgggccatcgtggtggatcccgtccacggcttcatgtactggaccgattggggcacgcctgccaagataaaaaaggggggtttgaacggagtcgatatctactcgttggttacggaaaatattcaatggcctaatggtatcaccttggatctgctttcaggacggctgtactgggtggactctaagctacattccatatcgtcgatcgatgtcaacggcggtaataggaaaacgatacttgaggatgagaagcggctcgcacaccccttctcactcgctgttttcgaggataaagtgttctggacggacattataaacgaagcaattttctcagctaatcgacttaccggcagcgatgtcaatctgctcgccgagaatctgctgagtcccgaagacatggtgcttttccacaacctaacccagcctcgtggggtcaattggtgtgagaggacaaccctgtccaacggcggttgtcagtatctatgcctgccagctccgcagatcaacccacactcacccaagttcacctgcgcttgccctgacggtatgcttttagcgcgcgacatgcgaagctgccttacggaggccgaagccgcagtggcaacccaagaaacatccactgtgagattgaaggtgtcttccacagcagtccggactcagcatactacgacccgaccggttcccgacacaagcaggctccccggtgccactccgggtttgactacagttgagatcgtgactatgagtcaccaggcactcggagacgtggcggggcgtggtaacgagaagaaaccttcgtcagtgcgagcattgtcgattgtgctaccaatagttcttcttgtcttcctgtgtcttggagtattcttactgtggaagaattggagactgaagaacatcaatagcattaacttcgataaccctgtttaccagaagacaacagaagacgaggtccatatttgccataatcaggatggctattcgtatccttcacgtcaaatggtctctcttgaagacgacgtcgcg

SEQ ID NO: 267 - DNA, 2580 bp, Artificial Sequence
  Description of Artificial Sequence: Synthetic Transcript Sequence
atgggaccctggggatggaaacttcggtggactgtggcacttctgctggcagcggcaggaaccgccgtgggtgatagatgtgagcggaacgagttccaatgtcaagatggtaagtgcatcagctacaagtgggtgtgtgatggatcggccgaatgtcaggacggctcggatgaatcgcaagagacttgtcttagcgtcacttgcaagtcgggtgatttttcgtgtggtggcagagtgaaccggtgtatcccccagttttggcgctgcgatggtcaggtcgactgtgataatggatcagatgagcaaggttgtcctccaaagacctgctcgcaagatgaatttcggtgccatgatggtaagtgtatatcgagacaattcgtctgtgattcagaccgggattgcctggacggctccgatgaagccagctgcccggtgcttacttgtggtccagcatcattccaatgcaattcctcgacttgtattcctcagctgtgggcatgtgataacgacccagattgtgaagatggatctgacgagtggcctcaacggtgtagaggtttgtacgtgttccaaggagatagcagtccttgttcagcattcgaatttcactgtttgtccggtgagtgcatccattcctcctggcggtgcgacggaggccctgactgtaaagacaagtcagatgaggaaaattgcgcagtcgcaacttgccggccagacgagttccagtgttcagatggcaactgtattcatggatcaagacagtgcgatagggaatacgattgcaaggatatgagcgacgaagtggggtgtgtcaacgtgactctttgtgaaggtccgaacaagtttaagtgtcattccggcgagtgtatcaccctcgacaaggtgtgcaatatggccagagactgtcgggactggtcggatgagcctatcaaggagtgtggaaccaacgaatgcctcgacaataacggtgggtgctcgcatgtgtgtaacgagctgaagatcggttacgaatgcctctgtcctgacggattccaattggtggcacaacgccgctgtgaggacatagatgaatgtcaagatcctgacacgtgttcgcaactttgcgtgaacctcgaaggtggctacaagtgccagtgcgaagaggggttccagctggatccacacaccaaagcctgtaaggcagtaggatcgattgcatatctgttctttactaaccgtcatgaggtccgcaagatgactcttgacaggtcagagtacaccagcctgattcctaatctgcggaacgtggtggcacttgacaccgaagtcgcttcaaatcgaatttactggtcggacctcagccagagaatgatttgtagcacccagctcgaccgtgctcatggtgtgtcgagctacgataccgtgatctccagagatattcaagcaccagatggtcttgctgtggattggatccacagcaatatctactggaccgattcggtcttgggaaccgtgtcggtggctgacacgaagggcgtcaagagaaagaccttgtttagggaaaacgggtcgaagcccagggcaattgtggtcgatcccgtgcacggctttatgtattggaccgattggggaactcctgcaaagattaagaaaggagggctgaacggtgtggacatttactcgcttgtcaccgagaacatacagtggcctaatggaattactcttgatcttctttcagggagactgtactgggtggattcaaagttgcactccatcagctcaatcgacgtgaacggtggaaacagaaagactattcttgaagatgagaaaagactggctcatccttttagccttgccgtgttcgaagataaggtcttttggaccgacattatcaatgaagcaatcttcagcgccaacagactgaccgggagcgatgtgaatttgcttgctgagaatctcctctcgcctgaggacatggtcctcttccataaccttactcaaccaaggggtgtgaactggtgtgaacgaaccaccctgtccaacggggggtgccagtacctttgtctcccggcaccacaaatcaaccctcattcgcctaagtttacctgtgcatgtccagatggaatgctgctggcaagggatatgagatcatgtctgaccgaggcagaagcagccgtggcgacccaagagactagcaccgtgcggctcaaagtttcctccacggccgtgaggactcagcataccactaccaggcctgtcccagacacctcgagactccccggagccacgcccggtctgaccacggtcgaaatagtcaccatgtcgcatcaggcattgggagatgtggcaggaaggggtaatgagaaaaagccctcgtcggtgcgagcattgtccattgtgcttcctatcgtgctcctcgtttttctctgcctgggggtctttctgctttggaagaactggcgactcaagaacataaactccatcaattttgataatcctgtgtaccaaaagaccactgaagatgaggtgcacatttgtcataaccaggacgggtattcatacccgtctcgtcagatggtgagccttgaggatgatgtcgca

SEQ ID NO: 268 - DNA, 2580 bp, Artificial Sequence
  Description of Artificial Sequence: Synthetic Transcript Sequence
atgggtccgtggggttggaaattgcgctggacggtcgcgcttctcctcgcagccgccggaaccgcggtgggagatcggtgcgaaaggaacgagttccagtgccaggatgggaagtgtatcagctacaagtgggtctgcgacggttcggccgaatgccaggacggaagcgacgaatcgcaggagacgtgcctgtccgttacttgtaagtcgggagacttctcgtgcggtggacgcgtgaatcgctgcattcctcagttctggaggtgtgatggacaagtcgactgcgacaacggatccgacgaacagggctgccctcctaagacctgctcccaagacgagttcagatgccacgacgggaagtgcatctctcgacaatttgtgtgcgattcggaccgcgattgcctggatggctccgatgaagcatcctgtcctgtgctgacttgcgggccagccagcttccagtgcaattcgagcacttgcatcccacaactttgggcgtgtgacaacgacccagactgcgaagatggttcagacgagtggccacagcgttgccggggactgtacgtctttcaaggcgacagctccccgtgctcagcctttgagttccactgtctctcgggcgaatgcatccattcctcatggagatgcgatgggggccctgactgcaaggataagtcagacgaagagaattgtgccgtggctacctgccgcccggacgagttccaatgcagcgacggaaactgcatacatgggtcacggcaatgtgatagagaatacgattgcaaggatatgtcggatgaagtcggatgtgttaatgtcaccctttgcgaaggacccaacaagttcaagtgccactccggcgagtgcatcactttggataaggtgtgtaatatggccagggactgccgggattggtcagacgagccgatcaaggaatgcggaaccaacgaatgcctcgacaacaacggcggatgtagccacgtgtgcaacgaactgaagatcggttacgaatgtctgtgcccagacggcttccagcttgtggcccaacggaggtgcgaggacatcgacgagtgtcaggatcccgacacttgcagccagctgtgtgtcaacttggagggagggtacaagtgtcagtgtgaagaagggtttcaacttgatcctcacactaaggcttgcaaggccgtcggttcaatcgcttaccttttctttaccaatcgccacgaggtgagaaaaatgaccctcgatcgcagcgagtacacttcgctgatcccaaacttgcggaacgtggtcgcgctggacaccgaagtggcttccaatagaatatactggtctgacctgtctcagaggatgatctgctccacgcaattggatcgggcacatggagtgtcgtcctacgacacggttatctcaagggacatccaagctccggacggcctcgcggtggactggattcactctaacatctactggacggactccgtgctgggaaccgtctccgtcgccgatactaaaggcgtgaagcggaaaactctgtttcgggaaaatggcagcaaaccccgagccatcgttgtggacccagtccacggattcatgtactggactgactgggggaccccagcaaaaatcaagaagggcggactgaacggagtggacatctattcccttgtcactgagaatatacagtggccgaacggcattacgctggatttgctgtcgggccgactgtactgggttgactcgaaactgcatagcatttccagcatcgatgtgaatggaggcaaccggaaaactatcctcgaggacgaaaagcgccttgcacacccgttcagcctggccgtgtttgaggacaaggtcttttggacggacattatcaacgaggccatcttctcagcaaatagacttactggatccgatgtgaatctcctcgcagagaaccttttgtctccggaagatatggtgctcttccataacctcacccaaccgcgcggagtgaattggtgtgagcgcactaccttgagcaatgggggttgccagtacctctgcctcccggctccccagatcaatccgcatagcccaaaattcacctgcgcctgtcctgatgggatgctgctcgcgagagacatgcggagctgcctgaccgaagccgaagcggccgtggccacgcaagaaacgtcaaccgtgcgccttaaggtcagctcaactgcagtgagaactcagcataccaccacccgccctgtcccggacacctcccggctgccaggagccacccccggcctgacgaccgtggaaattgtgaccatgagccaccaggcgctgggcgacgtggcgggacgcggaaacgagaagaagccgtcatctgtgcgcgcgctgtcaatcgtgctgcctattgtcctgcttgtgttcctgtgcctgggcgtgttcctgctgtggaaaaactggaggctcaaaaacatcaactcaatcaatttcgataacccggtctaccagaaaaccactgaggacgaggtgcacatttgccataaccaggacggatactcctatccgtccagacaaatggtgtctctggaagatgacgtggcc

SEQ ID NO: 269 - DNA, 2580 bp, Artificial Sequence
  Description of Artificial Sequence: Synthetic Transcript Sequence
atgggcccgtggggatggaagctccgctggaccgtggctctcctcctcgctgccgccggaactgccgtgggtgatcgatgcgagcggaacgagttccaatgccaggatggaaagtgcatttcatacaaatgggtgtgtgacggcagtgcggaatgccaggacggttccgatgagtcgcaagagacttgtctgtcggtcacttgcaaaagcggagacttcagctgtggtggacgagtgaaccggtgcatcccgcagttctggagatgcgatggccaggtcgattgcgacaacggttcagacgaacagggatgcccaccgaaaacctgctcccaggacgagtttaggtgccacgatggcaaatgtatttcccgccagttcgtgtgtgattccgacagggattgtctggacggctcggacgaggcgtcatgcccggtccttacttgtggtccggcctcattccaatgcaattcaagcacctgcatcccccaactgtgggcatgcgataacgatccggactgcgaagatggtagcgacgaatggccacagagatgccggggactctacgtttttcaaggggatagctcgccttgctctgcatttgagtttcactgtctttccggagagtgtatccactcctcgtggcgctgtgacgggggacctgactgcaaagacaaatcggatgaggaaaattgcgcggtcgctacctgcagacccgacgaatttcagtgttccgatggcaactgtatccacgggagtcggcagtgcgaccgtgagtacgattgcaaggacatgtcggacgaagtggggtgcgtcaatgtgacgctgtgcgaagggcccaacaaattcaagtgccactctggagagtgcatcaccctggacaaggtctgcaatatggcacgcgactgcagggattggtcagatgagccgataaaggaatgtggaactaacgagtgtttggataacaacggcggttgctctcacgtgtgcaatgaattgaagatcgggtacgaatgcctgtgcccagacggttttcagctggttgcgcagcgcagatgtgaggacatcgacgaatgccaagacccggacacttgttcacagctgtgcgtcaatcttgaaggtggatacaaatgccagtgcgaagaaggtttccaacttgacccgcacactaaggcctgcaaggcagtcggatcgattgcttatctcttcttcaccaaccgccatgaggtgcggaagatgaccttggaccggtcagaatacacgtccctcatcccgaatctcagaaacgtggtggccctcgacaccgaagtggcctccaaccgcatctactggtccgacctttcacagcggatgatctgctcgacgcaactcgaccgggcacatggagtgagtagctacgacactgtgatctcgcgggatatccaggcaccagatgggctggctgtggattggatccattcaaacatctactggaccgactccgtgctgggcactgtgagtgtggccgacactaagggagtcaagcgcaagaccttgttcagggaaaacgggagcaaacccagggctatcgtggtggaccccgtgcacggcttcatgtactggaccgattgggggaccccggcaaaaatcaagaagggcggactgaatggagtggacatctactcgctggtgaccgagaacattcagtggccaaatggaatcactctggatctgctgtcaggtaggttgtattgggtagactcgaagctgcattccatctcctcaatcgatgtgaacgggggaaacaggaaaacgatcctcgaggacgaaaaacggctggcgcacccattttcactggccgtgttcgaggataaggtcttttggactgacatcattaatgaagctatcttctccgcaaatcgcctcacgggctccgatgtgaatctgctcgcagagaatctgctgtcgccagaggacatggtgctgttccacaaccttacccaacctcgcggggtcaactggtgcgaaagaactaccctgtccaatggtggatgccagtacctttgtctcccggcgcctcagatcaacccgcatagcccgaagttcacgtgtgcatgcccggacggaatgctgctcgcccgggacatgagatcgtgcctgactgaagcggaggccgccgtggccacgcaggaaacttcaactgttaggctcaaggtgtcgtcgacggccgtcagaacgcaacataccactacccgccctgtgcctgacactagcagactcccaggagccaccccgggactgactactgtggaaatagtgactatgtcgcatcaagcactcggagatgtcgcgggacgcggaaatgagaagaaaccgtccagcgtgcgagcgctgtcgattgtcctcccgatcgtcctgttggtgttcctgtgtctcggagttttcttgctctggaagaactggcgtctgaagaatatcaatagcattaacttcgacaacccggtttaccagaaaactaccgaggacgaagtgcacatctgtcataaccaggacggatactcgtacccaagccggcagatggtatccctggaagatgacgtggcc

SEQ ID NO: 270 - DNA, 2580 bp, Artificial Sequence
  Description of Artificial Sequence: Synthetic Transcript Sequence
atgggcccctgggggtggaagctgcgttggaccgtggcgctgttgctggccgccgcggggacggctgtgggggatcgatgtgagcggaacgagtttcaatgccaggacggtaaatgtatatcctacaaatgggtgtgtgatggtagcgctgaatgtcaggatggaagtgacgagtctcaagagacttgcctgagcgtaacctgcaagtctggagacttttcttgtggcggaagggtcaacaggtgcataccacaattttggcgctgtgatggccaggtcgactgcgataatggcagcgatgagcagggttgtccacccaagacatgcagtcaggacgaattccggtgtcatgatggaaagtgtatctctaggcagtttgtgtgtgatagtgatcgggattgtctggatggcagcgacgaagctagctgccctgtcttgacttgtggacccgcttcattccagtgcaattctagcacttgcattccacagttatgggcgtgcgataacgatcccgattgtgaggatggcagcgacgagtggcctcaaagatgtcgcgggctctacgttttccagggggactcatccccatgctctgcattcgagttccactgtctatccggagagtgcattcacagcagctggaggtgtgacggcgggccagactgcaaagataagtcagatgaggagaattgcgcagttgccacctgtaggccagatgagttccaatgtagtgatgggaattgtatacacggctccaggcagtgtgatagagagtacgactgcaaggacatgtctgatgaagttgggtgcgtgaatgtaacactgtgcgagggaccaaataaattcaagtgccatagcggcgagtgtattacgctggataaagtttgcaacatggctagagactgtcgggattggtctgacgaacccattaaagaatgtggcactaatgaatgcctcgataacaatggggggtgcagccatgtttgtaacgagctgaagatcggatacgagtgtctgtgtcctgacgggtttcagttggttgcccaacgcaggtgtgaagatattgatgagtgccaggatcctgatacgtgcagccagctctgcgttaacttagagggtgggtacaaatgtcagtgcgaggagggatttcaattagaccctcatacgaaagcatgcaaggctgtggggtctatcgcttatctcttttttacaaatcgacatgaggtgaggaagatgacgttagatcggagtgagtatacctccctgattcccaatctgcgcaatgttgtcgcgcttgacactgaggtcgcatctaatcgcatctattggagcgatctgagccaaaggatgatctgttccacccagctggatcgagcccacggggtcagttcctatgataccgtgatttccagagacattcaggccccagacggcctggccgttgactggatccactccaatatctactggactgattccgttctggggactgtgtccgtggctgacactaaaggggtcaaaagaaagactctgtttagagagaatggttccaaaccaagagcgatcgtcgtggaccccgtgcatgggtttatgtattggacagactggggaacacccgccaaaatcaagaaaggtggcctgaacggcgtcgatatctatagtctcgtcaccgaaaatatccaatggcccaacgggattactcttgatctgctctccgggcggttatactgggtcgacagtaagttacacagtattagttccatcgacgtgaacgggggcaatagaaagaccatcctggaggatgagaaaagactggctcatccattctccctggccgtgtttgaggataaggtgttctggaccgatatcattaatgaagccattttcagtgcaaatcggcttaccggttctgacgtaaatttgttagccgaaaatctactcagtcctgaagatatggtcttgttccacaatctcactcagcctcgtggggtgaattggtgcgagaggacgacgctttccaacgggggttgtcagtatctctgcctgcctgctccgcagataaatccgcatagtccgaaatttacttgcgcctgcccagatggcatgctgctagcccgagacatgagaagctgcttgacggaggctgaagccgctgtagccacccaggagacgagcacagtccgactaaaagtgagctcaaccgctgttcgcactcagcacacaaccaccagaccggtgcccgatacatcacggctccctggtgcaactccaggcctcaccaccgttgaaatagtgacaatgtcccaccaagccctaggcgacgtggcaggccgcggcaacgagaaaaagccgagttcggttcgggccctaagtattgttttacctatcgtcctgctggtcttcctgtgcctgggagtgttccttctgtggaaaaactggaggctgaaaaacattaacagcatcaactttgacaacccggtctaccagaagactaccgaggacgaagtgcacatttgtcacaatcaggatggctactcctaccccagtagacaaatggtcagcttggaggatgacgtcgcc

SEQ ID NO: 271 - DNA, 2580 bp, Artificial Sequence
  Description of Artificial Sequence: Synthetic Transcript Sequence
atgggcccttggggttggaagctgcggtggaccgtcgctctgcttttggcagcggccgggaccgcagtgggcgatcgctgcgaacggaacgagttccagtgtcaggatggaaagtgtattagctacaaatgggtatgcgacggtagcgcggagtgccaggatggcagtgatgagtcccaggaaacgtgcctatcagtcacgtgtaagtccggcgattttagttgcggcgggcgggtgaacagatgcatccctcagttctggcgttgcgatggtcaggtcgattgcgacaacggatctgacgagcagggctgcccgccaaaaacctgttcgcaggacgagtttagatgtcacgacgggaaatgcatatctagacagttcgtttgtgactcagatcgagactgcctggacgggagtgatgaggcctcctgccctgttctcacgtgtgggccagcctctttccagtgcaattcttccacttgcatccctcagctgtgggcttgcgacaacgatcctgactgtgaggatggatctgatgaatggcctcagaggtgccgcggactgtatgtcttccaaggggatagctccccatgcagcgccttcgaattccactgtctgagcggtgaatgcatccacagtagctggcgttgcgacggtggacctgactgcaaagataagagcgatgaggaaaactgcgccgtagcgacctgcaggccggacgagttccagtgtagtgacggtaactgtatccacgggtcccgtcagtgtgatcgggagtacgactgtaaggacatgtccgatgaagtcggctgtgtgaacgtgacactctgtgaaggcccgaacaagttcaagtgtcactctggggagtgcattacgctagacaaagtatgcaatatggctcgggattgtcgggactggagcgatgaacctatcaaagagtgtggtaccaacgaatgtcttgataacaatgggggctgctcacacgtgtgcaatgaattgaagatcgggtatgaatgcctctgtccggacgggtttcaactagtggcacagcgccgttgcgaggacattgacgaatgccaggaccctgacacgtgcagccagctgtgtgtgaacctggagggcggctacaagtgtcagtgcgaagagggcttccagctcgatccccacaccaaggcctgtaaggccgtaggcagcattgcatatctgttttttactaatagacacgaagtccggaagatgacgttggacaggtccgagtacacctcactgatcccaaatctgagaaatgtcgtggcgctggataccgaggtagcttcgaacagaatctattggagcgatctgtcgcaacggatgatctgctccacccagctggaccgggcccatggtgtcagtagctatgacactgtcatcagccgggacattcaggcgcctgacggcctggccgtggattggatacattccaacatctactggactgattctgtgcttggcaccgtttcagtggccgacacaaaaggtgtcaagaggaaaaccctttttagagagaacggttcaaagcccagagccatcgtggttgaccccgtgcatggcttcatgtactggaccgattgggggactccagcaaaaataaagaaaggtggccttaacggagtggacatctactctctcgtgactgaaaatatacagtggcctaatggcattaccctggacctgcttagcggtcggctgtattgggtggactctaagctgcattcaatttctagtatagacgtaaatggggggaacagaaagaccattctggaggatgagaaacgccttgctcacccgtttagcctggcggtatttgaagacaaggttttctggacagacatcattaacgaggcgatcttctccgccaacaggctcacagggtctgatgttaacctgttggctgaaaacctgcttagccccgaggacatggtgctttttcacaatctgacacagccccgcggcgtgaactggtgcgaacggacaacactgtccaacggaggatgtcaatatttgtgcctcccagccccccagattaatcctcacagtccgaaattcacatgcgcttgccccgatggaatgctcctggctcgcgatatgcgaagctgcctgacagaggcagaggctgccgtcgccacccaagaaaccagtactgtgcgattaaaagtctccagcaccgcagttagaacccaacataccaccacgcgtccggtgcccgacaccagcaggctccctggcgcaaccccaggcttgactacagtcgagattgtgacaatgagccaccaagctttgggggacgttgccgggcgaggaaatgagaagaaaccctcttcggtccgcgccctgagcatcgtgttacctattgttttactcgtttttctatgccttggagtgttcctgctctggaagaactggagactgaagaatatcaacagcattaattttgacaatccagtgtatcagaagacaaccgaggacgaagtccatatttgccacaatcaggacggttactcatacccatcacggcagatggtttccttggaggatgatgtggcc

SEQ ID NO: 272 - DNA, 2580 bp, Artificial Sequence
  Description of Artificial Sequence: Synthetic Transcript Sequence
atggggccgtgggggtggaagctgcgctggaccgtggcattgttgctcgcagccgccgggacggccgttggtgacagatgtgaaaggaatgagtttcagtgtcaagatggcaaatgtatttcatataaatgggtgtgtgacggatctgctgaatgccaagacggttcagacgagtctcaggaaacgtgcctgagcgtgacgtgtaagtctggggattttagttgtggaggccgggtgaatagatgcattccccagttttggcgctgcgacggacaggttgactgcgacaatgggagtgacgagcagggctgcccgcctaagacctgctcccaggacgagttccgctgccatgatggtaagtgtatttcacggcagttcgtgtgtgactccgatcgggactgcctggatggctccgacgaagccagctgccccgtgctgacatgcggtcccgcctccttccagtgtaactcatctacctgcatcccccaactgtgggcctgtgataatgaccccgattgtgaggatggatccgacgagtggcctcagcggtgtagggggttatatgtgttccaaggcgactccagcccctgtagcgcatttgagtttcattgcctgtctggagagtgcattcattcctcttggaggtgcgacggggggccagactgcaaggataagtcagatgaggagaattgtgccgttgctacttgtcgcccagacgagtttcaatgctctgatggtaactgcatccacgggtctaggcaatgcgatcgggaatacgactgcaaggatatgtctgacgaagttggttgcgtaaatgtgacattgtgcgaggggcctaacaagtttaaatgtcattcaggggagtgtattacgttggacaaagtgtgtaacatggctcgcgactgccgagactggtctgacgaaccaattaaagagtgcggcaccaacgagtgcctcgataacaatggtggctgttcgcatgtctgcaacgagctgaaaatcgggtacgagtgcctgtgccccgatggatttcagttggtggctcaacggcggtgtgaagacattgacgagtgtcaggacccagatacatgttcccagctttgcgttaacttggagggagggtacaaatgccaatgcgaagaggggttccaactcgacccccacaccaaagcgtgcaaggccgtgggttctatcgcatacctcttcttcacaaatcgtcacgaggtccgtaaaatgacccttgatcggagcgaatataccagcctcattccaaacctgcgcaacgtcgtggctctggatactgaagtcgccagcaatcgaatttattggtccgacctctctcaacggatgatctgttccacacagctggatagggctcatggggtgagctcctatgataccgtgatcagcagggacatccaagcccccgacgggctggcagtcgactggatccactccaatatctattggactgattccgtgctgggcaccgttagcgtggccgacacaaagggagtgaagcggaagaccctgtttcgcgaaaacggttctaaacccagagcgattgtggtggatcctgtgcatgggtttatgtactggaccgattggggcaccccagctaagatcaagaagggaggcttgaacggggtcgacatttattctctggtgacagagaacatccagtggccaaatggcatcaccctggacttattatctggcagactatactgggtggattccaagttgcactccatttcatcaatcgacgtcaatggtggcaatagaaagacgatcctggaggatgagaaacgcctagctcacccattcagtctggcagtctttgaggataaagtgttttggaccgatatcatcaacgaggcaattttctcagccaatcgcctcaccggaagcgatgtcaacctactggccgagaacctgttatccccagaagatatggtcctgttccacaatctcactcagcctcggggcgttaattggtgcgaaagaaccactctatcaaatgggggctgccagtatttgtgcctacccgccccgcaaatcaatccccacagtcctaaatttacctgcgcatgtccggatgggatgctcctggcccgggatatgcgtagttgccttacggaagctgaggccgcggttgcgactcaggagacctctacagtgaggctgaaggtctcgtccactgcggtcaggacgcagcacactaccacccggccagtccccgataccagccggcttcctggggcaacccctgggctgaccacagtggagatagtcactatgagccatcaggccctcggcgatgtggccggcagagggaatgagaagaagccttcttcagtgagggcgctgtccatcgtactccctatcgttctactggtattcttatgtttgggcgtgttcctcctgtggaagaactggaggctcaagaatattaattccataaattttgataatccggtttaccagaagacaaccgaggacgaggtacacatatgtcacaatcaggacggctatagctacccctctagacagatggtctccctggaggacgacgtagcg

SEQ ID NO: 273 - DNA, 2580 bp, Artificial Sequence
  Description of Artificial Sequence: Synthetic Transcript Sequence
atgggtccctgggggtggaagttgcgatggactgtggcccttttgttagctgccgccggcacagctgtaggcgaccgttgcgaacgcaatgagtttcagtgccaggacgggaaatgcatcagttacaagtgggtgtgcgacggttcggccgaatgtcaggacggctccgacgaatctcaggaaacctgcctatctgttacctgcaaatcaggcgatttctcttgtgggggtcgagtgaacagatgcataccgcagttctggaggtgcgacggacaggtagattgcgacaatggatcagatgagcagggctgcccaccaaaaacctgtagccaggatgagttcagatgtcacgatggtaaatgcatatcccggcagtttgtatgtgactctgatcgcgattgcctggatggctctgacgaagcaagctgccctgtgctcacctgcggtcctgccagtttccaatgtaactccagcacctgcatcccccagctgtgggcgtgcgacaacgaccctgactgtgaggatggttctgacgagtggccacagcggtgcagaggcctgtacgtattccaaggcgactcaagtccttgtagtgctttcgagttccactgcctgtccggggagtgcatccacagttcttggcgctgcgacggcgggcctgattgtaaggacaagtcagatgaggagaattgtgccgttgcaacttgtcggcctgacgaattccagtgctctgatggaaattgcattcacgggtccaggcagtgcgaccgagaatacgattgcaaagatatgtccgatgaagtagggtgtgtgaatgtaacattatgtgagggtcccaataaatttaagtgccacagtggcgagtgcattacattggacaaggtgtgcaacatggctcgcgactgtagggactggtccgacgagcccatcaaggagtgtggtaccaacgaatgcctggacaataacgggggatgttctcatgtctgtaacgagttaaagattggctacgaatgcttatgcccggatggctttcagctcgtcgctcagaggaggtgcgaagacatcgacgagtgccaggatccggatacctgctcccaactatgtgtgaatctggagggtgggtacaaatgccagtgtgaagaggggttccagctcgaccctcatactaaggcctgtaaggccgtgggcagcatagcttatcttttcttcacgaacaggcacgaggttagaaagatgacactcgataggtctgagtacacttcactgattccaaacctgcggaacgtggtggccctggatacggaggtcgcgagtaatcgcatttattggtcggacctctcgcagcgaatgatatgtagcactcagctggaccgcgctcatggtgtaagtagctatgatactgtcatctctcgggatatacaggctccggacgggctggcggttgactggatccattcaaacatttactggactgatagcgtgctgggaaccgtaagcgttgccgacacaaaaggcgtgaagcgaaaaaccttgtttagggaaaacgggagcaagccaagggccattgtcgtcgaccccgtgcacggatttatgtactggacagattggggaaccccagcgaagattaagaagggcggattgaacggcgttgatatttacagtttagtgacagagaatatccagtggccgaacggcatcacacttgacctactgagcggccgattgtattgggtcgactctaaactgcatagtatcagcagtatagacgtgaacggagggaataggaagactatccttgaggatgagaagcgactagctcaccctttcagcttggcggtgttcgaagacaaggtgttttggaccgatattataaatgaagcaatttttagtgcaaaccgactaacagggagtgacgtcaacctgctagcagaaaacctgttgtctccagaggatatggtgctttttcacaacctgacccaacctagaggcgtcaactggtgcgagcgtactacactgagtaacggtggctgtcagtatctgtgtcttcccgccccacagattaaccctcattctcccaagtttacttgtgcatgtccagatggtatgctgctagcgcgggacatgcggtcttgcttaacagaggccgaagctgcagtggcaacacaagagaccagtacagtacgcttgaaggtctcttccacggccgtacgaacgcaacacaccaccacccgtccggtcccagacactagccgtctgccaggagcaacaccagggctgaccacagtggaaatcgtgacaatgtctcaccaggccctgggggacgtcgctggccgggggaatgagaaaaaaccgagcagcgtgcgagccttgtctatagttctgcctattgtgttgctggttttcctttgcctgggcgtgtttcttctgtggaagaattggaggcttaagaatattaacagcataaatttcgacaaccccgtgtaccaaaagacgaccgaggacgaagtgcacatttgccacaatcaggatggctacagctatccttcccggcagatggtgtccctcgaggacgacgtggct

SEQ ID NO: 274 - DNA, 2580 bp, Artificial Sequence
  Description of Artificial Sequence: Synthetic Transcript Sequence
atggggccctgggggtggaagctcagatggaccgtggccctcctgcttgccgccgccggcactgcagttggtgatagatgcgaaaggaatgagttccagtgccaggacggcaagtgcattagctataagtgggtttgcgacggttctgcggagtgtcaggatggctcagatgagtctcaggagacttgtctctccgtgacgtgcaagagtggagacttcagctgtggtggcagagttaaccgctgcattcctcaattttggcggtgtgacggccaggtggattgtgacaacggttccgatgagcagggatgcccaccgaagacttgctcccaggacgagtttcgctgccacgacggtaaatgcatttctcggcagttcgtgtgcgactctgatcgtgactgccttgacggttccgatgaggccagctgcccagtgctcacgtgcgggcccgcttcgttccagtgtaactcctccacatgcatccctcagctctgggcgtgtgacaacgatcccgactgcgaggacggatcagacgagtggccacagcgttgccggggcctgtacgtctttcagggtgactcgtccccttgctcagccttcgagttccactgcttatcgggcgagtgcattcactcgtcgtggagatgcgacggcggacctgattgcaaggacaagtctgacgaggagaactgtgccgtggccacctgtcggcccgacgagtttcagtgtagtgatggtaactgtattcatgggagccgacagtgcgatagggaatacgactgtaaggacatgtccgacgaggtgggctgcgtgaacgtcaccctgtgtgagggccctaacaagttcaagtgtcacagtggtgagtgcatcactcttgataaggtttgcaacatggctcgggattgtcgtgattggagcgacgaacccatcaaggagtgcgggaccaacgaatgcctggacaataacggcggctgttctcatgtttgcaatgagctgaagatcggttacgaatgcctttgccccgacgggtttcagctcgtagcccagcgtcggtgcgaggacattgatgagtgtcaggacccagacacctgtagtcagctttgcgttaatcttgagggcggttacaaatgtcagtgcgaggaaggtttccagctggacccccacaccaaggcctgcaaggccgtaggtagcatcgcttacctgttctttaccaaccgccacgaggtccgcaagatgactcttgaccgtagtgaatacacgagcctgattccgaacctgagaaacgtcgtcgccttagacaccgaggtggcaagcaaccgcatctattggagcgatttgtcgcagcgcatgatttgctccacccagctcgatcgcgctcacggcgttagcagctatgatactgttatctcgcgtgacatccaggcaccggatggcctcgccgtcgactggatccacagcaacatctattggaccgattcggtcctgggtacggtctccgtcgccgataccaagggtgttaagcggaagaccctgttcagagagaacggctctaagccccgtgcgattgttgtcgacccagtccatggtttcatgtactggaccgactggggcacacccgccaagataaagaaaggcggtctaaatggtgtcgacatctactcccttgtcaccgagaatatccagtggccaaatggtataacattagacctgctcagcggtagactttactgggtggattccaagctccatagcatctcctcgatcgacgtaaacggtggcaaccgtaaaactatcttggaggatgagaagagacttgctcatccattctctctggctgtcttcgaagacaaagtgttttggacggatatcatcaacgaggcgattttctccgccaaccgcctgaccggctccgacgtcaacttgctggcagagaatctcctctcccccgaggacatggtgctctttcacaacctgacccagcctcgcggcgtcaactggtgtgagcgcaccacgttgtccaacggcggctgccagtatctttgtctgcccgctccccagatcaacccacactcacccaagttcacttgcgcttgccccgatggcatgttgctcgcccgcgatatgaggtcttgcctcacagaggccgaggcggccgttgctactcaggagacgtcgaccgtacgactgaaggttagctccacggccgtcagaacccagcacaccacgacccgcccagttcctgatacctcccgtctgccgggcgccacccccggactgaccaccgtcgaaatcgtcaccatgtcacatcaggctctcggcgatgtcgccggccgcggtaacgaaaagaaacccagcagtgtccgagctctgtccatcgtgctacccattgtcctgctcgtgttcctgtgtcttggggtctttctgttgtggaagaactggaggctgaagaacataaattcgatcaacttcgacaacccggtgtaccagaagacgactgaagatgaggtccacatctgccacaaccaggacggctactcctacccctctaggcagatggtgtccctcgaggacgacgtcgct

SEQ ID NO: 275 - DNA, 2580 bp, Artificial Sequence
  Description of Artificial Sequence: Synthetic Transcript Sequence
atgggcccttggggttggaagctccggtggacggtggccctgcttctcgccgcggcggggactgcggtgggcgaccgttgcgagcgaaacgagttccagtgccaggacgggaaatgtatctcctataagtgggtgtgcgacggctccgcggaatgccaggatggctcagatgaatcccaagaaacctgcctgtcggtgacgtgtaagtcgggagacttctcctgtggtggaagagtgaatagatgcattccgcagttctggcgctgtgatggtcaagtggactgtgacaacggctccgacgaacagggctgcccaccaaaaacctgctcccaagatgagttccgctgccatgacggaaagtgcatctcacggcaattcgtctgcgacagcgatagagattgcctggatgggtccgacgaagcctcctgcccggtgctcacctgcggtccggccagcttccaatgcaactcctcgacttgcatccctcagctttgggcatgcgacaatgacccggattgcgaggacgggtctgatgagtggccccagcggtgcagaggactgtacgtgttccagggcgacagttcgccatgttccgctttcgagtttcattgcctgtcaggagagtgcatccactctagctggcggtgcgacggggggcctgattgtaaggacaaatcggatgaggaaaactgcgcggtggcgacttgcaggccggacgagtttcagtgctccgacggcaattgcatccatggatcgcgccagtgcgaccgcgagtacgactgcaaggatatgagcgacgaagtcggatgtgtcaatgtgactctgtgtgaaggaccaaacaagtttaagtgccactccggagaatgcatcaccctcgacaaggtctgcaacatggctcgcgattgccgagattggtcggacgagccgatcaaggaatgtggtaccaacgagtgtctggacaataacggcgggtgctcacacgtttgcaacgaactgaagatcggatatgagtgtctttgtcctgatggctttcagttggtggctcaacgccggtgcgaggacatcgacgaatgtcaagatccagacacctgttcacaattgtgcgtcaatctcgagggagggtacaagtgccagtgcgaagaaggattccagttggatccgcatacgaaggcctgtaaagccgtgggatccatagcttatctgttcttcaccaaccgacacgaggtcagaaagatgaccctggacagatcggaatacacctcgctcatcccgaacctgcgcaatgtggtggcgcttgacactgaagtggcatccaaccggatctattggtcagacctctctcagaggatgatctgctccactcagctggaccgcgcgcatggagtctcatcatacgataccgtgatctcgcgcgatatccaggcaccggacggcctcgccgtcgattggatccacagcaacatttactggactgattccgtgcttggcaccgtgtccgtggcggacactaaaggagtgaagcgcaagacgttgttccgggagaacgggtcaaagccgcgagcaattgttgtcgatccggtgcacggatttatgtactggaccgactggggcactccagcaaaaatcaagaagggcggactgaacggtgtggacatctactccctggtgaccgaaaacattcaatggccgaacggcattaccctcgacctcctttccggtcggctgtactgggttgattccaaactccattcaatttctagcatcgacgtgaacggaggaaatagaaagacgatcctggaggacgaaaagagactcgcgcacccgttctcactggccgtgtttgaggacaaagtgttctggactgacatcatcaatgaggccatcttctccgcaaaccgcctgaccggcagcgacgtgaacctgctggccgaaaacttgctgagcccagaggatatggtgctgttccataatcttacccagccaaggggggtgaactggtgcgaaagaaccacgctctcgaatggcggatgtcagtacctgtgcctgccagcaccgcagataaacccgcattccccgaagtttacctgcgcgtgcccggatgggatgctgctcgcgcgggacatgaggagctgtctgactgaggcggaagccgccgtggcaacccaggaaacctctactgtgcgcctgaaggtgtcgtccaccgcggtgcgcacccaacataccaccactcgccctgtcccagatacttcacgcctgcccggcgccaccccgggcttgaccactgtggagattgtgactatgtcgcaccaagccctgggtgatgtggctgggcgcggaaacgaaaagaagccaagctcggtgagggccctctcgattgtgctgccaatcgtcctgctcgtgttcctgtgcctgggtgtgttcctcctttggaagaactggcggttgaagaacatcaacagcatcaatttcgacaatccagtgtaccaaaaaaccactgaggacgaagtgcatatctgccacaaccaagatggctacagctacccaagccggcagatggtgtcgcttgaggacgacgtggcc

SEQ ID NO: 276 - DNA, 2580 bp, Artificial Sequence
  Description of Artificial Sequence: Synthetic Transcript Sequence
atgggtccgtggggttggaagctgcggtggactgtggcattgctcctggctgcggcgggaactgcagtgggggatcgctgcgagcggaacgagttccagtgccaggacggaaagtgcatctcctataagtgggtgtgcgatggctcagccgagtgtcaagacggtagcgacgaatcgcaagagacttgcttgtcggtgacgtgcaaatcaggggatttctcgtgcggaggacgggttaaccgctgcatccctcagttttggaggtgtgatggacaggtggattgcgacaatggaagcgacgagcagggttgtccgccgaaaacctgttcccaggacgagttcagatgtcatgatgggaagtgcatctcgcggcaatttgtgtgtgatagcgaccgcgactgcctcgatggatcagacgaggcgtcgtgcccggtcctcacgtgtggcccggcctcctttcaatgtaacagctcgacctgtattccccaactctgggcgtgcgacaatgacccggattgcgaggacggctctgacgagtggccgcaacgctgcaggggactgtatgtgtttcaaggggatagctccccgtgctcggcattcgaatttcactgcctcagcggggaatgcatacactcatcctggcgctgcgacggaggccctgactgcaaagacaagtccgacgaagaaaattgcgcagtggccacgtgccgcccggatgaatttcagtgctcggacgggaactgcatccacggatcacgccagtgtgaccgcgaatacgattgcaaggatatgtcggacgaagtgggatgcgtgaacgtgactctctgtgagggaccaaacaagtttaagtgccattcaggcgagtgtatcactctggacaaggtgtgcaacatggccagagattgccgggattggtcggatgaacccatcaaggagtgtgggactaacgagtgcctggataacaatggagggtgctctcacgtgtgcaacgaactgaaaatcggatacgaatgcctgtgcccggatggtttccagctggtggctcaacggcgttgcgaggatattgacgaatgtcaggacccggacacctgtagccagctgtgcgtgaacctggaaggcggatacaagtgccaatgtgaggaaggcttccaattggaccctcataccaaggcctgtaaagcagtcggttcaatcgcttacctcttcttcactaatagacacgaagtgcgcaagatgaccctggataggtcggaatacacttcgctcatccctaatctgcggaatgtggtcgcactggataccgaagtggcttcaaaccgcatctactggtcagacctctcgcagcgcatgatctgctctactcaactcgacagggctcacggtgtgtcatcctacgacaccgtgatctcccgcgatatccaggcaccagatggactggctgttgattggatccacagcaacatctattggactgacagcgtgctcggaactgtgtcggtcgcagacaccaaaggggttaagcgcaaaaccctgtttcgcgaaaatggctcaaagccacgggccatcgtggtcgatccggtgcacggattcatgtactggactgattggggaacccccgctaaaatcaagaaggggggacttaacggagtggacatctattccctcgtgaccgaaaacatacaatggcccaatggaattaccctggacctcctctctggacgcctctactgggtggattccaaactgcactcgatctcatcaatcgatgtcaatggaggaaacagaaagaccatcctggaggacgaaaaaaggctggcacacccgttctcgctggccgtctttgaggacaaagtattttggaccgacatcattaacgaggccatcttctcggcgaatcggctgactggctccgacgtgaacctcctggcagaaaatctgctttcgcccgaggacatggtcctctttcataacctgactcagccgaggggcgtgaactggtgcgaacggaccactctttcaaatggcggttgccagtacctgtgccttccggctcctcagataaatccgcacagcccaaagttcacttgtgcctgccctgacggcatgctcttggctcgcgatatgcgctcatgtctgacggaggcagaagccgcggtggccacgcaggaaacctctactgtccggctcaaggtgtcgtcaaccgctgtccggactcagcacactactacccgcccggtgccggataccagccggctcccaggagcgacccctggacttaccaccgtggaaatcgtgactatgtcccaccaggcccttggagacgtggcgggcagagggaacgagaaaaaaccgtcgtccgtccgcgcgttgagcattgtgctcccaatcgtgctgctcgtgtttttgtgcctcggagtgttcctgctgtggaagaattggcggcttaagaacatcaactccatcaacttcgacaaccccgtctaccagaaaactacggaggacgaggtgcatatttgccacaaccaggatggctactcctacccttcgcggcagatggtcagcctggaagatgatgtcgcg

SEQ ID NO: 277 - DNA, 2580 bp, Artificial Sequence
  Description of Artificial Sequence: Synthetic Transcript Sequence
atgggtccctggggttggaaattgcgctggaccgtggccttactccttgccgctgcagggacagccgtgggagatcggtgtgaaaggaacgaatttcaatgtcaggatggcaaatgtatcagttacaaatgggtttgtgatggatccgcagagtgccaggatggaagcgatgagagccaagagacatgcctgtctgtcacatgtaagagcggcgattttagctgtgggggccgtgtaaacaggtgcatcccacaattctggagatgcgatggacaagtggattgcgataatggcagcgatgaacaggggtgtcccccaaagacgtgttcacaggatgagtttcgatgccacgatggcaaatgtattagcagacagttcgtttgtgacagcgaccgcgactgcctcgacggaagcgacgaggcctcctgtcctgtgctcacctgcggccccgctagcttccagtgtaatagctccacctgcatcccacagctgtgggcttgtgacaacgatcctgactgcgaagacggtagcgatgaatggccccaaagatgtagaggactatatgtgtttcagggagatagtagcccatgttccgcgttcgaatttcattgcctgtccggcgagtgcattcactctagctggagatgcgacggcggccctgactgcaaggataagtctgacgaagaaaactgtgctgtggccacctgccggccagatgagttccagtgtagcgatggcaactgcatccacggttctcgtcaatgcgatagagagtacgactgcaaagatatgtctgacgaagtcgggtgcgttaacgtgaccctttgtgaaggaccaaataagtttaagtgtcactcaggcgagtgtatcactctggataaggtgtgcaacatggccagggactgcagggattggagcgacgaaccaattaaagaatgcggcaccaacgaatgcctggacaacaacggaggttgttcccacgtgtgcaacgagcttaaaatcggctatgaatgcctgtgcccagatggattccagctagttgctcagaggagatgtgaggacattgatgagtgccaggaccctgacacatgttcacaactttgtgtcaacctggaaggcggctacaaatgtcaatgtgaggaagggttccagctcgacccccacactaaggcttgtaaggcggttggctctatagcatacttgttcttcacaaatagacacgaagtacggaaaatgaccctcgaccgctcagagtatacctctctcatccctaatctgcgcaacgtcgtggcattggacactgaagttgcctccaatcgcatctattggagcgacctatcgcagagaatgatttgttcaacacagctggatcgcgctcacggagtgtccagctacgacacggtcatctctagggacatacaggcacccgatggactcgcggtcgattggatacactcaaacatctactggacggattctgtcctcggaacagtgagcgtggcagataccaaaggggtgaagaggaagacattattcagggagaacggatctaagccgagagctatcgtagtggatccagtccatgggttcatgtactggacagactgggggacccccgccaaaatcaaaaagggcgggctcaacggcgtggacatctatagcttggttactgagaatatccagtggcccaatggaataactcttgatctcctgagcggacggctctattgggtagacagcaaattgcattcaataagctccatagatgtcaacggaggaaaccgcaaaaccatactggaggacgaaaagcgcctggcacatccattttcgctggccgtgtttgaggacaaggtgttctggacagatatcatcaacgaagccatattcagtgcgaacaggttgacaggatccgatgttaacctgctggctgaaaacctgttgagcccagaggatatggtgctgtttcataacctgacccagcccaggggagtgaactggtgcgaacggactaccctgtcaaatgggggttgtcaatacctgtgcctgcctgctccccagataaaccctcacagcccaaagtttacctgcgcctgcccggacggaatgctcctcgctagggacatgaggtcctgcttaacagaagcggaggccgcagtggctacccaggagacatccactgtccgattgaaggtgagctccacagctgtccgcacccaacataccactacccgcccagtacccgatacctccaggcttccaggagccaccccaggactgacaaccgtcgagattgttaccatgagccatcaggcactgggcgacgtagctggacgaggaaacgaaaaaaagcctagcagcgtcagagcattatcaattgtgctgcccatcgttttactggtgttcctctgtctcggagtctttctactgtggaagaactggcggctcaagaatatcaactctattaacttcgataacccagtgtaccagaaaactaccgaggatgaagtgcatatttgccataaccaggacgggtactcctatccttcccgacaaatggtctcactggaggatgacgtggca

SEQ ID NO: 278 - DNA, 2580 bp, Artificial Sequence
  Description of Artificial Sequence: Synthetic Transcript Sequence
atggggccatgggggtggaagctgcgttggacagtggccttgctcctcgctgcggcgggcaccgctgtcggtgataggtgcgaacgaaatgagttccaatgtcaggatggaaagtgtatttcttacaagtgggtgtgcgacgggtctgctgagtgccaggacggttccgacgaaagtcaggaaacttgtttgagtgtgacttgtaagagtggggacttcagctgcgggggacgagtaaataggtgcatcccacaattctggagatgcgacggacaagtggactgcgataacggatccgacgaacagggatgtcccccaaagacatgctctcaggatgagtttcgttgtcatgacggaaagtgcatcagccggcaatttgtttgcgactccgatcgcgactgcctagatgggagcgatgaggccagctgcccagtgctgacatgcggtcctgcctcttttcagtgtaattcttcaacatgcattccacaactgtgggcgtgtgacaatgaccccgactgcgaagacgggtcagatgagtggccccagcgctgccgcggactctacgtgtttcaaggtgattctagcccatgcagcgcgtttgaattccactgcctcagcggggaatgcatccatagttcctggcggtgtgacggcgggccagattgcaaagataagagcgacgaggaaaactgcgcggtggcaacgtgccgcccagatgagttccagtgcagcgatggtaactgcattcacggctccaggcagtgcgatcgcgagtatgattgcaaagacatgtcagacgaggtcggctgtgttaacgtgactctgtgcgaaggacccaataaattcaaatgccacagcggagagtgtataactctcgacaaggtatgcaatatggcgagggactgtagggactggagcgatgagcctataaaggaatgtggcaccaatgaatgtctcgataataatgggggctgctcacacgtatgcaacgaattgaaaatcggatatgaatgcctctgtccggatggattccaactcgtcgcccaaagacgctgcgaggatattgacgagtgccaagacccagacacgtgctcacagctctgcgtcaatttagagggcggctataagtgccagtgcgaggaggggttccaactcgatccccacaccaaagcctgcaaagctgtgggaagcattgcatacttgttctttacgaatcgacacgaggtcagaaagatgactttagacagatcagagtacacctccctgattcctaacctgaggaatgttgtggcgctcgacactgaggtcgcatccaaccgaatctattggagcgatctgtcccaacgtatgatttgttctactcagctcgatcgagcccacggggtcagcagttacgacacagtgatatcccgggacatccaagctcccgatggactggccgtggattggatccattcgaacatctactggactgatagtgtccttggaacagtgtcagtggcggacaccaagggcgtgaagaggaaaacactatttcgagaaaacggtagtaaacctcgagccatagtggtcgacccggtccacggatttatgtattggaccgactggggcactccggccaagataaaaaaaggcggcctgaatggggtggatatctactcgcttgtgactgagaacatccagtggcccaatgggataaccctagacttacttagtggcaggctatactgggtggatagtaagctgcactcgatttcaagcatcgacgtcaacgggggaaaccgaaagacaatcctggaggacgaaaaacggcttgcgcaccccttttctttagcagtgttcgaggataaggtcttctggaccgatatcatcaacgaagcgatcttcagcgcaaaccgattgacaggttcggatgtaaacttgcttgcagagaatctgctaagtccagaagatatggtgctgtttcacaacttgacccagcctcggggcgtgaactggtgtgagaggaccaccctgtctaatggtggatgtcagtacctgtgcttgccggcccctcagattaatccacattccccaaagtttacctgcgcctgcccggacggaatgctcctggcgagagacatgcggagctgcttaacagaagctgaagcggccgtagcaacgcaggagactagtacggtccggctaaaagtgtcctctacagctgtgcgcacccagcacactactacccgcccagtgcccgatacatccaggctgccaggcgcaacaccaggattaactacggtggagatcgtgacaatgtctcaccaggcgctgggtgacgtggccggaaggggtaatgaaaaaaaacctagctctgtcagagccctgagtatagtacttccaatagttctgctggtctttttatgcctgggtgtgttcctgctgtggaaaaattggcgccttaaaaacattaatagcatcaacttcgacaaccctgtttatcagaaaactaccgaagatgaagttcatatctgccacaaccaggacgggtatagctaccccagccgccagatggtgagcctggaggacgacgtggcc

SEQ ID NO: 279 - DNA, 2580 bp, Artificial Sequence
  Description of Artificial Sequence: Synthetic Transcript Sequence
atgggaccctggggctggaaactcagatggaccgttgccctactgctggccgccgctgggactgctgttggagatagatgcgaacggaatgagtttcaatgccaggacggtaaatgcatctcatacaaatgggtgtgtgacggatccgccgagtgccaggatgggagcgatgaatcccaagaaacctgcctgtccgtgacctgtaaaagcggggatttctcatgcggaggaagggttaatcggtgcatcccacagttctggcgctgcgacggtcaggtggattgcgacaacggtagtgatgaacagggatgccctcctaagacatgctcacaggatgagtttaggtgccatgatggtaaatgtatttctcggcagttcgtttgtgactcagaccgggactgtctcgatggatcagatgaagcctcctgtcctgtgctgacctgcggcccggcatcgtttcagtgtaatagtagtacctgcattccccagttgtgggcctgcgacaacgatcccgactgcgaggatggcagtgatgagtggcctcagcgctgccgtggactttatgtgttccagggagacagttctccatgctcagcctttgagtttcattgtctatctggcgaatgtattcactcctcatggagatgtgatggcggcccggattgcaaggataagtccgacgaagaaaactgcgctgtagccacatgtagacccgatgagtttcaatgctcggacggcaattgcattcatggatcccgtcagtgcgatagagagtatgactgtaaggacatgtcggatgaagtcgggtgtgttaatgttacgttgtgcgagggcccaaacaaattcaaatgtcatagtggcgaatgcattacactcgacaaggtgtgcaatatggctagggactgtagagactggtccgacgagccaatcaaggagtgcggaaccaacgagtgtctcgacaataatggcggatgttcacatgtttgtaacgaactcaagattggctacgagtgcctttgccctgacggttttcagctcgttgcgcagagacgctgcgaagatatcgacgaatgtcaggacccggatacctgtagccaactgtgcgtcaacttagaaggaggctacaagtgccagtgtgaagagggtttccagttggatccgcacactaaagcctgcaaggcagtcggttccatcgcatacttgttctttacaaaccgtcacgaagtacgcaaaatgactcttgaccgctccgagtacacctcactgatccctaatctacgcaacgttgttgctttggacaccgaagtggcctctaaccgcatctactggtcagatctatcccaacgtatgatctgtagcacacagctcgacagggctcacggagtgagctcctacgataccgtgatcagccgagatatacaggcccccgacggtctggctgtggactggatccactccaacatttactggactgactctgtgctcgggaccgtgtccgtcgctgacactaaaggagtcaagcggaagacactgtttcgggagaacggaagcaagcctcgagcgatcgtggtcgatcccgttcatggctttatgtattggaccgactgggggactcctgcaaaaattaaaaagggaggacttaatggcgttgatatatactctcttgtcactgagaacatccaatggcctaatggtataacgctggacctattgagtggtaggctctattgggtcgattctaagctgcactctataagtagcatcgacgtgaatgggggtaatcggaagaccatcctagaagacgagaagagattggctcacccgtttagtctggccgtgttcgaggataaagtgttctggactgacattattaacgaagccattttctcggccaatcggctgactggttctgatgtgaacctgctcgcagagaacctcttgtccccagaagacatggtactgtttcacaacttaacccagccgagaggggtgaactggtgtgaacgaaccacattgtctaatggcggctgtcagtacttgtgcctgccagcgccccagatcaacccacacagtccaaaattcacttgcgcgtgcccagacgggatgcttctcgcccgggatatgaggagctgcctcaccgaagctgaggctgccgtggcaacacaagagactagcactgtacgcctgaaagtctcgtcaacagccgttcgaacacagcacacgactaccaggccagtgcctgacacatcacggcttccaggggctacaccgggacttaccaccgtggagattgtcaccatgagccaccaggccttgggagacgtggccgggcgcggaaacgagaaaaagccatcttccgtgcgggctttatctatagtgttgccaatcgtcttgttggtctttctctgccttggcgtcttcctgctttggaaaaattggaggctgaagaatattaacagtatcaactttgacaatccggtataccaaaaaaccactgaagatgaagtgcatatttgtcataaccaggacggctatagttatccaagccggcagatggtgtctctggaggacgatgtcgca

SEQ ID NO: 280 - DNA, 2580 bp, Artificial Sequence
  Description of Artificial Sequence: Synthetic Transcript Sequence
atgggaccctgggggtggaagctgcgctggacagtggcactgcttttggcagccgctggaactgctgtgggagataggtgtgagagaaacgaatttcagtgccaagatggaaagtgcatcagttataagtgggtttgtgacggcagcgcggaatgccaggatggcagtgacgagtcgcaggaaacttgtttgagcgtgacctgcaagagtggcgacttttcttgcgggggtcgggtcaaccgatgtatccctcagttctggaggtgcgatggtcaggtggactgtgacaacggttcagacgaacagggatgcccccccaaaacctgctcccaggatgagttccgctgtcacgacgggaaatgtataagcaggcagttcgtctgtgactccgatcgggattgcctggatgggtcggacgaggcctcatgccccgtgctcacgtgcggtccagcctcttttcaatgtaacagcagcacatgtattccccagttgtgggcttgtgacaatgatccagactgcgaagacggatctgatgagtggccgcagagatgtcgaggattgtacgtttttcagggcgattcttcaccatgcagcgcctttgaattccactgcttgtctggggagtgcatccattcctcttggcgatgcgacgggggccctgattgcaaggataaaagcgatgaggagaattgcgccgtggcaacctgcaggcccgatgaatttcaatgctcagacggcaattgtatccatggcagcagacagtgcgaccgagagtatgattgtaaagacatgtccgacgaggttggctgtgttaacgtgacactgtgcgagggccccaataaattcaagtgtcacagcggggaatgtattactctggataaggtgtgcaatatggctagggactgcagggactggagtgatgaaccaataaaggagtgtggcactaatgagtgcctagataataacggcggttgcagtcatgtgtgcaacgagctcaaaatcggctacgagtgcctgtgcccagacggattccagctggtggctcagcggagatgtgaggatatcgatgagtgccaggatccagacacatgcagccagctgtgcgttaacctggagggcggatacaagtgccagtgcgaggagggttttcagctagatccccacacgaaagcgtgtaaggcggttggttccattgcctacctcttcttcacgaaccgtcatgaggtgagaaaaatgacacttgacagatctgagtacacctccctcattccaaacctgaggaacgttgtcgctctggataccgaagtcgccagcaacagaatttactggtcagacctgtcccagcgcatgatatgctccacccaactggacagggctcatggagtttccagctacgacacagtaatctctagggatatccaggcccccgacgggctcgcagtggactggattcactccaacatctactggacagacagcgtactgggcaccgtttcagtggccgacaccaagggagttaagcggaagactttgttcagggaaaacggaagtaagcctagagcgatcgtcgttgacccagtccatggctttatgtactggaccgattgggggactccggcaaagatcaagaaggggggtctgaatggcgtggacatctacagcctggttacagaaaatatccagtggccaaacggcatcacccttgatctgctgtcaggtcgactctattgggtggattcaaaactacattccatttcaagcatcgatgtcaacggggggaacagaaaaactatcctagaggacgaaaagcgactcgcacatcccttcagcctagcagtcttcgaagacaaagtattctggactgacatcatcaacgaagccattttctcggccaacaggctgaccgggtcagacgtgaatctgttggccgagaatctactgagtccagaagatatggtgttattccacaatctaacccaacccagaggggtgaactggtgtgagcgtacaaccctcagcaacggcggttgtcagtacctgtgcctgcctgccccacagatcaacccccactcccccaagttcacttgcgcgtgcccagacgggatgctcctggctcgcgatatgcgctcttgtcttacagaagccgaagccgctgtagctactcaggaaacctccaccgtccgcctgaaagttagcagcactgccgtgaggacccagcacacgacaactagaccggtgcccgacacaagcagactcccaggggctacccccggtttaaccacggtagagatcgtgacaatgtcacatcaggctcttggggatgtggccgggcgcggcaacgaaaagaagcctagtagcgtgagagctctgtccattgtgctgcctatcgttctgctagtgttcctgtgtttaggcgtgtttttgctctggaagaactggcgtctgaagaacataaactccattaacttcgacaaccccgtctatcagaagaccaccgaggatgaagtccacatctgtcacaaccaggatggctactcctaccctagtaggcaaatggttagcttggaggatgacgtggca

SEQ ID NO: 281 - DNA, 2580 bp, Artificial Sequence
  Description of Artificial Sequence: Synthetic Transcript Sequence
atggggccctgggggtggaaactgaggtggactgtggcactccttctggcagccgctgggactgctgtgggagatcggtgtgaacgcaatgaattccagtgtcaggatgggaagtgcatctcttataaatgggtttgcgatgggtccgccgagtgccaggatgggtctgatgaatcccaggagacatgtctctccgtcacatgcaaaagtggggatttctcgtgcgggggaagggtgaaccggtgcatcccccagttttggcggtgtgacggacaggtcgattgcgataacgggtccgatgagcaggggtgcccacctaagacatgctcgcaggatgaattccggtgccatgatggaaaatgtatatctcgccagtttgtatgtgacagtgatagggattgtctggatgggagtgatgaagcatcttgtcccgtgctaacatgtggaccagcaagttttcagtgcaatagttctacttgtatacctcagctctgggcttgtgataatgatcccgattgcgaagatgggtcagatgaatggcctcagaggtgcagagggttatatgtctttcagggagattcatctccctgctctgccttcgaatttcactgcttatccggggaatgtatccacagttcttggcgctgtgatggagggccggactgtaaagataaaagtgatgaggagaattgcgcggttgctacatgccggcccgatgaatttcagtgttccgatgggaattgcatccacggaagtagacagtgtgatagggagtatgactgtaaagatatgagtgatgaggtgggatgcgttaacgtaacactctgcgagggacctaataaattcaagtgtcattcaggagaatgcatcacactcgacaaggtgtgtaacatggctagagattgtagagattggtcagatgaacccatcaaagaatgtgggactaacgaatgcctcgataataacggggggtgttctcatgtttgtaatgaactcaaaataggatatgaatgcctgtgtcccgatgggtttcagttagtggcccagcgccgatgcgaggatattgatgaatgtcaggatcctgatacttgcagtcagctgtgtgtaaatctcgaggggggatataaatgccagtgcgaagaagggtttcagctggatccccacactaaagcttgcaaagctgtgggatctatagcctacctattttttacaaatcggcatgaagtgaggaagatgacactggatagatctgaatatacatctctcatcccaaacctacgcaatgtggtggccctggatactgaagtggcctcaaaccgaatctattggagtgacttaagtcagcgaatgatatgctcaactcagctggatagagcccatggagtttcaagttatgatacagtgatatctcgagatatacaggcccccgatggactagctgtggattggatacattcaaacatatactggacagattcagtcttgggaactgtgagtgtggctgatactaaaggggttaaacgcaaaacactgtttagagaaaacgggtctaaaccccgggccattgttgtcgatcctgtccatgggttcatgtattggactgattggggaactcctgcaaaaatcaaaaaagggggactcaacggagttgatatctacagtctcgtcacagaaaatatacagtggccaaacgggattacactagatttattgtccggaagactatattgggtcgatagtaaactgcactcaatttcttctatagatgttaatggggggaacaggaaaacaatacttgaagacgaaaaacggctcgcccacccattctccttggctgtgttcgaagataaagtgttctggactgatattataaacgaggccatattttcggcaaacagactcactggatcagacgttaacctcctggctgaaaacctgctctcccccgaggatatggttcttttccataatcttactcagccaaggggggtcaattggtgtgagcggactactctcagtaatggggggtgtcagtatctctgcttacccgcaccccagattaacccacacagtccaaagttcacatgtgcctgcccagatggaatgttattagcccgcgacatgcggagttgcctcacagaagccgaggccgctgtggccactcaggaaactagtacagtgcgccttaaggtgagtagtacagcagtgcggacacagcacacaacaactaggccagttcctgatacatctcgccttccaggagccactcccgggcttacgactgtcgaaattgttacaatgtctcaccaagcacttggagacgtggccggacgaggaaacgagaaaaaacctagttccgtgcgcgctctttccatagtgctaccaatagtattactcgtcttcctatgcctcggagtatttcttctctggaaaaactggaggcttaaaaacataaactcaatcaatttcgataatcccgtttatcagaaaacgacggaagatgaggtccatatctgtcacaaccaggatggatattcttatccttccaggcagatggtgtctttagaggacgatgtggca

SEQ ID NO: 282 - DNA, 2580 bp, Artificial Sequence
  Description of Artificial Sequence: Synthetic Transcript Sequence
atggggccttggggttggaagctcaggtggactgtggctcttcttcttgcagcggcagggacggctgtgggcgaccgctgcgaacggaacgaatttcaatgccaagatggaaagtgtatttcctacaagtgggtgtgtgatgggtctgcagaatgtcaagacggttcagatgaatcacaggaaacctgtctgtcagtgacttgtaagtctggagactttagctgtggtggacgtgtcaacaggtgcattccccagttctggcggtgtgacgggcaagtggattgcgataacgggtcagacgagcaaggatgccctccaaagacgtgttcgcaagacgaatttcgttgccatgacggaaaatgtatcagccgccaattcgtctgtgactccgatcgggattgtctcgatggatcggacgaagcatcatgtccagtgcttacttgtggccccgcttcctttcaatgtaacagctcgacctgtatccctcagctttgggcgtgcgacaacgatccagactgtgaagatggttccgacgagtggccccaacggtgtcgaggcctctacgtgtttcaaggagattccagcccgtgctccgcatttgagttccactgtctctcgggggagtgtattcattcgtcatggaggtgtgatgggggtccagattgtaaggataagtcggacgaagaaaattgtgccgtcgcaacctgtcgccctgatgaatttcagtgttcggatggtaactgcattcacggtagccggcagtgtgacagagagtacgattgcaaggacatgtcggatgaggtgggttgtgtgaacgtgactctgtgtgaaggcccaaacaagtttaagtgtcattcaggggaatgtattaccctggacaaggtgtgtaacatggccagagactgccgagattggtccgatgaaccgattaaagaatgcgggaccaatgagtgcctcgataacaatggaggttgtagccacgtgtgcaacgaactcaagataggatacgaatgcctgtgtcctgatggtttccaactcgtggcgcagcgacgctgcgaagatattgatgaatgccaggaccccgatacctgctcccaactgtgtgtcaacctggaaggaggatacaagtgccaatgcgaggagggtttccagctggatcctcacactaaggcatgtaaggccgtgggttccatcgcatacctgttctttacgaatcgacatgaagtgaggaagatgactcttgataggtcggaatacacctctctgattccaaatcttcgcaacgtggtggcgctggatactgaagttgcatccaatcgcatttactggtcggatctgtcgcaaaggatgatttgttctacgcagctggacagagcgcatggagtgtcatcgtacgatacggtgatcagccgtgatatccaggctcctgatggccttgctgtggattggatccattcgaacatttactggaccgatagcgtgcttggcaccgtcagcgtggcagatactaagggtgtaaagcgcaagaccctgtttagggaaaatggatccaagcctagagcaatcgtcgtcgacccagtccatggttttatgtactggactgattggggaacgccagcaaagatcaagaaagggggacttaatggcgtggacatttactcattggtcactgaaaacatccagtggcccaacggaatcaccctggacttgttgtctggtagactgtactgggtggactcgaaactgcatagcatttcctcaattgatgtgaacggaggaaatcggaaaactatcctggaggacgagaagaggcttgcacaccccttttccctggcagtgtttgaagataaggtgttctggaccgatatcattaacgaggcgatattctcagcaaacagactgactggaagcgacgtgaatcttctggctgagaatctcctgtcccccgaagatatggtgctgtttcataacttgacccagccaaggggcgtcaactggtgcgaaagaaccaccctctcaaacggtggttgtcaatacctgtgtttgccagcaccccagattaaccctcactcaccaaaattcacctgcgcatgtccagatggcatgctccttgcaagagatatgagatcctgtctcaccgaggccgaagccgcagtcgcaacccaagagactagcactgtgcgtctcaaggtgagctcgactgccgttcggactcaacatacgaccactaggccggtacctgatacctccaggctccccggagcaactcctggccttactaccgtggaaattgtgaccatgtcacatcaagcgctcggagatgtcgccggcagaggtaatgaaaagaaaccttcgtcagtgcgtgccttgtcgatagtactgccgatagtgctgttggttttcctgtgtctcggagtctttctgctttggaagaactggaggctcaagaacatcaactccattaacttcgacaaccctgtgtaccaaaagaccactgaggacgaagtgcacatatgccacaatcaggacgggtactcttacccatcgcgccaaatggtgtcgcttgaagatgatgtcgcc

SEQ ID NO: 283 - DNA, 2580 bp, Artificial Sequence
  Description of Artificial Sequence: Synthetic Transcript Sequence
atggggccttggggatggaaactgagatggaccgttgctctgctgttagccgccgctggtaccgcagttggagacaggtgcgaacgcaatgagtttcagtgccaagacgggaaatgcatctcctataagtgggtctgtgacggatctgctgagtgccaggatgggagcgacgagtctcaggaaacatgtctgtctgtaacctgcaagtccggtgacttcagctgcggcggccgggtaaatcggtgtatcccacaattttggcgctgtgacggccaggtggattgtgacaacggatctgatgaacagggatgcccccctaagacctgctcacaggacgaattcagatgtcacgatggtaaatgcatttcaagacaatttgtgtgtgactctgacagagactgcctggatggtagcgatgaggcaagctgccccgtgttgacttgcggaccagcttcttttcaatgcaactcaagtacatgtattccccagctttgggcctgcgacaatgaccctgattgcgaggatggtagtgatgagtggccacagaggtgcaggggtttatatgtgttccagggtgatagttcaccttgctctgccttcgagtttcactgtctgagcggtgagtgtatacattcctcctggcgctgcgacggagggcccgactgcaaggataaatccgacgaggagaactgcgccgtggccacgtgtaggcctgacgaattccaatgctccgacggtaattgtatccacggatctcgtcagtgtgaccgcgaatatgactgcaaagatatgtccgatgaagttggctgcgttaacgtaactctctgcgaggggcctaacaagtttaagtgtcattccggcgagtgtatcacgctggacaaggtgtgtaatatggcgcgtgactgcagagattggtccgacgaacctattaaggaatgcggcacaaatgagtgtctcgacaataacgggggatgcagccatgtctgcaatgagctcaagatcggctacgagtgcctgtgcccggacggctttcagctggtcgcccaacgaagatgcgaggacattgatgagtgccaggacccagacacatgttcacaactgtgtgtaaatctggaggggggatacaaatgtcagtgcgaagaaggatttcaactagacccacataccaaggcctgcaaggcggtaggatccatagcctacctgtttttcactaaccgacacgaggtgagaaagatgactcttgacagaagtgaatacacctctctgatcccaaacctgcgaaatgtcgtggctctggacactgaagtcgcctccaatcgcatctactggtcagatctgtctcagaggatgatatgttccacccagctggacagggctcacggagtgtccagttacgacacagtgatttcccgagatatccaggctcctgacggactggccgtggactggattcactcaaatatctactggacggatagtgtgctgggcactgtgtctgtcgcggacacgaagggggtcaagcgcaagacgcttttccgtgagaatgggtccaaaccccgcgcaatcgtcgtcgacccagttcatggttttatgtattggacagattggggtacccccgcaaagattaaaaaaggcggcctcaacggggtcgatatctatagcctcgtgaccgagaacatccagtggcctaatggcattacactcgacctgcttagcggacgactgtattgggtggactctaaacttcactccatcagcagcatcgatgttaacggaggcaaccgcaagacgatcttagaggatgaaaagaggctcgcccaccctttctccctagccgtgtttgaagacaaggtgttttggactgacatcataaacgaggctatctttagtgcaaacaggttgacggggagcgatgtgaatttgctcgccgagaaccttctcagtcccgaggacatggtcctgttccataacttgacccaaccaaggggagtcaactggtgtgaaagaaccacgttaagcaacggagggtgccagtacctgtgtttgccagccccacaaatcaatcctcattcaccgaagttcacctgcgcctgtcccgatgggatgctcctggcgcgggacatgagaagttgtctgaccgaagccgaggcggccgtcgccacacaagagacttctactgtccgcctgaaggttagttccaccgctgtgcggacacagcacaccacaaccagaccagtgccagacacttcccgcctccctggcgccacacctgggctgactaccgtagaaatcgtaactatgtcccatcaagccctcggagacgtcgctggtcgggggaatgaaaagaagccctcgtctgtgagggcgctgtccattgtcctgccgatagtgctgttggttttcctctgccttggggtgttcctactttggaagaactggcggctcaagaatattaatagcatcaatttcgataatccggtgtaccagaagaccaccgaggacgaggtgcacatttgccacaaccaggacggctactcttacccctccaggcaaatggtgtccctggaggatgacgtcgca

SEQ ID NO: 284 - DNA, 2580 bp, Artificial Sequence
  Description of Artificial Sequence: Synthetic Transcript Sequence
atgggtccgtggggatggaagctcaggtggaccgtcgccctgctcctggctgccgcgggaacggcggtcggagacaggtgcgagcggaacgaattccaatgccaagacggcaagtgcattagctacaagtgggtctgcgacggaagcgccgaatgtcaggatggctccgacgaaagccaggaaacctgcctgtccgtgacttgtaaatccggtgacttctcctgcggcggaagggtgaaccggtgtatcccgcagttttggcggtgtgatgggcaggtcgactgtgataacggatccgatgagcagggttgccctccaaagacttgctcacaggacgagttcaggtgccacgatggaaaatgcatctcccgccagttcgtatgcgatagcgacagagactgtctcgacggctcggatgaggcaagctgcccagtccttacctgcggtccagcgtcgttccaatgcaactcctccacctgcatcccccagctttgggcatgcgacaacgaccccgattgcgaggatggatcggatgaatggccgcagcgctgtcgggggctctacgtctttcagggggactcatcgccgtgctccgccttcgaatttcattgtctgtcgggcgaatgcattcattcgtcctggcgctgcgatggaggaccagactgcaaggacaagtcagacgaggaaaattgcgccgtggcgacgtgccgccctgatgagttccaatgttcggacggtaactgcatccacggctcccggcagtgcgatcgcgaatacgattgcaaagacatgagcgacgaggtcgggtgtgtcaacgtgaccctgtgcgagggaccgaataagttcaaatgccactccggtgagtgcataactctcgataaggtgtgcaatatggcccgcgactgcagggactggagcgacgaaccgatcaaggaatgtgggaccaacgagtgtctcgataacaacggaggctgtagccacgtgtgcaatgacttgaagatcggatacgagtgcgattgtcctgatggatttcagctggtggcacaacgccgctgcgaagatatcgatgaatgccaggacccagatacgtgctcccagttgtgtgtgaacctggaaggcggttataagtgccaatgtgaggagggtttccagctggacccgcacaccaaggcgtgcaaggccgtcggatccatcgcttacctcttcttcaccaacagacacgaggtgcgcaagatgactctggatagatccgaatacacttcgctgatccccaatctccgcaacgttgtggctctggacaccgaagtggcttcaaatagaatctactggtcggatctgagccagagaatgatttgctcgacgcaactcgaccgcgctcatggagtcagcagctacgacaccgtgatctcaagagatattcaggcaccggacgggctcgctgtagactggatccactccaatatctactggaccgattcggtgctgggtactgtgtcagtcgccgataccaagggagtaaagcgcaagactctgttcagggaaaatggaagcaaaccaagagcgatcgtcgttgacccggtgcatggcttcatgtattggaccgattggggcacgcctgccaagatcaaaaagggaggtcttaatggagttgatatctacagcctggtcaccgagaacatccagtggcccaacggcatcacgctggatctgctgtcaggacggctgtactgggtcgactcgaaactgcattcgatttcctccatcgatgtgaacgggggcaacagaaagactatcctggaggacgagaagcgccttgcccatcccttctcgctcgctgtgtttgaagataaagtgttctggaccgatatcatcaacgaagccatcttttccgctaatcggctgacggggtcagacgtgaatttgctggctgagaacctgctgtccccagaagatatggtcctgtttcataacctgactcaaccgagaggagtgaattggtgtgaacgcactacgctctctaacgggggatgccagtacctctgcctccctgcaccgcaaatcaacccacactcgccgaagtttacgtgcgcgtgtcccgatggaatgctcttggcgcgggacatgcggtcctgcctcaccgaggcggaggcagccgtggccactcaagaaaccagcactgtccggcttaaggtgtcaagcactgctgtccgcacccagcatactaccactaggccagtgccggacacgtcccggctgcctggagccactccgggcttgaccacggtggagattgtgaccatgtcccaccaggcgctgggagacgtcgcgggtcgcggtaacgaaaagaagccgagctccgtgcgcgcgctctccatcgtgctgccaatcgtcctcctggtgtttctgtgtctcggcgtgttccttctttggaaaaactggcggctcaagaacatcaatagcattaacttcgacaacccagtgtaccagaaaactaccgaagatgaagtgcacatctgccacaaccaagatggttactcatacccatcaaggcagatggtgtcgctggaagatgacgttgcc

SEQ ID NO: 285 - DNA, 2580 bp, Artificial Sequence
  Description of Artificial Sequence: Synthetic Transcript Sequence
atggggccatgggggtggaagctacgttggacagtagccctgctgctcgccgcagctgggacagccgtgggagacaggtgtgaacggaatgagttccaatgtcaggatggaaaatgtatctcctataaatgggtgtgtgatgggtccgcagaatgccaggatgggtccgatgaatctcaagaaacatgtctgagtgttacttgtaaatctggggacttctcatgcgggggaagggtcaacaggtgtattccacagttctggcggtgtgatgggcaggtggactgcgacaatggaagtgatgagcaggggtgcccacctaagacatgctctcaggatgaatttcgctgtcacgatggaaagtgtatttcaaggcaattcgtctgtgactctgatcgagattgccttgatgggtccgatgaagcctcttgtcctgttctcacatgcggaccggcttctttccagtgcaactcttccacatgtataccccagctgtgggcgtgtgacaacgaccccgattgtgaagacggatcagatgaatggcctcagcgatgtcgggggctgtatgtcttccagggagattcttcaccttgcagtgcattcgaattccattgcctctccggagagtgtatccatagtagttggcggtgtgatgggggacccgattgtaaagacaaatccgatgaagaaaattgtgctgtggcaacatgccgcccagatgaatttcagtgttctgatgggaattgtatccacgggtccagacagtgcgatagggagtacgattgtaaggatatgtccgacgaagtgggatgtgtgaatgttacactgtgtgaagggcctaataaattcaagtgccacagtggagaatgtatcacattagataaagtctgtaacatggcccgggactgccgggattggtctgatgaacctataaaagaatgtgggacaaacgagtgcctcgataacaacggaggatgttctcatgtatgcaatgacctgaaaatagggtacgaatgcgactgtcccgatggattccagctcgttgcccagcgccgttgtgaagatatagatgagtgccaggaccctgatacatgtagtcaactatgtgtgaacttagaagggggatataaatgccagtgtgaagagggattccagctcgatccccacacaaaagcctgcaaagcagtggggtctatcgcatatcttttcttcactaaccgccatgaagtgcgcaaaatgacattagatcggtctgaatatacatctctcatacccaatctccgcaacgtggtggctctcgatactgaagtagcttcaaatcggatttattggtcagatctgagtcagagaatgatctgctctactcagctcgatcgagctcatggggtgtctagttatgatactgtgatttcccgcgatatacaggcccccgacgggctagccgttgattggatccattcaaatatttactggacggattccgttctgggaactgtgtctgtggcagatactaaaggagtcaagcgaaaaactctttttagggaaaacgggagtaaacccagggctatcgtcgtggacccagtccacggatttatgtactggactgattgggggacacctgcgaaaatcaaaaaaggaggactcaatggggtcgacatatattctttggtgacagagaacattcagtggcctaacggaatcacactggatctcctgagtggacggctgtactgggtagattccaaactccactctataagttctatagacgtgaacggagggaatagaaaaacaattctcgaggatgaaaaacgccttgcacaccctttcagtctcgcagtcttcgaggataaagtgttctggactgatattatcaacgaagccattttctctgccaatagacttacaggatcagatgtcaacctattggctgaaaacctcctgagtcctgaagatatggtgctgttccacaatctgacacagcccaggggagtgaactggtgcgagcgcacaacactgtctaacggggggtgccagtatttatgtcttcctgctccacagataaaccctcactctcccaaatttacatgtgcctgcccagacgggatgctactagcaagggatatgagatcttgcttgactgaggcggaggcggctgtagcaactcaggaaacatccacagtaaggttaaaagtctcttctactgccgtgcgaacacagcacacaacaactaggccggtcccagatacatctcgccttcctggagctactcctggattgactactgtcgaaatagtgactatgtcacatcaggcgctaggagatgtagcagggcgtgggaacgaaaaaaaaccatcttccgtcagggcactcagtatagtgctgcccatagtgctactcgtatttctatgtctgggagtattcctcctgtggaaaaactggcggttaaaaaatatcaattccatcaatttcgataaccccgtgtatcagaaaacaacagaagatgaggtacatatctgccataatcaagatgggtactcatacccttctcgccagatggtgtctcttgaggatgatgttgcc

SEQ ID NO: 286 - DNA, 2580 bp, Artificial Sequence
  Description of Artificial Sequence: Synthetic Transcript Sequence
atgggaccctggggctggaagctgcggtggaccgtggcgcttctgttggcggcggcaggaaccgcggtcggtgacaggtgcgaaagaaacgaattccaatgccaggacgggaaatgcatctcgtacaaatgggtctgtgatgggtcagctgaatgccaggatggaagcgacgagtcgcaggagacttgcctctcagtgacgtgcaagtcaggagatttctcgtgcgggggtcgcgttaatcggtgcatcccgcagttctggcggtgtgacggccaggtggactgcgataacggatccgacgaacagggctgtcctcccaagacctgcagccaggacgagttcagatgccatgacggcaagtgtatctcccggcaattcgtgtgtgactcagaccgcgactgcctggacggttctgatgaagcatcctgccctgtgcttacctgtggccccgcgtcatttcaatgcaactcctcgacctgcatcccgcaactctgggcttgcgacaacgatccggactgcgaagatggatcagacgagtggccacagagatgccgggggctttacgtttttcaaggtgatagctcgccgtgctcggcattcgagttccattgtttgtccggcgagtgcattcactcatcctggcgctgcgacggaggtccggactgcaaggacaagagcgacgaggagaattgcgcggtggcgacttgcagaccggacgagttccaatgttctgatggaaattgtatccacgggtccagacagtgcgacagagaatacgattgtaaggatatgtcggatgaagtgggatgcgtcaacgtcaccctctgtgaaggtcccaacaaattcaagtgccactcgggagaatgcatcacccttgacaaagtgtgcaacatggcgcgggactgccgcgattggtccgatgagccgatcaaagaatgcggtactaacgaatgcctcgacaacaatgggggttgcagccacgtgtgtaacgacctcaaaatcgggtacgaatgcgattgtccagacggattccagcttgttgcgcaaaggcgatgcgaggacattgacgaatgccaagacccggatacctgttcgcagctctgtgtgaatctggaaggagggtacaagtgccagtgcgaagagggattccaactcgaccctcataccaaagcatgcaaggccgtgggaagcattgcttacctgttctttaccaaccgacacgaagtccgcaaaatgactctggaccgcagcgaatacacctccctgatcccgaatctgcggaacgtggtggccctcgacactgaggtggcttccaacaggatctactggtccgacctgtcgcagaggatgatctgtagcacccagctggatcgcgcacacggtgtgtcctcgtatgataccgtcatctcacgggacatccaagcaccagatggactggcggtcgactggatccactcgaacatctactggactgactccgtgcttggaaccgtgagcgtcgccgacactaagggggtcaaacgcaagacgcttttccgcgaaaacggatccaaaccccgggccattgtcgtcgaccctgtccacggatttatgtactggactgattggggcaccccagccaagatcaagaagggagggctgaatggcgtcgacatatactcactggtgaccgagaacatccagtggccaaatggcatcactctcgatttgctgtcgggcaggctgtattgggtggatagcaagctccattcaatctcgtcgatcgatgtgaatggaggaaatcgcaagactatactggaggatgagaaacggctcgcgcatccgttttccctggctgtgttcgaggacaaagtgttttggaccgatatcatcaacgaggccatcttctcggccaatagactcactggatcggatgtcaatttgcttgccgagaatctgctgtcaccggaagatatggtgctgttccacaacctcacgcagcctcggggcgtcaattggtgtgagcgcactaccctgtccaacggaggatgtcagtacctgtgccttcccgcgccacaaatcaacccacacagcccaaaattcacttgcgcatgcccggacggtatgctgctggcgagggacatgaggtcatgtctcaccgaagccgaagcagcggttgcgactcaagaaacttcaaccgtcagactgaaggtgagctcaactgccgttcgcactcagcacactactactcgaccggtgccggatacctcgagactgcctggcgcaacgcccggactgaccactgttgaaatagtgactatgtcgcaccaggccctcggggacgtggcaggacgcggaaacgaaaagaagccgtctagcgtgcgcgcgctttcaatcgtgctccctattgtgctcctggtgttcctgtgcctgggcgtgtttctcttgtggaagaattggagactgaagaatatcaacagcatcaattttgacaatccggtgtaccaaaagaccaccgaagatgaggtccatatctgccataaccaggatggctactcgtacccgtctaggcagatggtgagcttggaagatgacgtggcc

SEQ ID NO: 287 - DNA, 2580 bp, Artificial Sequence
  Description of Artificial Sequence: Synthetic Transcript Sequence
atgggaccatggggctggaagctcagatggactgtggcactgctgctggccgccgccggaacggcagtgggtgatcgctgtgaacgcaacgaattccaatgccaggacggtaagtgtatttcatataagtgggtctgcgatgggagtgctgagtgtcaggatggatccgacgaatctcaagagacttgtctttccgtgacctgtaagtctggagacttctcgtgcggtggtagagtgaaccgctgtatcccccaattttggcggtgtgatgggcaggtggactgtgataacggcagcgacgaacagggctgtcctcctaaaacctgttcacaagatgaattccgttgtcatgatggaaagtgtatttctcgacagttcgtgtgcgattcggaccgggattgcctcgacggttcggacgaagcctcatgtccggtgctgacttgtggacctgcttcctttcagtgtaactcatcgacttgcattccacaactctgggcatgtgataatgatccggactgcgaagatggatcggacgagtggcctcagagatgtaggggtttgtacgtgtttcagggggattcatcgccatgctcagcctttgaatttcactgtctttcaggcgagtgcatccattcgtcgtggcgatgcgatggaggtcctgattgcaaagacaaaagcgacgaggagaactgtgccgtggcgacttgtcgcccggacgaatttcaatgttcagatggcaactgcatccatggaagccgtcagtgcgaccgagaatacgattgtaaggacatgtcggatgaagtgggatgcgtgaacgtaactctgtgtgagggacctaacaagttcaagtgtcatagcggtgaatgtatcacccttgataaggtgtgtaacatggctagagattgtagagactggagcgatgaacccatcaaagaatgtggtactaacgagtgcctggataacaacggtgggtgttcacatgtctgcaacgatctgaaaattgggtacgaatgtgactgcccggacggttttcagttggtggcacaaaggaggtgcgaagatatcgatgaatgccaggatccagatacctgctcccaactttgcgtcaacctggaaggaggatacaagtgtcaatgtgaagaaggatttcaacttgacccacatactaaggcctgtaaggcagtagggtccatcgcatacctgttctttaccaaccgtcatgaagtgcgaaagatgacccttgatagatccgagtacacttcgctcattcctaaccttagaaatgtcgtggcactcgacaccgaagtcgcgagcaacagaatatactggtccgatctttcccagagaatgatctgttcaactcaactggatcgtgcgcatggtgtgtcgtcgtatgatacggtcatcagccgggatatccaagccccagatggcctggcagtcgattggatccattcaaacatttactggactgattccgtgctcgggaccgtttctgtggcagatactaagggagtgaagcgaaagaccctgttcagagagaacgggtcgaaacctagagcgattgtggttgatccagtgcatgggtttatgtactggactgactgggggaccccggcaaagataaagaaagggggtctgaacggtgtcgacatctactcacttgtgaccgagaacatacagtggcccaacggtataactcttgatctcctttctggacgcctttactgggtggattcaaaattgcactcaatttcctctatagatgtgaatggaggcaatcggaaaactattctggaggatgaaaagcgtctggcacatcctttctcacttgcggtgttcgaggacaaggtgttctggactgacatcatcaatgaggcaatcttttccgccaatcgacttactggcagcgacgtcaatcttctcgcagagaatctgctttcaccagaggatatggtcctgtttcataatcttactcagcctagaggagtgaactggtgcgaaagaaccacgctcagcaatggcggatgtcaatacctgtgtctcccagcgcctcaaatcaatccccattcgccaaagtttacttgtgcatgtcccgatggcatgctgctggccagagacatgaggtcatgtctcactgaagccgaggccgccgtggcaacccaggaaacctcaacggttagacttaaggtgtcgtccacggctgtgcggacccaacatactaccactcggcctgtgcccgacacttcccggctccctggtgcaacccctggtctgaccaccgtggaaattgtgactatgtcgcaccaggcacttggcgatgtggcaggtagaggaaacgaaaagaaaccctcatcagtaagagcactttcgatcgtgcttccaatagtgctgctcgtgtttctgtgcttgggagttttcttgttgtggaagaactggcggctgaagaacatcaattccattaactttgacaaccccgtgtaccagaaaaccaccgaggacgaagtccacatctgtcataatcaggatggctattcctacccttcgcgtcaaatggtcagcctggaagatgatgtggca

SEQ ID NO: 288 - DNA, 2580 bp, Artificial Sequence
  Description of Artificial Sequence: Synthetic Transcript Sequence
atgggaccgtggggatggaagctgcgctggaccgtggcactcctgctcgctgccgccggtaccgcggtcggtgacagatgcgagcgcaatgagttccagtgccaggatggcaagtgtatttcatacaagtgggtgtgtgatgggtcggcggaatgccaggatggatcggacgaatcacaggaaacgtgtctgtccgtgacctgcaaatccggggatttcagctgcggtggtcgcgtgaatcggtgcatccctcagttctggcggtgcgacggacaagtggattgcgacaacggcagcgacgaacaaggatgccctccaaagacttgctcccaggatgaattcaggtgccacgacggaaagtgtatctcacggcagttcgtgtgtgactccgatagagattgtctggacgggagtgacgaagcctcctgccctgtgctgacttgcggaccagcttccttccagtgcaatagctctacttgcatcccccaactctgggcctgtgacaatgaccctgactgtgaggacgggtcggacgagtggccgcagcgctgcagaggactctatgtgttccagggagactcctcgccgtgctcggcattcgagtttcactgcctctccggagaatgtatccactcctcgtggcgctgcgacgggggaccagactgcaaggataaatctgacgaagagaactgcgctgttgcgacctgccggcctgacgagttccaatgttccgacggaaactgcatccatggttcccgccaatgcgaccgggagtacgactgcaaggacatgtcggatgaggtgggatgtgtcaatgttaccctctgcgaagggccgaataagttcaaatgccactcaggcgagtgtatcaccctggataaggtgtgcaatatggcgagggactgccgggattggagcgacgaaccgatcaaagaatgtggtactaatgagtgcctcgacaataatggcggctgcagccacgtgtgcaatgatctgaaaattggatacgaatgtgactgcccagacggattccaattggtcgcacagcggcgctgcgaggacattgacgagtgccaggaccctgatacttgttcgcagctgtgcgtgaaccttgaaggtggatacaagtgccaatgtgaagaaggcttccaactcgacccgcataccaaagcgtgcaaagctgtgggatcaattgcatacttgttctttactaatcgccatgaagtccgcaagatgactctcgacagatctgaatacacttcccttatcccgaacctccggaacgtcgtggctctggacaccgaagtcgccagcaacagaatttactggtccgatctgtcacagcgcatgatttgctccacccagttggaccgggcacatggagtgtcgtcttacgataccgtgatttcaagggacattcaggcaccggatggactggcggttgactggatccattcaaacatctactggactgattcggtgttgggaacggtatcagtggccgatactaaaggggtcaagagaaagactctgtttagagaaaacggatcgaaaccacgggctatcgtcgtggatccggtgcacggatttatgtactggaccgactggggcaccccagcaaagatcaaaaagggaggtctgaacggcgtggacatttactctctggtcactgagaacattcagtggccaaatgggatcacgttggacctgttgtcgggaaggctttattgggtggactctaagctgcactccatttcctccatcgacgtcaacggaggaaatcggaaaactatcctcgaggacgaaaagaggctcgctcacccgttctcactggctgttttcgaggacaaggtcttttggactgacatcatcaacgaggcgatattctcagctaatcggttgaccggatccgacgtgaacctccttgccgagaacctgctttcgccggaggatatggtcctgttccacaaccttactcagccgcgcggagtgaactggtgtgaacgaactaccctcagcaatggagggtgccagtatctgtgcttgccggcgccgcagatcaacccacactcaccgaaattcacctgtgcgtgcccggatggtatgctgctggcgcgcgatatgcgatcatgcctgaccgaggctgaagccgcggtcgctacgcaagagacttccacggtgcgtctcaaggtgagcagcacggcagtgaggactcaacatactaccacccgtcctgtgcccgatacctcgagactgccgggcgccacccctggcctgactaccgtcgaaatcgtaaccatgtcgcatcaggcgctgggagacgttgccggtcggggaaatgaaaagaagccgagctccgtgcgcgcgctgtcaatcgtactgcccatcgtgctgcttgtgtttctgtgcctcggagtgtttctcctgtggaagaactggcggctgaaaaacatcaactcgatcaacttcgacaaccctgtgtaccaaaagacgaccgaggacgaagtgcatatctgccacaatcaagatgggtactcgtacccctcccgacagatggtgtctctcgaggacgatgtggcc

SEQ ID NO: 289 - DNA, 2580 bp, Artificial Sequence
  Description of Artificial Sequence: Synthetic Transcript Sequence
atgggaccttggggatggaagttgagatggaccgtagctctgctcctggcggctgccggcaccgccgtgggtgatcgatgcgagaggaatgagtttcagtgccaagatgggaagtgtattagctataaatgggtgtgtgacggatcagcagaatgccaggacggaagcgatgagagccaggaaacttgtctgagtgttacatgcaaaagcggcgacttttcctgcggggggagagtaaatcgctgcatcccacagttttggcgttgcgacgggcaggtggactgtgacaacggatccgatgaacaggggtgccctccgaaaacctgctcgcaggatgagttccgctgtcacgacggtaagtgcatctcccgacagttcgtctgcgattctgatcgcgactgtctggacgggtccgacgaggccagctgccccgtgctaacatgtggtccagccagttttcagtgtaatagtagtacttgcataccacagctttgggcctgcgataatgatcccgactgcgaggatggatcagacgagtggccccaacgctgccggggcctgtatgtgtttcaaggggactctagtccgtgcagtgcttttgagtttcattgtctttccggtgagtgtatccactcttcgtggagatgcgatggcggaccagattgtaaagacaaatcagacgaggagaattgtgcagtagctacttgtagacctgacgaattccagtgctctgacggaaattgcattcatggctcaagacagtgtgaccgggaatatgattgcaaggatatgtccgatgaagtgggatgcgttaatgtcaccctgtgcgagggaccaaacaaatttaagtgccactccggggagtgcataacgctggataaggtgtgtaatatggcaagagactgccgagattggagcgatgagccgatcaaggagtgtggtaccaatgagtgtctggataacaacggagggtgctcacacgtgtgtaacgatctgaagataggatatgaatgcgactgcccagatggtttccagctggttgcccagaggcgatgtgaggatatcgacgaatgtcaggatccagacacctgctcccaattatgtgtgaacctcgaagggggctacaagtgccagtgcgaggagggattccaactcgatccgcacacaaaggcatgcaaggccgttggaagtatagcttatttgttctttacaaaccggcacgaagtgcggaagatgaccctggatagatccgaatatacatcacttatcccaaatcttcgaaacgtcgtggcgttggacaccgaggtggcctccaatcgaatctactggagtgatctgagccagcggatgatttgctccacgcagctcgaccgcgcgcatggtgtctcctcttacgacaccgtaatcagccgtgatatacaggcgccagatggcctggcggtggactggatccattcaaatatctactggactgactccgtcctggggactgtgtccgtggccgacacaaaaggcgtgaaacgtaagacactgtttcgggagaacgggtctaagccgagggccattgtagttgaccctgtacacggctttatgtactggaccgattggggaacccctgccaaaatcaaaaagggcggcctgaatggagtcgatatctacagcctggtcaccgagaacattcagtggcccaacgggattacgttagacctgctctcagggcggctatattgggtagattccaagttgcactccatctcttcaatagacgtaaatggtggcaatcgaaaaaccattctggaggatgagaagcgtctggcccacccattcagccttgctgtgtttgaggataaagtgttttggactgacattatcaatgaggccatctttagcgccaatcggctcaccggttctgacgtgaacctgctagccgagaacctcctgagccccgaagatatggtattgtttcacaacctgacccagccgcgcggggtgaactggtgtgaaagaacaaccctcagtaacggtggttgccagtacctgtgcctgcctgcacctcagataaatcctcactctcccaaattcacctgcgcgtgccctgacggcatgctgttagcgagggacatgcgatcttgtctgacagaggccgaggccgcggtcgctacacaggagacttcaactgtaaggctcaaagttagttcgactgccgtgagaactcagcacaccactacgcggcctgtgcccgacacctcaaggttgcccggtgcaactccagggttaaccaccgtcgagatcgtcactatgagccaccaggcactcggggatgtggcaggcaggggaaacgagaagaagccctcttccgtgcgcgctctgtcaatcgtcttacccattgtgcttcttgtatttctgtgccttggggtatttttactgtggaagaattggaggctgaagaatattaacagtataaattttgacaatccagtctaccagaagacaactgaggacgaggtgcatatttgccataatcaagacgggtattcctacccttctcggcagatggtctctctcgaagatgacgtggcc

SEQ ID NO: 290 - DNA, 2580 bp, Artificial Sequence
  Description of Artificial Sequence: Synthetic Transcript Sequence
atgggcccttggggttggaagctgcgctggactgtggcactgctgttggcagcagctggaactgccgtgggagatagatgcgaacgcaacgaattccagtgccaggacggaaaatgcattagctacaaatgggtctgcgacggctcagcggagtgtcaagacggaagcgacgagagtcaggaaacctgtctgtcagtgacttgtaagtccggcgacttctcgtgcggcggtcgggtgaatagatgcatccctcagttctggcgttgcgacggtcaggtggactgtgacaatggatccgacgagcaggggtgtccacccaagacttgttcgcaggatgaattcagatgccatgacggaaagtgcatttcgcgccagttcgtgtgcgactcggatcgcgattgcctcgatgggtcagacgaagccagctgtccggtcctcacctgcggaccggcttccttccaatgcaactcgtccacgtgtatcccacagctctgggcgtgcgacaatgaccccgattgtgaggacggatccgatgaatggccgcagagatgtcgcggactctacgtgtttcaaggagactcgtcaccgtgctccgcgttcgagttccattgcctgtccggagaatgcatacacagctcatggaggtgtgacggaggcccggattgcaaggacaagtcggatgaggaaaactgcgcggtggcgacttgccgcccggatgaatttcaatgtagcgatggaaactgcatccatggctcacgtcagtgtgaccgggagtacgactgcaaagatatgtcagacgaagtggggtgcgtcaacgtgacgctctgcgaaggaccaaacaagttcaaatgccattccggcgaatgcattactctggataaggtctgcaacatggcgcgggactgccgggactggtcggacgaacctatcaaggagtgtggaacgaatgaatgcctcgataacaatggaggttgctcacacgtgtgcaacgacctgaagataggctatgagtgtgactgccccgatggcttccagctggtcgcacagcgccggtgtgaagatatcgacgaatgccaagatcccgacacctgctcccagctctgtgttaacctggaaggaggctacaagtgccagtgcgaggaggggtttcagctggatcctcacactaaggcttgcaaagcggtgggatcgattgcctaccttttcttcactaatagacacgaggtccgcaagatgactctggaccggtcggagtacacctctctgattccaaacttgcggaacgtcgtggccctggacactgaagtggcgtcaaatagaatttactggtccgatctgagccagaggatgatctgtagcactcagttggaccgtgctcacggagtctcgtcgtacgatacggtaatctcgcgcgatattcaagcaccagatggcctggcggtggactggatccactcgaacatttactggactgattccgtgctcggcaccgtttcagtggccgataccaagggggtcaaacgcaagactctgttcagagaaaatggatccaagccacgggcgatcgtggtggatccggtccacgggtttatgtactggactgactggggtactccggcgaaaatcaaaaagggagggcttaatggagtcgacatctactcgctcgtgactgaaaacatccaatggccgaacggaatcaccctggatctgctgtcgggccgcctctactgggtggactcgaaacttcactcgatctctagcatcgacgtcaatggcggaaataggaaaactatcttggaggatgagaagcggctggcgcaccctttcagcctggccgtgttcgaggacaaggtgttctggacggacatcatcaacgaggccatcttcagcgccaatcgtctcactggctccgacgtcaacctgcttgctgagaatctgctttcgcccgaggatatggtgctgtttcataaccttacccaaccacggggcgtgaattggtgcgaacggaccaccctgtccaacggtggctgccagtacctctgcctcccggcccctcaaatcaacccgcactcgcctaaattcacttgcgcatgcccggacggtatgttgctggcgagagacatgcggtcgtgccttaccgaagccgaggccgccgtggccacgcaagaaacctccaccgtgcgcctgaaggttagcagcaccgccgtgagaacccaacataccaccaccagaccagtgccggacacctcccgactcccgggggccacccctgggttgaccaccgtggaaatagtgaccatgagccatcaggcacttggggatgtggctggacgcggaaacgaaaagaagccttcctcggtgcgggctctgtcaatcgtcttgcccatcgtcctcctcgtctttctctgcctgggagtattcctcttgtggaagaactggcgcctgaagaacatcaactcaataaactttgataacccagtgtaccagaaaaccactgaggacgaagtgcatatctgtcacaatcaagatggatattcttacccgagcaggcagatggtgagcttggaggacgacgtggca

SEQ ID NO: 291 - DNA, 2580 bp, Artificial Sequence
  Description of Artificial Sequence: Synthetic Transcript Sequence
atgggcccttggggatggaagttgcggtggaccgtggcactcctacttgcggcagcaggaacggctgtaggtgataggtgcgagaggaatgagttccagtgtcaggatggaaaatgcatttcctacaaatgggtgtgcgacggttctgccgagtgccaggatggatcagatgaaagccaagaaacttgtctgtcggtcacttgtaagtcgggggatttctcttgcggcgggagggtaaatcgatgtattcctcagttctggcgctgcgacggacaagttgattgcgataacggcagcgatgaacagggatgccctcctaagacttgttcccaggatgagttccgatgtcacgatggaaaatgtattagccgccaatttgtgtgcgatagtgacagagattgcctggatgggagtgatgaggcatcttgccctgtgttaacctgcggcccagccagtttccagtgtaattcatcgacatgcatcccacagctgtgggcatgtgataacgaccccgattgtgaggatggtagtgacgaatggccacagcgctgccgaggattgtatgtctttcaaggcgatagtagcccgtgttccgcttttgagttccactgtcttagcggcgagtgtattcactcctcttggcgctgcgacggaggccctgactgtaaagataagagtgatgaggagaattgcgcagttgctacatgtcgcccagatgagtttcagtgttccgacggaaactgtatacacgggagcaggcagtgcgaccgtgagtacgattgcaaagacatgtcagatgaggttggctgcgtgaacgtcacgctctgtgaaggacccaacaaatttaagtgtcacagcggtgagtgtattaccctggataaagtgtgtaatatggccagagattgccgagactggagcgacgaaccgataaaagagtgcggcacaaacgagtgccttgacaataatggcggttgttcacacgtgtgcaacgatctgaagatcggatatgaatgcgattgtcctgatggatttcagctagttgcacagcggcgctgcgaggatattgacgagtgtcaagatccagatacatgtagccaactatgcgtgaatctggagggcggatataagtgccaatgtgaggaggggtttcagcttgatccacatacaaaggcttgtaaggccgtgggctctattgcgtacttgtttttcactaatagacacgaggttcgcaaaatgactttggacagatcggaatacacttccctcatcccaaaccttagaaatgttgtcgccctggatactgaggtggccagtaaccgtatttactggtccgatctgagccagagaatgatatgcagcactcagctggaccgcgcacatggagtgtcttcttacgacacagtgatttctcgagatatacaggcccccgacggcctggcagtggattggattcacagcaacatttattggaccgattctgtccttggaacagtcagcgtggcggacacaaaaggcgtcaagcggaaaacattgtttcgggaaaacggcagtaagcctagagctatcgtagtcgatcccgtccatggtttcatgtactggaccgactgggggacaccagccaaaatcaaaaaaggtggtttaaatggagtggacatttattccctggtaacggagaacattcagtggcccaacggtataactttggatttactttctggacgcctttactgggtggatagtaaactacacagtatcagttcaattgacgtcaacggaggtaatcgtaaaactatcctggaggatgaaaaacgtcttgcccacccattctcactcgctgtcttcgaggacaaggtattctggaccgacataatcaacgaagcaatctttagcgccaaccgtctgactggcagcgatgtgaaccttcttgccgaaaatttattgagccccgaggacatggtactgtttcacaatttgacacagccccgaggagtgaactggtgtgaacgaactaccctgagcaacggaggttgtcagtacttgtgcctgccggctccacaaattaatccccatagtccaaaatttacatgtgcctgtcccgacggaatgctgctagcacgggatatgcgctcgtgtcttaccgaggctgaggcagcagtcgccacccaggaaacctccaccgtgagactgaaagtctctagcaccgcagtgcgcacacaacacaccacaacccgtcccgtgcccgatacatcccggctgccaggggcaacaccaggtctgacaaccgtggaaatagtaaccatgagccaccaagcgctgggggacgtggccggacggggcaacgagaagaagcctagttccgtcagagcactttctatcgtgctgccaattgtcctgctagtgttcctctgcctgggcgtctttctgctgtggaaaaattggagactgaaaaatattaacagcattaactttgacaaccccgtgtaccaaaagacaactgaggacgaagttcatatctgccacaaccaggatggatattcctaccccagtcgccagatggtttctctggaagacgacgtggcc

SEQ ID NO: 292 - DNA, 2580 bp, Artificial Sequence
  Description of Artificial Sequence: Synthetic Transcript Sequence
atggggccttggggatggaagctgcgctggacagtcgctctgctcctggctgcggcgggtaccgccgtgggggataggtgcgagagaaatgaattccaatgccaggacggaaagtgcatcagctacaaatgggtatgtgatggctcagcagagtgccaggacggaagtgacgaaagtcaagaaacctgtctatcggtgacatgtaagtctggcgactttagctgcggaggccgagtgaatcgatgtattccacagttttggaggtgtgatggccaagtggattgcgacaacggttcagacgagcaggggtgtcctccaaagacctgtagccaggatgaattcagatgccatgacgggaagtgcatctcaaggcagtttgtctgcgacagtgatagggactgcctggatggctccgatgaagcgtcatgtcccgtgttaacttgcggccctgcgtcattccaatgtaattcatcgacctgcattccccagctctgggcctgcgacaatgaccctgattgcgaagacggtagcgacgaatggccccagaggtgtcggggcctgtacgtttttcagggtgattcatctccttgttcagccttcgagttccactgcctgtctggggagtgcatacattcgtcttggcggtgcgacggaggtcccgattgtaaggataaatcagacgaagagaactgtgctgtagctacatgcaggccagatgagttccagtgcagcgacgggaactgcatacacggatctaggcagtgcgatcgggaatatgattgtaaagacatgtctgacgaggtcgggtgtgtgaatgtgacactgtgcgaaggtccgaataagttcaagtgtcactctggggagtgtatcaccctggataaagtctgcaatatggcacgagactgcagagattggagcgacgagcctataaaggagtgcgggaccaatgagtgtctggacaataacggaggatgcagccacgtctgcaacgatctcaagatcgggtacgaatgcgactgtcctgacggtttccagctagttgcgcaaagaagatgtgaggatatagatgaatgtcaggaccccgatacgtgcagtcaactctgtgtgaacctcgaaggcggatataagtgtcaatgcgaggagggcttccagctcgatccccatacaaaagcctgtaaggcggtcgggagcatagcctacctgttcttcactaacagacacgaggtacggaaaatgacattagacagatcagagtacacatctcttattcctaatcttaggaatgtggtggccctggatacagaagtcgcttctaatcggatctattggagtgacctaagtcagcgcatgatctgttccacccagctagatagagcccacggcgtgtcttcatacgacaccgtgataagcagggatatacaagccccagatggactcgcggtcgactggatccacagcaatatctattggacagattcggtgctgggcacagtaagcgtagccgatactaagggggtgaagcgcaagacgctcttcagggaaaatggttccaaaccgagagccatcgtggtagatccagtccacgggtttatgtactggaccgactggggaacaccggcaaagataaagaagggtggccttaatggggtcgacatctacagcctggtgactgaaaacatccaatggcccaacggcataaccctcgacttactgtcaggccgactctattgggtcgattccaagcttcatagtatttcttccattgatgtgaacgggggcaatagaaaaacaattctcgaagatgaaaaacggctcgctcatcctttctccttggcggtgtttgaagacaaggtgttctggactgacataataaacgaggcgattttttccgctaatagactgaccggctcagatgtgaatttgctggcggaaaacctgctgtcgccagaggatatggtccttttccacaacttaacccagccacggggcgtaaactggtgcgagagaacaacattgagcaacggtggctgccagtatctatgcctgcccgctccacagataaacccccacagtccgaagtttacttgtgcatgccctgacggaatgctgcttgcccgtgatatgcgatcgtgcctgaccgaagcagaagccgcagtagctacacaagaaacatcaaccgttcggctgaaggtgtcttcgactgctgttagaacacagcacaccaccacccggccggtcccggatacaagcaggctccccggagccacaccaggactgaccaccgtggaaattgtcaccatgagccatcaagcccttggagatgtggccggccgcgggaacgaaaaaaaaccctctagtgttagagctctgtctatcgttttgcctattgtacttctcgtcttcctgtgcctgggagttttcctgctgtggaagaactggcgcctcaaaaatatcaactcaatcaattttgataaccccgtctatcaaaagacaactgaagatgaggtccatatctgtcacaatcaggatggatattcatacccctctcggcagatggtctcgctggaagatgacgttgcc

SEQ ID NO: 293 - DNA, 2580 bp, Artificial Sequence
  Description of Artificial Sequence: Synthetic Transcript Sequence
atgggaccttggggctggaaattgcggtggacggtcgctctcttacttgccgccgcaggtaccgcagtcggtgataggtgtgagcgcaacgaattccagtgtcaggacggaaaatgtattagttacaagtgggtgtgcgacggatctgccgagtgtcaggatggaagcgacgagtctcaggaaacctgtctcagcgtaacctgtaaatccggcgactttagttgcggcgggcgggtgaaccgctgcatcccccaattctggaggtgtgacggccaggtggactgcgataatgggagcgatgaacaagggtgtccaccaaagacttgcagccaggacgaattccggtgtcatgatgggaaatgcataagccgccagtttgtctgtgactccgatcgcgactgccttgacggctcggatgaggcctcttgcccggttctgacatgcgggcctgcgtccttccagtgcaatagttcaacctgcattccccagctgtgggcttgtgacaacgatccggattgtgaggatggctccgatgaatggccccagcgatgccgtggactttacgttttccagggggacagcagcccctgcagtgctttcgagtttcactgcttgagcggcgagtgcatccacagctcttggcggtgtgatggaggacctgattgtaaggataagtctgacgaggagaactgcgcagtggctacctgtaggcccgacgagtttcagtgttccgacggaaactgtatccacggtagcaggcagtgcgatcgagaatacgattgcaaagacatgtccgacgaggtggggtgtgtaaatgtgactctctgcgagggaccaaacaagttcaaatgtcatagtggggagtgcattactctggataaagtgtgtaatatggcacgggattgcagagactggagtgatgaacccattaaagagtgcgggactaatgaatgcctggacaacaacggcggctgtagtcacgtttgtaacgacctgaagatcggttacgaatgtgattgcccagacggcttccaactggttgcccagcggcgatgcgaagacatcgacgagtgtcaggatcctgatacatgttcacagctctgtgtaaatctggaagggggttataagtgtcagtgcgaagaagggttccagctggacccccacactaaagcatgcaaagctgtcggctctatcgcctacttgttcttcacaaaccggcatgaggtcaggaaaatgactttggataggtctgagtacaccagtctgatccccaacctcaggaacgttgtagcgttggacacagaagtggctagtaatcgtatctactggagtgacctgtcacagaggatgatatgtagcacccagctggacagggcccacggggtgagctcttacgacaccgttatcagtagagatatacaggccccagatgggcttgctgtagattggatccatagcaatatttactggaccgattcagttttagggacagtgagtgttgctgacacgaaaggagtcaagaggaaaaccctgttccgtgagaatgggagtaaaccgcgagcaattgttgtggacccagttcacggcttcatgtattggaccgattggggtaccccagccaaaatcaaaaaaggtgggctgaacggtgtggatatctatagcctggttactgaaaacatccagtggccaaacggcatcactctggacctgctttctggtcggttgtattgggtagattcgaagctgcacagcattagctccatagatgtgaacggaggcaatcgaaagaccattctcgaagatgaaaaaaggcttgcccatcctttttctctcgctgttttcgaagataaggtgttttggaccgacatcatcaacgaagctatcttttccgctaaccggctaaccggctccgacgtgaatctgctggccgagaatctgctctctcctgaggatatggtgttgtttcacaatctgacccaaccacgtggtgtgaactggtgtgagcgaaccacactctctaatggtgggtgccagtatctatgcctgccggctccccagattaatccccattcacctaaatttacctgcgcttgtcccgatggaatgctgctggcccgggatatgcgatcctgcctcaccgaagccgaagccgcggtggctacacaggagacatccacggtccgcctgaaggtctcaagtactgcagtgcgtactcagcacacgacgacacgccctgtcccggatacttcacggctccccggggccaccccgggcctgaccactgtggaaattgtaacaatgtcacaccaagctctgggcgacgttgctgggaggggaaacgagaagaaaccgtcaagtgttcgcgccctatcgattgttttaccaatagtgttgctggtctttctgtgtctgggtgtgttcctcctatggaaaaactggcggctcaagaatattaattcaatcaattttgataacccagtctaccagaaaactacggaagatgaggtccacatttgccacaaccaagatggctactcatacccttctagacagatggtgtcattggaggacgatgtcgct

SEQ ID NO: 294 - DNA, 2580 bp, Artificial Sequence
  Description of Artificial Sequence: Synthetic Transcript Sequence
atggggccctggggctggaagttacgctggaccgtggctttgctgttggccgccgccggcacagctgtaggagatcgctgtgaacggaacgagtttcagtgtcaagatgggaaatgtatcagctataagtgggtgtgcgatggcagcgctgaatgtcaagacggcagtgacgagtctcaagagacttgcctgagtgttacctgcaaatctggcgactttagctgcggcggcagagtgaatagatgtataccacaattctggcggtgtgatggccaggtggattgtgacaatggaagcgacgagcaaggatgcccgcccaaaacctgctctcaggacgagtttcgatgtcacgacggtaagtgtatctccaggcaattcgtatgtgactcagaccgtgactgcctcgatggcagtgacgaagcatcatgcccagtattaacctgtgggcccgcatccttccaatgtaattcctcaacttgtattccacagctctgggcctgcgacaacgacccagattgcgaagacggctccgatgagtggccgcagagatgtaggggcctctacgttttccagggcgacagttctccttgcagcgccttcgaatttcactgcttgagtggagagtgtatccactccagctggagatgtgacggcggtccagattgtaaagacaagtcggatgaggagaattgcgcagtagccacatgcagacccgatgaattccaatgttccgacggaaactgcatccacggaagtcggcagtgtgatagagagtacgattgcaaggacatgtctgacgaagtaggatgtgtgaacgtaaccctgtgcgaaggccctaataaattcaagtgccacagtggggagtgtatcactttggataaggtgtgcaatatggctagggactgcagggattggtccgacgagccaatcaaagagtgcggcactaatgagtgtcttgacaacaacggcgggtgtagtcatgtctgcaacgatctcaagatcgggtacgagtgtgactgtccagatgggttccagttggtggctcaacgccgatgcgaagatattgatgagtgtcaggatcctgacacttgttcccagctgtgcgttaatctggaggggggatacaaatgccagtgcgaggaagggttccagctcgatccacatacaaaggcgtgtaaggcagtgggtagcatagcctatctgttttttaccaaccgccatgaggttaggaaaatgacccttgatcgttcggaatataccagccttatcccaaacttgagaaatgtggttgccttggacactgaggtggcctctaaccgcatatactggtccgacctgagtcagcggatgatctgttctacacagctggaccgcgcccatggtgtctcctcatatgataccgtcataagccgcgatattcaagcccctgatggactggcagttgattggatccatagcaacatatactggacagattcggtcctgggcacagttagcgtggcagacaccaagggcgtcaaaagaaagaccctctttcgagaaaacggatcgaaaccgcgagcaatcgtggtggaccccgtccatgggtttatgtactggactgattggggtaccccggccaaaatcaagaaaggcggattgaacggagtcgacatttactctctggttacagagaacattcagtggccaaacggtatcacactggacctgctctcaggccgtctctattgggtcgacagtaaactgcattccatcagctccatcgatgtaaatgggggaaaccgtaagaccattctggaggacgagaagcggttggctcaccccttctccctcgccgttttcgaagacaaggtattttggaccgacattatcaacgaggctatattttctgccaataggctcacaggctcagacgtcaacttgctggcggaaaacctcttgtccccggaagacatggtactgttccacaacttgactcagccccgcggagtcaactggtgcgagcggactactcttagcaacggggggtgccagtacctgtgtcttccggccccccaaattaacccccactcacctaagttcacctgcgcctgtccagatggcatgctgctggcccgagatatgaggtcatgtcttactgaggcagaggccgccgtagctacccaggaaacctcaactgtgagactgaaggtatcctctactgctgtgaggacccagcatacaaccactcgacctgtcccagacacgagcaggctgcccggtgcaacacccgggctgaccacggtggaaattgttactatgagccaccaagccctgggcgatgtggctggccggggcaatgagaagaagccctcttccgttcgggccttgagcatcgtccttcctattgtgctgttggtatttctttgtctcggcgtattcctgctgtggaaaaactggaggttgaagaacatcaactctattaattttgataaccctgtgtatcagaagaccacagaagatgaggttcacatctgccataaccaagatggctactcttatccatcccgacagatggtttccctcgaagacgatgtcgct

SEQ ID NO: 295 - DNA, 2580 bp, Artificial Sequence
  Description of Artificial Sequence: Synthetic Transcript Sequence
atggggccctggggctggaaactgcgttggactgttgcccttctgctcgccgccgccggcaccgcggtcggtgaccggtgcgaacgaaacgagtttcagtgccaggacggaaagtgtatctcctacaagtgggtctgcgacggctctgcggagtgtcaggacggctctgacgagagccaggagacttgcctctctgttacgtgcaaatcaggcgatttcagttgcggcggtcgagtaaaccggtgcataccacaattctggaggtgtgatggacaggttgactgtgacaacggcagcgacgaacaaggctgcccacccaaaacctgctcccaggatgagtttaggtgtcacgacggaaagtgtatttcccggcaattcgtgtgtgactctgaccgtgattgtctggacggctcagacgaggcttcatgccccgtgctcacgtgcgggcccgccagttttcaatgcaacagcagcacctgtatcccccagctttgggcttgcgataatgaccctgattgtgaggacggctccgatgagtggcctcaacgctgccggggtttgtatgtatttcagggcgactccagtccctgttccgcatttgagttccactgtttgtccggcgagtgtatccattcctcttggagatgcgatggtgggcccgactgcaaggacaaatcagacgaagaaaattgtgccgtggcaacgtgccgcccagatgaatttcaatgttccgatgggaattgcattcacgggtccaggcagtgtgatcgagaatacgactgcaaagatatgtccgatgaggtggggtgcgtgaatgtcacgctctgcgaggggcccaataagttcaagtgtcatagcggagagtgcatcacattggataaggtgtgcaacatggcacgggattgcagggattggtctgacgagcctatcaaggagtgtggcacgaatgaatgtttagacaataacggaggttgcagtcatgtgtgcaacgatttgaagatcggctatgagtgcgactgtcccgatgggttccaactggtggctcagcgtcgttgcgaagatatcgatgagtgtcaggaccctgatacctgcagccaactctgtgtgaacctggaaggcggatataagtgtcagtgtgaagagggtttccagcttgaccctcacaccaaagcatgtaaagccgttggcagcatcgcttacctcttttttactaaccggcatgaggtgaggaagatgaccctcgaccggagcgaatacacctcgctgattcctaacctgaggaacgtagtagctctcgataccgaggtggcctccaaccgcatctattggtcggacctcagtcaacgtatgatttgcagtacccagctggaccgtgctcacggcgtgagctcgtacgataccgtgatcagccgcgacatccaggccccggacggcctggccgtcgattggatccatagcaatatatattggacagacagcgtgctcggtacagtgtctgtggccgacacaaaaggggtgaagcgcaagacactgttccgcgagaacggttccaagccgcgcgctatcgtagtggatccagttcatggcttcatgtactggactgactggggtactcccgctaagatcaaaaaaggcgggctgaacggagtggatatatatagtctggtgacagagaacatccaatggccgaatggaattacattagacctgctgtccgggcgactctattgggtcgatagcaaactccactctatttcttctatcgacgtcaacgggggcaaccgaaagactatactggaagatgagaagcgtttagcacaccctttctctctcgctgtgttcgaggataaggtgttttggactgatatcatcaacgaggccatctttagtgctaacaggctcacgggaagcgacgtcaatttactggcagagaacttgctgagccccgaggatatggtgctgttccacaacctcactcaaccccgcggagtgaattggtgcgagcgcacaaccctaagcaatggcggctgtcaatacctgtgccttccagccccacagataaatccccactcgccaaaatttacctgcgcttgcccagacggaatgcttctagcccgcgacatgcgctcatgcctgacagaagccgaggcggccgtcgcaacccaggagacatcaacagtcagactgaaagtgagctctacggctgtgcgcacacagcataccacaactcgacccgtgcctgatacttcccggcttccaggcgcgacgcctgggctgacgaccgtagagatcgtcaccatgtcccaccaggccttaggagacgtcgcgggaagggggaacgagaagaagccttcgagtgtgagagctctgagcatcgtgctccctatcgtcctcctcgtcttcctgtgtttgggagtgtttctgctgtggaagaactggagattgaaaaacataaactcaatcaattttgacaacccagtgtaccagaagacaacagaggacgaagttcatatctgccataatcaggacggctacagctacccatcgcggcaaatggtttcattggaagacgacgtggcg

SEQ ID NO: 296 - DNA, 2580 bp, Artificial Sequence
  Description of Artificial Sequence: Synthetic Transcript Sequence
atgggaccatgggggtggaaacttcggtggaccgtggccctgctcctggccgcagcgggtacggcagtgggagatagatgcgaacggaatgagttccagtgtcaggatgggaagtgtatcagttacaagtgggtgtgcgatggatcagccgaatgtcaggacggttccgacgaatcccaagaaacctgcctgagcgtcacttgcaaatctggggacttttcgtgcggagggcgggtgaaccgctgtataccgcaattctggcgctgtgatggtcaggtcgactgcgataacggatccgacgaacaaggctgcccaccaaagacctgctcgcaagatgaattccggtgccacgacggcaagtgcatctcccgccagtttgtgtgtgatagcgatcgggactgtctggacggaagcgacgaagcgagctgtccagttctgacgtgcggcccggccagcttccagtgcaattcgtcgacctgtatcccgcagctctgggcatgcgacaacgatcctgactgcgaagatggctcggacgaatggccgcaaagatgcaggggactgtacgtttttcagggagactcgagcccttgctcggctttcgaattccactgcctctccggtgagtgtatccactcaagttggcgttgcgatggcggcccggattgtaaggataagtcagacgaggaaaattgtgccgtggcgacctgccgccctgacgagttccagtgcagcgatggaaactgcatacacggcagccggcagtgtgaccgcgagtacgattgcaaagacatgtcggacgaggtggggtgcgtcaacgtgaccctttgcgagggacctaacaaattcaagtgtcactcgggagaatgtatcactctggataaggtctgcaatatggctcgcgactgccgggattggtccgatgagcccatcaaggaatgcggaaccaacgaatgcttggataacaatggaggttgctcccacgtgtgcaacgatttgaaaatcgggtacgagtgcgattgccctgacggattccaattggtggctcagcgccggtgcgaagatatcgacgagtgccaggatcctgatacctgttcccagttgtgtgtcaacctcgaaggaggttacaagtgccagtgtgaggagggattccagttggacccccacactaaagcgtgcaaagcagttggctcgatcgcgtacctgttcttcactaatcgacatgaggtgcgcaaaatgaccttggacagatcggaatacacgtcgctcattccgaaccttcgcaacgtagtggccctggacactgaggtggcttccaatcgcatctactggtcagatctgtcgcagaggatgatctgttccactcagctcgatagagcacatggagtgtcgtcgtacgacaccgtgatctcacgcgacatccaagccccggatggattggctgtcgactggatccacagcaacatctactggaccgactccgtgcttggaactgtgtcggtggccgataccaagggtgtcaagagaaaaaccctgttccgcgagaatggaagcaagcctagagcgatcgtggtcgacccggttcacggatttatgtactggaccgattgggggacgccagcaaagatcaagaagggaggactgaacggtgtcgatatctactctctggtcactgagaacatccagtggccaaacggaattaccctggatctcctttccggaagattgtactgggttgattccaagctccattcgatctccagcatcgacgtgaacggcggcaataggaaaactattttggaggatgaaaagcgcctcgcgcatccgtttagcttggccgtctttgaagataaggtgttctggacggacatcatcaacgaagctatcttcagcgcgaatagactgaccggatcggatgtcaacttgctggcggaaaacctcctgagcccagaggatatggtgctctttcacaacctgacccaaccgcggggcgttaactggtgcgagcgcactaccctgtccaatggcggctgtcagtacctgtgtctgccagcaccgcagattaatccacactcacctaaattcacctgcgcctgcccggatggtatgctcttggcccgcgacatgaggtcatgtctgaccgaggcagaggctgcagtcgccactcaggagacttcgacggtgcgcttgaaagtcagcagcactgcggtgagaacccagcacactaccacccgcccagtgcccgacacgtcccgcttgccgggagccaccccaggactcaccaccgtggaaatcgtgaccatgtctcatcaagcgcttggagacgtggctggacggggaaacgagaaaaagccgagctccgtgcgagccctctccattgtcctgccgatcgtgctgctggtgttcctgtgcctgggagtgtttcttctctggaagaactggcggctcaagaatatcaactccatcaatttcgataatcccgtgtaccaaaagactactgaagatgaagtgcacatctgccacaaccaggatggatattcgtatccgagccggcagatggtttcactggaggatgatgtggct

SEQ ID NO: 297 - DNA, 2580 bp, Artificial Sequence
  Description of Artificial Sequence: Synthetic Transcript Sequence
atgggtccttggggatggaaacttaggtggactgtggcgctgctcctggctgcggcgggtaccgcagtgggtgatcggtgcgagcggaatgagttccagtgccaagacggaaagtgcatttcgtacaagtgggtctgcgacgggtcagccgaatgtcaagatgggtctgatgaatcccaagaaacctgcctttccgtgacgtgtaagagcggtgatttctcatgcgggggacgggtgaatagatgtatacctcagttctggcgttgtgacggacaagtggactgcgataatggctcggatgaacaaggctgccctcctaagacctgctcacaagacgaatttagatgccacgatggaaaatgtatttcccggcaatttgtgtgtgacagcgatcgggactgccttgatggatcggacgaagcatcctgtcccgtgctgacctgtggtccagcatcgtttcagtgtaatagctcaacttgcatccctcagctgtgggcatgcgataacgaccctgactgcgaggatggttcagatgaatggcctcagagatgtcgcggtctgtatgtgtttcagggagattcatcgccatgctccgcgtttgaattccattgcctgtcaggagaatgtattcatagcagctggcgctgtgacggtggaccggactgtaaggataagagcgatgaagaaaactgtgcagtcgcaacttgtagaccagatgagttccaatgttcggatggaaactgtatacatggctcgagacaatgcgatcgagagtacgactgtaaagacatgtcggatgaagtggggtgtgtcaatgtcactctgtgtgaaggacccaataagtttaagtgccatagcggtgaatgtataaccctggacaaggtgtgcaacatggcgcgagattgtagagactggtcggatgagccaattaaggaatgcggaactaacgaatgtctcgacaataatggaggatgttcccacgtctgtaatgatctcaaaatcggatacgaatgtgactgtcctgatggatttcaactcgtggcacaacgaagatgtgaggatattgatgaatgccaagatccagatacttgctcacagctgtgtgtgaatctcgagggagggtacaaatgtcaatgtgaagaaggattccagctcgatccacataccaaggcatgtaaggcagtgggatcgatcgcatacctgtttttcaccaaccggcatgaagtgcggaaaatgactctggataggtccgaatacacttccctgattccaaaccttagaaatgttgtcgcacttgataccgaggtggcctcgaatcgaatctactggtccgatctgtcgcaacgcatgatctgtagcacccaactggacagagcgcatggggtgtcgtcctacgatacggtgattagcagggatatccaagccccggatggattggcagtcgactggatacattcgaacatttactggaccgattcggtccttggaactgtctccgtggccgatactaaaggagtgaagagaaagacccttttccgggaaaacgggtcaaagcccagagccatcgtggtggatcctgtgcacggcttcatgtactggaccgactggggaactccagcaaagattaagaaaggggggcttaacggtgtcgatatctacagcctggttactgagaacattcaatggcctaatgggatcactctggacctgctgtccggtcgactgtactgggtggattccaaactgcattcgatttcgtcgattgacgttaacggcggaaatcgcaaaaccatactggaagatgaaaagcgtctcgcacatcccttctccttggcggtgttcgaggacaaggtcttttggacggatatcataaacgaagcaatctttagcgcaaacagattgactggatcagatgtcaacttgctggcagaaaacctgctttccccggaagatatggtgctttttcacaacctcactcagccccggggtgtgaactggtgtgagagaaccacgctgtccaacggaggctgccagtacttgtgcctgcctgcacctcagataaatccccattcccctaaattcacctgtgcgtgcccagatggaatgcttcttgcaagggatatgcgttcctgtcttaccgaagccgaggctgcagtggccacgcaggaaacttcgaccgtcagactcaaggtgtcatcgactgcagtccgcacccagcataccaccacccgtcccgtcccagacacctcaaggttgccaggcgcaaccccaggcttgactacggtcgagatcgtcaccatgtcacaccaggcactgggagatgtggcaggacgaggtaacgaaaagaaaccatcgtctgtgcgggcactgtcgattgtgctccctatagtgctgcttgtctttctctgtcttggagtgtttctgctttggaaaaactggaggcttaagaacattaactccataaacttcgataacccagtgtaccagaaaacgactgaggacgaagtgcacatttgtcacaatcaagatggatacagctatccatcgcgccaaatggtgtcgcttgaagatgatgtggcg

SEQ ID NO: 298 - DNA, 2580 bp, Artificial Sequence
  Description of Artificial Sequence: Synthetic Transcript Sequence
atgggaccctgggggtggaaactgcggtggaccgtggctctgctgctggccgctgccggcaccgccgtgggagaccgctgtgagaggaatgagttccagtgccaagacgggaaatgtatttcttataaatgggtgtgtgatggctcagcagagtgccaggacggttccgatgaatcacaggagacctgtctgtctgtgacctgcaagagcggggatttcagctgcggaggccgcgtgaataggtgtattccacagttctggaggtgcgacggccaggttgactgcgataatggctccgacgaacagggctgcccacctaaaacatgcagccaggatgaattccgatgccatgacggaaaatgcatttctcggcagtttgtatgcgactccgatagggactgcttagacggaagcgatgaggccagctgtcccgtgctcacctgcggtcccgcttcattccagtgcaattcctcgacttgtatcccccaactgtgggcttgtgacaatgaccccgactgcgaggacgggagtgacgagtggccacaacgctgtcggggactttacgtgttccagggggattcttccccctgttccgcctttgaattccattgcctatccggagagtgcattcatagttcttggagatgtgatggcggcccggactgtaaggataaatctgatgaagagaattgcgcagttgctacctgcaggccggatgagtttcagtgctccgatgggaactgtatccatggaagccggcagtgcgatagagagtacgactgcaaggacatgagcgatgaggttggttgcgtgaacgtaaccttgtgcgaggggcccaataaatttaaatgtcactcgggcgagtgtattactctcgacaaagtttgcaacatggctagggactgtcgtgattggagcgatgagcccattaaggaatgtgggactaacgaatgcctggacaacaacggaggatgttctcacgtgtgtaatgatctcaagatcggatatgagtgcgattgccctgatgggttccagctggtggcccagcgaagatgcgaggatatcgacgaatgtcaggaccctgacacatgttcccagctctgcgttaaccttgaagggggttacaaatgtcagtgcgaagaaggcttccagctggacccccatactaaggcctgcaaggcagtggggagtattgcatatctttttttcactaaccgccatgaggttcgaaagatgacattggatcgatccgagtacacgagcttgatcccaaacctgcgcaatgttgtagctttggacacggaagtcgccagcaacagaatttactggtcagacttgagccaaagaatgatctgtagcacgcagttagaccgcgctcacggggtgtcgagctacgacaccgtgatatctcgggatatccaagcccccgacggactcgcggtggactggatccacagtaacatctactggactgatagcgtcttgggtacagtctccgttgccgacactaagggcgtgaagcgcaagactctttttcgtgaaaatggatcgaaacctcgagcaatcgtcgtcgatcccgtgcacggattcatgtattggacagactggggtacgcccgcaaagattaaaaagggcggactcaatggggtggacatctactccctggttacagagaatattcagtggcctaatgggataacactcgacttacttagcggcaggctgtattgggtagatagtaagcttcacagcatcagtagtattgatgtgaacggaggtaatcgcaagactattctcgaggatgagaaacggctcgctcacccgttttccctcgcggtgtttgaggataaggtgttttggactgatatcattaacgaggccattttcagcgccaaccgccttactggaagcgacgtgaaccttttagccgagaacctcctcagccccgaggatatggtcctgtttcacaatctgacccagcccaggggagtcaactggtgcgagaggacaacactgtctaacgggggctgccagtacctgtgcttgcccgccccccaaattaacccccactcacctaaatttacttgtgcctgtcctgatggcatgctgttggccagggacatgcggagctgtctgacagaagctgaagctgccgttgctacccaggagacttctacagtgcgcctgaaagtgagtagtaccgctgtcaggacacagcacacaactactagacccgtccccgataccagcaggttgcccggggcaaccccaggattaacaaccgttgagattgtaaccatgtcgcatcaagcactcggtgacgtggccggcagaggtaatgagaagaaacccagcagcgtccgcgccttgagcatcgtcctgcctattgtgctcctcgtctttctatgcctaggagtctttctactgtggaagaattggagactgaaaaacatcaattctatcaatttcgataaccccgtataccagaagaccaccgaagatgaagtccacatttgccataatcaggacgggtactcttatccctccagacagatggtatcactagaggacgatgtggcg

SEQ ID NO: 299 - DNA, 2580 bp, Artificial Sequence
  Description of Artificial Sequence: Synthetic Transcript Sequence
atgggaccatggggttggaaacttcgttggacagtagctctccttcttgcagctgcaggaactgcagttggagatagatgtgaaagaaatgaattccaatgtcaagatggaaaatgtattagttataaatgggtatgtgatggatctgcagagtgtcaagatggatctgatgaaagtcaagaaacatgtttgagtgtaacatgtaaatcaggtgacttttcttgtggtggaagagttaatagatgtattcctcaattttggagatgtgatggacaagttgactgtgataatggttcagacgaacaaggatgtccaccaaaaacttgttcacaagatgaatttagatgtcatgatggaaaatgtatatcccgtcaattcgtttgtgattcagatagagattgtttagatggtagcgatgaagctagttgtccagttttaacttgtggaccagcatcttttcaatgtaatagctcaacatgcattccacaactttgggcatgtgataacgatccagactgtgaagatggatctgatgaatggccacaaagatgtagaggactttatgtttttcaaggagatagttctccatgtagtgcattcgaattccattgtttgagtggtgaatgtatacattcatcttggaggtgtgatggaggaccagattgtaaagataaaagtgacgaagaaaattgtgctgtagctacatgtagaccagatgaatttcaatgctcagatgggaattgtattcatggatctagacaatgtgatagagaatatgattgtaaagacatgtctgacgaagttggttgtgttaacgtaacattatgcgaaggtccaaataaatttaaatgtcattctggagaatgtatcacactcgataaagtttgtaatatggctagagattgtagagattggtcagatgaaccaattaaggaatgtggaactaacgaatgtcttgataataatggaggttgttcacacgtttgtaatgatcttaagattggatatgaatgtgactgtccagatggttttcaacttgttgcacaacgtagatgtgaagatattgatgaatgtcaagatccagatacatgtagtcaattatgtgttaatttagaaggaggttataaatgtcaatgtgaagagggttttcaattagacccacatacaaaggcatgtaaagcagtgggatctattgcttatctttttttcactaatagacatgaagtcagaaaaatgactttagatagatccgagtatacctctttaataccaaatttaagaaatgttgttgcccttgataccgaagttgcatcaaatcgtatttattggtcagacctttcacaaagaatgatttgttcaacacaacttgatcgtgctcatggagtatcttcttatgatacagtaatttctcgtgacatacaagcaccagatggattagctgtagattggattcatagtaatatttattggacagattcagttttaggaactgtttcagttgcagacactaaaggagttaagagaaagacattattcagagaaaacggttccaaaccacgtgcaattgttgtagatcctgtacatggatttatgtattggacagattggggtactcctgctaaaattaagaaaggaggtttaaacggagtagatatctattcacttgttacagagaatattcaatggccaaatggaataacacttgacttattgagtggacgactttattgggttgacagtaaattgcattcaatttctagcattgatgttaatggaggaaatagaaagacaattttggaagatgaaaaaagacttgctcatccattctcattagcagtttttgaagataaagttttttggacagatataattaacgaagcaattttttcagctaatagacttacaggatcagatgtaaatttattagctgaaaatttacttagtccagaagatatggttttatttcataatcttacgcaaccaagaggggttaattggtgtgaaaggactactctttcaaacggtggttgtcaatatttatgtcttccagctccacaaattaatccacattcaccaaaatttacatgtgcatgtccagatggaatgttacttgcacgagatatgcgtagttgtttaacagaagctgaagctgcagttgcaacacaagaaacttcaacagtaaggttaaaggtaagttcaactgctgttagaacacaacatacgacaacaagacctgttccagatacatcaagattacctggagctacgccaggattaacaactgttgaaattgtcactatgtcacatcaagcccttggagatgttgctggacgtggaaatgaaaaaaaaccttcttctgttagagcacttagtattgttttaccaattgttcttttagtcttcttatgtttaggtgtttttcttttgtggaagaattggagacttaaaaatattaacagtataaattttgacaatccagtatatcaaaaaacaactgaagatgaggttcatatttgtcataatcaagatggatattcatatccttcaagacaaatggtttcattagaagatgatgttgct

SEQ ID NO: 300 - DNA, 2580 bp, Artificial Sequence
  Description of Artificial Sequence: Synthetic Transcript Sequence
atgggaccgtggggatggaagttgagatggaccgtggcccttttgctggcagccgccggcactgctgtgggagacaggtgcgagcggaacgaatttcagtgtcaagatggcaagtgcatatcatacaaatgggtctgcgacggatcggctgaatgccaagatggctccgacgaatcccaggaaacttgcctgtccgtgacctgcaagtcgggcgacttcagttgcggaggtcgagtgaaccggtgcatcccgcaattctggcgttgcgacggacaggtagattgcgacaacggtagcgatgaacagggttgtccgccaaagacgtgctctcaagatgaattccgctgccacgacggaaaatgcatcagcaggcagttcgtgtgcgactcggaccgcgactgtcttgatggaagcgatgaagccagctgcccggtcctgacttgtggaccagcctcattccagtgcaacagctccacgtgcatcccacaactttgggcttgtgataacgaccctgactgtgaagatggcagcgatgagtggcctcagcgctgtagaggactttacgtctttcagggtgacagcagcccatgctcggccttcgaattccactgcctctcgggggaatgcatccactcctcatggcggtgcgacggagggcccgactgcaaggataaaagcgacgaagaaaactgcgccgttgccacttgcaggccggacgagtttcagtgctcggacggcaactgcatccacggaagccgccagtgcgacagggagtatgattgcaaagacatgtccgacgaggtcggatgcgtcaacgtcactctgtgcgagggaccgaataagttcaaatgtcattccggagaatgcatcactctggacaaagtgtgtaatatggcccgagattgccgcgactggtctgatgaaccgatcaaggaatgcggaactaacgagtgtctggacaataatggtggatgtagccatgtgtgcaatgacctgaagattggatacgaatgtgactgtccggatgggttccagctcgtggcgcagagacggtgcgaagatatcgacgagtgtcaggatccggacacctgctcgcaactctgcgtgaatcttgagggaggctacaagtgccaatgcgaagagggattccaactggacccccataccaaggcgtgtaaagcagtcgggtcgattgcctacctgtttttcacgaatcgccacgaggtgcgcaagatgaccctggatcggtcggagtacacctcgctgatcccgaacctccggaacgtggtggcactcgacaccgaagtcgcatccaatcgcatctactggtcagatctgtcacagcgcatgatctgctccacccaacttgatagagctcacggtgtgtcgtcatacgacaccgtgatcagcagagacattcaagccccggacggcctggcggtggactggatccattcaaatatctactggaccgacagcgtcctgggaaccgtgtcggtcgccgatactaagggcgtcaagcgcaagactctcttccgcgagaatggaagcaaaccccgggccatcgtcgtggatcctgtgcacggattcatgtactggactgattggggaaccccggcgaagatcaagaagggcggcctgaacggcgtggacatctactcactggtgaccgagaacattcaatggcctaacggcattactctggacctgctctcgggacggctgtattgggtggactccaagctccactcgatctcctccatcgacgtgaacggggggaacagaaagactattctggaagatgagaagcggctggctcatcctttctcactcgcggtgttcgaggataaggtgttctggactgacatcatcaatgaggcaattttctccgccaatcgcctgactggttccgacgttaacctgctggcagagaacctgctcagtccggaggacatggtgttgtttcacaacctgacgcaaccacggggtgtgaactggtgcgaacggactaccctgagcaacggaggctgtcagtacctctgcctcccggcaccccaaatcaacccacattcaccaaagtttacttgtgcgtgcccggacggtatgctgctggcgagagacatgagatcctgcctcaccgaagcagaggcagccgtcgctacgcaggaaacctccactgtccggttgaaggtgtcgtcaaccgccgtgcggacccagcatacgaccactcgccctgtcccggatacttcgaggctcccgggggccaccccagggttgaccaccgtcgaaatcgtgactatgtctcaccaggctctgggagatgttgcgggacgcgggaacgagaagaagccatcgtcagtgcgcgcgttgtcgatcgtgctcccaatcgtgctgctggtgttcctctgtttgggagtgttcctcctttggaaaaactggaggctcaaaaatatcaactcgatcaattttgacaaccccgtgtaccagaaaaccaccgaagatgaagttcacatctgccataatcaggacggctactcatacccttccagacagatggtgtccctggaggatgatgtcgcg

SEQ ID NO: 301 - DNA, 2580 bp, Artificial Sequence
  Description of Artificial Sequence: Synthetic Transcript Sequence
atgggtccctggggatggaagctcagatggacagtggcccttcttttagccgccgcaggaaccgctgtgggtgatcgctgtgagcggaacgaattccaatgccaggacggaaagtgcatctcttataagtgggtttgcgacgggagcgcagagtgtcaggacggatcggatgagtcacaggaaacttgcttgtccgttacttgcaaatccggggattttagttgtggagggagggtgaacagatgtattcctcagttttggcgctgtgacggtcaggtggactgtgacaatgggtcggatgaacaaggctgccccccaaaaacctgcagccaggatgagtttcggtgtcatgatgggaaatgtatctcccggcagttcgtctgtgactcagaccgcgactgccttgacggttcagatgaagccagctgtccagttctgacttgcgggccagcgagcttccagtgtaactcatccacttgcattccacagctatgggcctgtgataacgatcctgactgtgaggatgggagtgatgagtggccccagaggtgccggggactctatgtgtttcagggggattcaagtccctgctcagccttcgagtttcattgcctctcaggagagtgcatccatagttcctggaggtgcgatggaggcccagactgcaaggataagagtgatgaggagaactgtgccgtggcgacatgccgaccagatgagtttcagtgtagtgacggaaattgtatccacggctccaggcaatgtgaccgagagtatgactgcaaagacatgagtgatgaggtcggctgcgtaaatgtcactttgtgcgaggggccgaacaagttcaaatgtcatagcggtgagtgtattactctcgacaaggtgtgcaacatggcaagggattgtcgggactggagcgacgaaccgatcaaagaatgcggcaccaacgagtgtctggacaataatggaggatgtagccatgtctgcaacgatctgaagatcggatatgagtgcgactgcccagacggctttcagcttgtcgcacaaaggcgctgcgaagacattgacgaatgccaagatcccgacacctgtagccagctgtgcgtgaacctggaaggtggatataagtgccagtgcgaggaagggtttcagctggaccctcacaccaaagcatgcaaggccgtcgggtccattgcatatctgtttttcacaaaccgccatgaagttcggaaaatgaccctggacagatccgagtatacctctctgatccctaacctgagaaatgttgtggcattagacaccgaggtggcttccaaccgaatctattggagcgacttgtctcagcgaatgatatgctcaacgcagctggacagagcccacggagtcagtagctatgataccgtcatttccagggatattcaggctccagacggtttggccgttgattggatccacagcaacatatactggactgattctgtcctcggcacagtgtccgtggctgatacaaagggagtcaagcgaaaaacgctatttcgtgagaacggttctaaacccagagccattgtggttgatcccgtccatgggttcatgtactggacagactggggaacccccgccaagattaagaagggtggcttaaacggcgtcgatatctactccttagtcacggagaacatccagtggccgaatgggataactctggatctgctgtctgggagactgtattgggtggactcaaagcttcactctatctcaagcattgatgttaacggtgggaatcgaaagacgatcctggaggatgagaagcgtctggcacaccccttttctctcgccgtttttgaagacaaagtgttctggaccgatattatcaacgaggctatcttcagtgcaaatcggctgaccgggagcgatgtgaacctgctcgccgaaaatcttctttccccagaagacatggttctctttcataatttgacacagccacgcggagtcaactggtgtgagcggactactctgtccaatggcggctgccagtacttgtgcctgccggcaccgcagattaacccgcattcacctaagtttacctgtgcctgtccggatgggatgcttttggctagagatatgagatcctgcctgacggaggcagaggctgcagtggcgacacaagagaccagcactgtgcggctgaaagtgagtagcaccgccgtgcggacccagcatacaaccactcgacccgttcccgacaccagtaggctccccggcgctacacccgggcttaccactgtagaaatcgtgactatgtcgcatcaggccttgggtgatgttgcagggcggggaaacgagaagaagccctcatccgttagagctctatcaatcgtgctgccaatagtcctcctcgtgttcctctgcctgggggtctttctgctgtggaagaactggaggctgaagaacattaacagcatcaattttgacaatccggtttaccagaaaactacagaggacgaagtgcacatttgccataatcaggacggatacagttacccaagcaggcaaatggtcagcttggaggacgatgtggcc

SEQ ID NO: 302 - DNA, 2580 bp, Artificial Sequence
  Description of Artificial Sequence: Synthetic Transcript Sequence
atggggccctggggctggaaactgagatggaccgtggccctcctgctcgcggcagccggaaccgccgtcggggaccgctgcgagcggaacgaattccagtgtcaagacggaaaatgtatcagctacaaatgggtgtgtgacggctctgctgagtgccaggacggcagcgacgagagccaagagacctgcctctccgtgacctgcaagtcaggggatttttcctgcggaggacgtgtgaaccgctgtatcccccagttctggcgctgcgatggtcaggtggactgcgacaatggatccgacgaacagggctgtccgccaaaaacgtgtagccaggatgagtttcggtgccacgacggtaagtgtatcagccgacagttcgtgtgtgactcagaccgggactgcctcgacgggagcgacgaagcctcctgccccgtattgacttgcggacccgcaagttttcaatgcaatagcagcacctgtatcccccagctctgggcctgcgacaatgatcccgattgcgaagacggaagtgatgagtggccccagcggtgcaggggcctgtacgtttttcagggagactcgtcgccttgtagtgccttcgagttccactgcctgagtggcgagtgcatccattccagttggagatgcgatggaggaccagattgtaaggataagtccgacgaggagaactgtgcggtcgcgacatgtcgcccagacgaattccaatgctccgacggtaattgtatccacggctctcgccaatgtgaccgggaatacgactgtaaagacatgtcagacgaagtgggatgtgtcaatgtgactttatgtgagggccccaataaattcaaatgccactctggagagtgtattaccttggacaaggtgtgcaacatggcaagagattgccgggactggagtgacgaaccaataaaggagtgtggcacaaatgagtgtctggataacaacggtggctgctcacacgtgtgcaacgatctcaaaattgggtatgaatgcgattgcccagatggctttcagctcgtggcacagaggcggtgtgaagacatcgatgagtgtcaggatcctgacacctgttcccaattatgcgtgaacttggagggaggctataagtgccaatgtgaagagggctttcagttggatccccacaccaaggcttgtaaagcggtcggctcgatagcttatttgttttttaccaaccgtcatgaggtaagaaagatgaccctggaccggtcggaatacactagcttgatccctaacctccgcaacgtggtcgcactggatacagaggtggcctctaataggatctattggagcgacttgagccagcgcatgatttgctctacacagttggatcgggcccatggggtgtcctcctacgatacggtgatttctagggacatacaggcgccagacggacttgcagtggattggatccactctaatatctactggaccgatagcgtactgggtaccgtgagcgtggccgataccaagggagtgaaacgtaaaaccctgttccgggaaaatgggtcaaagcctcgagctattgtggttgaccctgtgcatggatttatgtattggactgactggggcactcccgctaaaattaaaaagggtggcctcaatggtgtcgacatttacagcctggtcacagagaatatccagtggcctaatggaataacccttgatctgctaagtgggcggttgtattgggtcgattcgaagttacactcaatttcaagcatcgatgtgaatgggggaaaccggaagacaattctcgaagatgagaaacgactcgcccaccccttctcactggccgtattcgaagacaaagtgttttggaccgatattattaacgaggctattttctctgccaacagactaaccggctctgacgtaaatctgctagcagagaacttgctatctcccgaggatatggtccttttccataatctgacgcagccacgcggcgtgaactggtgcgagagaacaaccctgtccaacgggggctgtcaatacctctgcctcccggcgcctcagatcaatcctcactcaccgaagtttacctgtgcctgccccgatggcatgcttctggcccgggacatgcgtagctgtctcaccgaggccgaagctgccgtggccacccaggaaacctcaacagtacgactgaaggtgtctagtacggctgtcagaacacagcacacaacaacccgcccagtgccggatacttcacggctacccggggccacacctggtttgactacagtcgagattgtaacaatgtcccatcaagccttgggagatgtggcaggtagggggaatgagaagaagccatcctccgtccgggccctgtctatcgtgctgccaatcgtactgttggtgttcctatgccttggagtgtttctcctgtggaagaactggagactcaaaaacatcaattctataaattttgataacccggtgtaccaaaagacaaccgaggacgaggtgcatatctgtcataatcaggacggttactcttatccgagtcgccaaatggtgtctcttgaagacgacgtcgcc

SEQ ID NO: 303 - DNA, 2580 bp, Artificial Sequence
  Description of Artificial Sequence: Synthetic Transcript Sequence
atgggaccgtggggatggaaattgaggtggaccgtcgcccttctgctcgcggctgctggcacggctgtcggcgaccgctgcgaacgcaatgagtttcaatgccaagacgggaagtgcatctcatacaagtgggtctgcgacggatcagcggaatgccaagatgggtcggacgaatcgcaggaaacctgcctctcagtcacctgtaagtcgggcgatttcagctgcgggggccgggtgaaccgctgcatcccccaattctggcggtgcgacgggcaggttgactgcgacaacggttctgacgaacaaggctgccctcctaagacctgttcccaggatgaattcaggtgccatgatggaaaatgcatctcgcgccaattcgtgtgcgattccgacagagactgtctggatggaagtgacgaggcatcgtgcccagtcctgacttgcgggccggcttccttccagtgcaactcgtcaacttgtatcccgcagttgtgggcctgtgataacgaccccgattgcgaggacggctcggatgaatggcctcagagatgccgtggactgtacgtttttcaaggtgattcttcaccgtgcagcgcttttgagttccattgtctgtcaggcgaatgtatccactcgagttggcgatgcgacggcggacccgactgtaaggataagtcagacgaggagaattgcgccgtggccacttgccgcccggacgagtttcagtgctcagatggaaactgtatccatggatcacgccagtgcgaccgcgaatacgattgtaaggatatgtctgatgaggtcggctgcgtgaatgtgaccctgtgcgaaggtccgaacaagttcaaatgtcacagcggagaatgcattacgctcgataaggtgtgtaacatggcccgggattgtcgcgattggtcggacgagccaattaaggaatgcggtacgaatgagtgcctggacaataacggaggttgttcgcacgtgtgcaatgacctcaagatcggatatgagtgcgattgcccggacggattccagctggtggcacagcgcagatgcgaggacatcgatgaatgtcaggatccagacacttgttcacagctgtgcgtgaacctcgaaggaggctacaaatgtcagtgcgaagagggattccagctcgacccacacaccaaagcctgcaaggcggtggggagcatcgcctacctgttcttcaccaatcgccacgaagtgcgcaaaatgaccctggatcggtccgaatacacgtccctcatccctaatctgcgcaatgtggtggctctggacaccgaggttgcaagcaaccgcatctattggtccgatctgtcgcagcggatgatctgctcgactcagctggaccgcgcgcacggcgtgagttcctacgatactgtaatctcgcgggacatccaagcgcccgacgggctggcggtggattggattcacagcaacatttactggaccgactcggttcttggcactgtgagcgtcgcggacaccaaaggagtcaagcgcaagacgttgtttcgggagaacggaagcaaaccgcgcgccatcgtggtggatccagtgcatgggttcatgtactggactgattggggcaccccggccaagatcaagaaaggtggattgaacggagtggacatatactccctcgttaccgagaatatccaatggccgaatggaattactctggaccttctcagcggacggctgtactgggtcgactcgaaactccattcaattagttccattgatgtgaacggaggaaacagaaaaaccatcctggaagatgagaagagactggcgcatccgttttccctggccgtgttcgaggacaaagtgttctggaccgacatcatcaacgaggcgatcttctcggcgaatcggctgaccggatcggacgtgaaccttctggccgagaaccttctgtccccggaggatatggtgctgtttcacaatctcactcagccacggggggtgaactggtgcgaacggactaccctctccaatggtggatgccagtacctgtgcctgccggctccgcaaatcaatcctcactcacccaagttcacttgcgcctgccctgacggaatgcttttggcgagggacatgagatcgtgcctcactgaagcagaagccgcggtggccacccaggaaacgtccactgtgagactgaaagtgtcgtccactgctgttagaacccagcacactaccactcgccccgtcccagacacttcgagattgccaggtgctaccccgggactcactaccgtcgaaatcgtgaccatgtcgcatcaggctctcggggacgtcgccggacgtggaaatgaaaagaagccttcctcggttagagccctgtcgattgtgctgccgatcgtgctgctcgtattcttgtgcctgggagtgttcctgctctggaagaactggagactgaagaacatcaattcgatcaactttgacaatccagtgtaccagaaaactactgaagatgaagttcacatctgtcataatcaggacggatactcatacccttcgagacaaatggtgagcctcgaggacgacgtcgct

SEQ ID NO: 304 - DNA, 2580 bp, Artificial Sequence
  Description of Artificial Sequence: Synthetic Transcript Sequence
atgggaccctggggctggaagctgagatggactgttgccctgctcctcgctgcagcgggtacagctgttggggaccggtgtgagcgtaacgagtttcagtgtcaggacggaaaatgcatttcctataaatgggtgtgcgatggaagtgccgaatgccaggatgggtcagatgaatctcaggaaacctgtttgagcgtgacatgcaagagcggcgacttctcatgtgggggaagagtgaaccggtgtatcccccaattttggcgttgtgatggacaggtggactgcgataacggaagcgatgaacaaggctgcccgcctaaaacctgtagccaagatgagttccggtgtcacgacggaaaatgcatctctagacagtttgtatgcgacagcgatcgggactgtctcgatggctcagacgaagcctcttgcccagtgctgacttgcggcccagcatccttccagtgcaacagcagcacttgtattcctcagctgtgggcatgtgacaacgatccagattgcgaggacggaagtgatgagtggccccaaaggtgtcggggactttatgtcttccagggggactcctctccctgcagtgcctttgaattccactgtctctcgggagagtgcatccactcaagttggcgttgtgacggcggccctgattgtaaagataagagcgatgaggagaattgtgctgtagctacttgtcgtcctgatgaatttcagtgttccgacggcaattgtattcatggcagcagacagtgcgacagggaatacgattgcaaggatatgtcagatgaagtaggatgcgtgaatgtgaccttgtgtgaagggcctaacaaatttaagtgccattccggcgaatgtataaccctggacaaagtttgcaacatggccagggattgcagagattggtcagatgaacccattaaggaatgtggcacaaacgagtgcttggataacaatgggggttgttcccacgtttgtaatgacttgaaaatcggatatgagtgcgattgcccagacggatttcagcttgtggcccaacgccggtgtgaagacatcgacgaatgccaggaccccgacacatgctcccaactgtgtgtcaatcttgagggagggtataagtgtcagtgcgaggagggtttccagctggaccctcataccaaggcgtgcaaggccgtcggtagcatagcctatttgttctttaccaacagacatgaggtacggaagatgacactcgacaggtcagagtacaccagccttattcctaaccttagaaacgtggtggctctggacacggaagtcgccagcaatcgaatctactggtcagacttatcccagcgaatgatatgctcgactcagctggatagagctcatggtgtgagctcctacgatacagttatctcccgcgatatccaggctccagacgggctcgccgtcgattggatacattctaacatatactggaccgactccgttctggggacagtttccgtcgctgacaccaagggggtgaaacgcaaaacgctctttcgggagaatggaagtaaaccacgcgcgatcgtcgtggatcctgtgcacggctttatgtattggacagactggggaacccctgccaagattaaaaaaggtggcctcaacggcgttgacatttatagcctggttactgaaaatatccagtggccaaacggcattactctcgatctcctgagcggccgcctctactgggtggactcaaagttacattcaatcagcagcatagatgtgaatggcggtaatagaaagaccattctcgaagatgaaaagcggcttgctcatcctttttcgttggccgtgtttgaggataaggtattctggacagatattatcaacgaggccatcttttccgccaataggctcaccgggtccgatgtgaaccttctagccgaaaacctactttccccagaggacatggtcttatttcacaacctgacccagccccgaggagtgaattggtgcgaaaggacaacactgtccaacgggggctgccaatacctttgtctgcctgccccacagatcaacccacattcccctaaatttacttgcgcctgccccgatggaatgctgcttgctcgcgacatgcggagttgcctgaccgaagctgaagctgcagtcgccacccaggagacctccaccgtgagactgaaggtgtcatctaccgccgtacggacacaacatacaacaactcgtcccgtcccagatacttcccggttgccaggcgctacacccggactgactaccgtggaaatcgtcacaatgagtcaccaggcactgggagatgttgctgggcggggaaacgagaaaaaaccttccagtgttagggcactgtctatagtgcttccgatcgtgcttctggtgttcttgtgcctgggcgtgtttctgctgtggaaaaattggcgcttgaaaaacattaattctattaattttgacaaccctgtgtaccagaaaacaactgaagacgaggttcatatctgccacaaccaggacggctattcttacccttcaagacagatggtatctctggaggacgatgtcgca

SEQ ID NO: 305 - DNA, 2580 bp, Artificial Sequence
  Description of Artificial Sequence: Synthetic Transcript Sequence
atgggcccatggggatggaaactcaggtggaccgtggctctcttgctggcagccgcggggaccgcagtgggtgacagatgcgaacgaaacgagtttcagtgtcaagacggcaagtgcatcagctacaaatgggtgtgcgacgggtccgctgaatgtcaagatggaagcgacgagtctcaggagacatgtctaagcgtgacctgcaagtctggcgacttttcttgcggtggtcgtgtgaacaggtgcattcctcaattctggcgttgcgacggccaggtcgattgtgacaacggttcagacgagcagggatgcccacccaagacgtgtagccaggatgagttccgttgccatgacggtaaatgcatatcaaggcagtttgtgtgcgatagcgaccgcgattgtcttgacgggtccgatgaagcttcttgcccagtgctgacttgcgggccagccagtttccagtgcaattcgagcacatgcattccacagctttgggcctgtgataatgaccccgactgcgaagacggctctgatgaatggccgcagagatgtagaggactctatgtctttcaaggcgattcgagtccttgtagtgcgttcgaatttcactgcctgtctggagaatgcatccattcatcatggaggtgcgacggcggtccggactgcaaggacaagagcgacgaagaaaattgcgcggtcgcgacatgcaggcccgatgaattccagtgtagcgacggtaactgtattcatgggtcccggcagtgcgaccgtgagtacgattgcaaagatatgtcagacgaagttggatgtgtgaacgtgacactgtgcgaagggcccaacaagtttaaatgccattcgggagagtgcataaccttggacaaagtttgtaacatggcacgagactgccgagattggtcagacgaaccaattaaagagtgtggcacaaacgagtgtctagataacaacggggggtgtagccatgtctgcaacgatctaaagattgggtacgaatgtgactgtcccgacggtttccagttggtagctcagcgacggtgcgaggacatagacgaatgccaagatccagacacttgctcacaactgtgcgtaaatttagaaggaggatataagtgccagtgtgaagaaggtttccagttagacccccacacaaaggcctgcaaggctgtcggctcgattgcctacctcttttttacgaaccgtcatgaggtgcgtaaaatgacattggatcggtcagaatatacttccctcatccctaacctgcgcaatgtcgtcgcgctcgatactgaggttgccagcaacagaatctactggtccgacctgtcacagaggatgatttgctctactcagttggacagagcgcatggagtgtccagttatgacacagtgatctctcgggatattcaggcccctgacggtctggcagtggattggatccattcaaacatctactggaccgattccgttctcggtacagtgtcagttgctgatactaaaggcgttaagaggaaaactttattcagggagaatggatctaaaccccgcgccatcgtcgtggatcctgtacatgggtttatgtactggactgactggggcacacccgcgaaaataaaaaaaggggggctgaacggcgtggacatctattctctggtcacggaaaatatccagtggcccaatggaatcactctggacttactctccggacgactttactgggtggacagcaaactgcatagtatttcaagcattgacgttaatggaggaaacaggaagacgatcctcgaggacgagaaaaggctggcgcatccctttagtcttgctgtatttgaagataaggttttttggaccgacataataaacgaggctatatttagtgcgaacaggctgacagggtccgatgtaaatcttttagctgagaacctgctcagcccagaagacatggtgctctttcacaacttgacccagcctcgaggggtgaactggtgtgagcgaacgactttgagcaacggcggctgccagtacctgtgcttgcctgccccacagatcaaccctcacagccctaaatttacctgcgcatgcccggacggtatgttgctggcccgagacatgaggtcatgcttaacagaagcggaagccgcggttgctactcaggagacctctactgtgagactgaaagtgtcctctaccgcggttcgcacccaacataccaccacccgaccagtgccggatacttcacgactgcctggcgccacacctgggctgactaccgtggagattgtgacgatgtcacaccaggccctgggtgatgtagccggcagaggaaatgagaaaaaaccctcatccgtccgagcactgtccatcgtgcttcctatagttttgctggtgtttctctgcctgggtgtgtttctgctgtggaaaaattggaggctgaaaaacataaattcaattaatttcgacaaccccgtgtaccaaaaaactaccgaagacgaagtgcacatttgccataatcaagacggatacagttatccatctagacagatggttagtttggaggacgatgttgct

SEQ ID NO: 306 - DNA, 2580 bp, Artificial Sequence
  Description of Artificial Sequence: Synthetic Transcript Sequence
atgggaccctgggggtggaaactcaggtggactgttgccctcctgcttgcagccgccgggactgcagttggcgatcggtgcgagcgcaacgagttccaatgccaagatggtaaatgtatttcgtataagtgggtttgcgacggttctgctgagtgccaggatggatcggatgaatcccaggaaacttgcctgagtgtaacctgcaaatctggtgatttttcctgcggagggagagtgaatagatgcattccccagttttggaggtgtgatggccaggttgactgtgacaatggatcagacgaacagggctgcccgcccaagacgtgctcccaggatgaattccgctgccatgacggtaagtgcatttcacgccagttcgtgtgtgacagtgacagagactgcctcgacggctccgatgaagcgtcctgtccagtcttaacatgtggtccagcatcattccagtgtaattcaagtacttgcataccccaactatgggcttgcgataacgaccccgattgcgaagacggaagtgacgaatggccccagcggtgtagagggttgtacgtgtttcagggtgattcaagcccatgctctgcattcgaattccactgtctgagcggggaatgcatccatagttcatggcgctgcgatggaggccccgattgtaaagataaaagcgatgaggaaaactgcgctgtggccacatgcaggcctgatgagtttcagtgtagtgacggaaattgtatccatggatcacggcagtgcgatagggagtacgactgcaaagatatgtccgatgaggttggctgcgttaacgtgacactgtgtgagggacccaacaagtttaagtgtcacagcggggaatgtattactctggacaaggtgtgcaacatggctcgagactgtagagactggagcgatgaacctatcaaggagtgtgggaccaatgagtgtttggacaacaatggagggtgtagccacgtctgtaatgatctgaaaataggctacgaatgcgactgtccggatgggttccagttagtggctcaacggcgatgtgaggacatcgacgagtgtcaggatcctgacacatgcagccaactctgcgttaacctggagggcggctataagtgccaatgtgaggagggctttcaactcgacccccataccaaagcctgcaaggctgtagggtccatagcctatctgttctttactaatcgacacgaggtgcggaagatgaccctggaccgatcggagtacaccagcctgattcccaatttgaggaacgtcgtagccttggacacggaggtcgcctctaataggatctattggagtgacctgagccagcgaatgatctgcagtacccagctggaccgagcccacggtgtgagttcatacgataccgtgatatcccgggacatccaggccccagatggactggccgtggattggattcactctaacatctactggactgactctgtactgggcaccgtgagcgtagctgatacaaagggtgtaaagagaaagactctgtttagggagaatggcagtaagcctagggctattgtagttgaccccgtgcacggattcatgtattggacggattggggtacccccgccaaaataaaaaagggaggactgaacggggtggacatttatagcttagttacggaaaatattcagtggccaaacgggatcacactggatctgctgtcaggccgtctgtattgggtcgactcaaaactgcactcgatctcctcgatcgatgttaacgggggcaacaggaaaactattctcgaagatgagaaaaggctcgcacatccctttagtcttgccgtgtttgaagataaggtgttctggaccgacatcattaatgaggccatctttagtgcaaaccgtttgactgggagcgacgtgaacttactggcagagaacttgctgtcacccgaggatatggttctgtttcataatttaacgcagcctcgcggagtcaactggtgtgaaagaactaccttatcaaacggcggatgtcagtatctgtgccttcccgcccctcagatcaacccccacagtcccaagttcacatgcgcctgtcccgacggaatgctgttggcccgagatatgaggagctgtcttactgaagcagaagctgctgtggctacccaggagacctcgacagtgaggctgaaagtgtcttcaaccgcagttcgaacacagcacacaactacccgcccagtgcctgacacctctcgcctgcccggagcaacgcccggcctgaccaccgttgaaattgttactatgtcacatcaggccttgggggacgtcgccggacggggaaacgaaaagaagccaagctccgttagggccctatctatagtcttaccaattgtgctactggtgttcctgtgtcttggagtgtttctgctgtggaaaaattggcggctgaagaatattaattctatcaatttcgataacccagtgtatcagaagaccaccgaagacgaagtgcacatctgtcacaatcaagatgggtactcctacccctcgcgacagatggttagcctcgaagatgatgtggct

SEQ ID NO: 307 - DNA, 2580 bp, Artificial Sequence
  Description of Artificial Sequence: Synthetic Transcript Sequence
atggggccctggggatggaagctgaggtggaccgtggcactgcttctggcggcagcgggaactgcagtgggagacagatgtgagagaaatgaatttcaatgccaagacggcaagtgcatatcgtacaagtgggtgtgtgacggatccgcagaatgccaggacggttcggatgagtcgcaagaaacttgtctttccgttacctgtaagtcaggcgatttttcatgcggaggccgtgtgaaccgatgtatccctcaattttggcgttgcgatgggcaggtggattgtgacaatggttccgacgagcagggttgtccgcccaagacctgctcgcaagacgaatttcgttgtcatgatggaaagtgcatctcccggcaatttgtatgtgactcagatagagactgtctggatggttccgatgaagcgagttgccctgtgctgacctgtggtcctgcatcctttcagtgtaactcatctacctgcataccccaactttgggcctgcgacaacgatcctgattgtgaagatggatcggacgaatggcctcagaggtgtaggggattgtacgtgtttcagggtgacagctccccatgttccgcctttgaattccattgtctttcgggggagtgtatacattcgtcgtggcgctgcgacgggggccctgattgtaaggacaaatcagatgaggagaactgtgcggtggccacttgtcgacctgatgagtttcagtgttcggatggtaactgcatccatggctcgcgacagtgtgatagagaatacgattgcaaggatatgtcggatgaggtgggttgcgtgaacgttaccctttgcgagggacctaacaaattcaagtgtcattcgggagagtgtattacccttgataaagtgtgcaacatggcacgggattgtagagactggtctgatgaacctattaaggaatgcggtaccaatgagtgtcttgacaacaacggaggatgtagccatgtgtgcaacgaccttaagattggttacgaatgtgattgccccgatggttttcagctggtggcccaaagacggtgcgaggacattgacgaatgtcaggaccctgatacttgttcgcaactttgtgtcaatcttgaaggtggatacaagtgtcaatgtgaagaagggttccaactcgacccacatactaaggcatgtaaggcggtcggatccattgcttatcttttctttaccaacagacacgaggtgagaaaaatgacgctcgatcggtcggaatacacctcgctcatccctaatttgcgcaacgttgtggcactggataccgaggttgcaagcaatcgcatttactggtcggatcttagccaaagaatgatttgctcaacccagttggacagggcgcatggagtgagttcatacgatacggttatttcaagagatatccaggcgcctgatgggctcgctgtggactggattcactcgaacatttactggaccgactccgtgcttggaactgtctccgtcgccgacactaagggtgtcaagcggaaaaccctgttcagagagaatggttcgaagcccagagcgatcgttgtggaccccgtccacggattcatgtattggaccgattggggcacgcctgccaagatcaagaagggcgggctcaatggtgtggacatttacagcctcgtcactgaaaacattcaatggcccaacggtataaccctggacctgctttcgggacgcctttactgggtcgactcgaagctgcactccatctcctcgatcgatgtgaacggaggaaataggaaaaccatcttggaggatgaaaagcggctggcacatccattttccctggcggtctttgaagataaggtcttttggactgatatcattaatgaagcaattttctcagccaaccgattgactggttcagatgtgaaccttctcgcagaaaacctcttgtccccagaggatatggtgctctttcataaccttacccaacccaggggagtcaactggtgtgagagaactacccttagcaacggtggttgtcaatacctgtgccttccggccccccaaatcaacccacattccccaaagtttacttgtgcatgtccagacggaatgctgcttgcccgggatatgaggtcatgccttacggaggccgaagccgcagtggccacccaggagacttcaaccgtcaggcttaaagtgtcctcgaccgcagtgcgaacccaacataccaccactcgtcccgtgccagacacttcaaggctcccaggagccaccccggggcttactactgtggagatcgtgactatgagccatcaggcacttggagatgtcgccggaagaggtaatgagaaaaaaccctccagcgtgagagcactgagcattgtgcttccaatcgttctgctggtgtttctgtgtcttggtgtctttcttctgtggaagaattggagactgaaaaacataaacagcattaactttgataacccagtgtaccaaaaaacgactgaggacgaagttcatatctgtcataatcaagatggatactcatacccgtctcgccaaatggtcagccttgaagatgatgtggcc

SEQ ID NO: 308 - DNA, 2580 bp, Artificial Sequence
  Description of Artificial Sequence: Synthetic Transcript Sequence
atgggaccatggggctggaaacttcgatggaccgtggccttactgcttgcagccgccgggacagctgtgggggataggtgtgaaagaaatgagttccaatgtcaggacgggaaatgcatttcatataaatgggtgtgtgatggctcggctgaatgtcaggacggatcagatgaaagtcaagagacatgcctgtcagtgacatgtaaaagcggagatttctcctgtggcggacgcgtaaatcggtgcattccgcagttctggcgctgcgatgggcaggttgattgtgacaacggttctgatgaacaaggttgtcccccgaaaacgtgctcacaggacgaatttagatgccatgacggcaagtgcatcagcaggcagttcgtttgtgacagcgacagagattgccttgatggaagtgatgaagcgtcatgccctgtattgacgtgcggacctgcatcatttcagtgtaattcatcgacgtgcattccgcagctatgggcctgcgacaatgacccggattgtgaggacggctctgacgagtggccccaaagatgtcgaggtttatacgtctttcaaggcgattcgtcaccatgtagcgcgttcgagtttcattgcttatccggggagtgcatccactcttcatggcggtgtgacggaggccccgactgcaaagacaaaagtgacgaagaaaattgtgctgtcgctacctgtagaccggatgaattccagtgctctgacggtaactgcattcatggctcacgtcagtgcgatcgggaatatgattgcaaagatatgtctgatgaagtaggttgcgttaatgtaacgctttgtgagggcccgaacaaatttaagtgtcattcaggcgaatgtatcacattagataaagtgtgcaatatggcgcgtgattgtagagattggagtgacgaacctattaaagagtgcggaacaaatgaatgcttagataacaatgggggatgcagtcatgtctgtaatgatttgaaaataggatatgagtgtgactgtcccgatggttttcaactggtagcgcaaagaagatgcgaagatatcgatgaatgccaagatccggatacctgtagccagctttgcgtgaatcttgaagggggttataaatgccaatgcgaggaaggatttcagctggatccgcacaccaaagcatgcaaagccgtcggttctatcgcgtatctgttttttacaaatagacatgaggtcagaaaaatgacgctcgatcgttcggagtatacctctctgattccaaatctcagaaatgtggtggcactcgacacagaagtcgcgagcaatcgaatctattggtcagatctctcacaacgcatgatctgttcgacacagttagacagggcgcatggggtttcttcatatgatacggtaatctcgcgcgatatccaagcgccggacgggcttgcggtcgattggattcatagcaatatttactggactgatagtgtcctgggaacagtaagtgttgctgatacaaaaggcgtcaaaagaaagacactctttcgggaaaacggatcgaaacctagagcaattgttgttgatccagttcacggttttatgtattggacagattggggaaccccggccaaaattaagaaaggcggcctgaatggagttgacatctacagtttagtgactgaaaacattcagtggccgaatggaatcactttagatctgctgagcggccgtttatactgggttgattctaagctgcatagtattagctccatagatgtaaacggtggcaaccgcaaaacaattcttgaagatgaaaaacgtttggctcatccgttttcactggcagtttttgaagacaaagtgttctggaccgacattatcaatgaggcaatattttcagctaacagattaacagggagtgatgtaaacctgctggccgagaacctcctatccccggaagatatggtcctttttcataatcttactcaacctcgaggtgttaattggtgcgaacggacgacactctctaatggggggtgccagtacctgtgtctgccggcaccccagattaacccgcattccccgaagtttacatgcgcgtgccctgatggcatgttactggctcgggatatgagatcatgccttacggaagccgaggcagcggtagcaacacaagaaacatcaaccgtgcgtttaaaggtctcgagtacagcggtcagaactcaacatacgacgacacgaccggtgccagatacttcaagactacctggggccacaccgggacttacaacagtggaaattgtcacaatgtctcatcaagctcttggggatgttgcgggaagaggaaatgaaaaaaaaccgagtagtgtccgtgccctttcaatcgttctgccaattgtgctcctggtttttttgtgcctgggagtctttctgctttggaaaaattggcggcttaagaacatcaattcgattaatttcgacaacccggtctaccagaaaacgacagaggatgaggtccatatttgccataatcaggatggctattcttacccgtctcggcagatggtcagtctggaggatgatgtggca

SEQ ID NO: 309 - DNA, 2580 bp, Artificial Sequence
  Description of Artificial Sequence: Synthetic Transcript Sequence
atgggtccttggggatggaagttgcgctggaccgtggcgcttctccttgccgcggcaggcaccgcggtcggcgacagatgcgagagaaacgaattccagtgtcaggatgggaagtgtatttcatacaaatgggtgtgtgatggttcggccgaatgtcaggacggctcggacgagtcgcaagagacttgcctctcagtcacttgcaaatcgggagactttagctgtggaggacgcgtcaacaggtgtatcccgcagttctggcggtgtgatggccaggtcgattgtgataacggttcggatgaacagggatgtccgccaaagacgtgctcccaagatgagtttagatgtcacgatggaaaatgtataagccgtcagttcgtgtgtgattcggaccgcgattgtctggatggatcggatgaggcatcgtgtcctgtgctcacctgcggtccagcctcgttccagtgtaattcctcaacttgtatcccccaactctgggcttgcgacaacgaccctgattgcgaggatggaagcgatgagtggccgcaacgctgtcgggggctgtacgtgttccaaggcgactcctcgccttgctcggcttttgaatttcattgcctgtcgggagaatgcatccattccagctggcgatgtgatggcgggccagattgtaaggataagtcagatgaggaaaactgtgcagtggctacgtgtagaccagacgagtttcagtgtagcgacggcaattgtatccatggatccaggcaatgcgatagagaatacgattgtaaagacatgtcggacgaggtcggatgtgtgaacgtgactctctgtgaaggccccaataagttcaaatgccattcaggagaatgtatcaccctggacaaggtgtgcaacatggctcgggactgtcgtgactggtcggacgaacctatcaaggaatgcggcactaacgaatgtctcgacaataatggtggatgttcccacgtgtgcaacgacttgaaaatcggatacgaatgtgactgtcctgatggatttcagcttgtggcccaaagacggtgtgaggacatcgacgagtgccaagatccagacacctgtagccaactgtgtgtgaaccttgaaggaggttacaagtgtcaatgcgaggaaggatttcaactggacccgcatactaaggcctgcaaggcagtcggctcgatcgcatatctgtttttcactaatcgtcacgaggttaggaagatgaccctcgaccgctcggagtacacctcacttattccaaacctgagaaatgtggtggcgcttgataccgaagtggcatcgaatagaatttactggtcggatctgagccaacggatgatttgttcgacccaattggaccgtgctcacggagtgtcctcatatgataccgtgattagcagagatatccaagcgcccgatggactggctgtcgattggattcattcaaatatctattggaccgactccgttctgggaaccgtctcggtggcagacacgaagggagtgaagaggaaaactctgtttagggagaatggaagcaaacctcgcgcaattgtggtggaccccgtgcacggctttatgtactggaccgattggggaactccggcaaagattaagaaagggggacttaacggagtggacatatacagcctggtgactgaaaacatccagtggcctaacgggataacccttgatttgctctccggacggctttactgggtggatagcaagctccattctatttccagcattgatgtaaatggcggcaatcgaaagacgatcttggaggatgaaaagcgattggcacaccccttttccctggccgtgtttgaggataaagtgttctggaccgacattatcaacgaagcaattttctcggcaaaccgtcttaccggctcggatgtgaacttgctggccgaaaacctcctgtcacccgaagatatggttctttttcacaaccttactcagccccggggagtgaattggtgcgaacgaacgactctgtcgaacggaggatgtcagtacctgtgtctcccggcaccacagattaacccccatagcccaaagttcacctgcgcttgtcccgatggaatgcttctcgcaagggatatgcgatcatgtctgacggaggccgaagcggcagtcgcgacgcaagaaacttctacggttagactcaaagtgtccagcactgccgtgcggacccagcataccaccactcggcctgtgcctgacacctccagactgccaggtgcaaccccagggttgaccactgtggagattgtgaccatgagccatcaagccctgggagatgtggccggtcgcggaaatgaaaagaagccttcgtcggtgcgcgccctctcaatcgtgcttccaattgtcctgctcgtgttcctgtgccttggcgtgtttctcctttggaagaactggcggcttaagaacatcaattccatcaattttgataatccagtgtatcaaaagactaccgaagatgaagtgcatatttgtcataaccaagatggatactcatacccctccagacaaatggtgtccttggaagatgacgtggca

SEQ ID NO: 310 - DNA, 2580 bp, Artificial Sequence
  Description of Artificial Sequence: Synthetic Transcript Sequence
atggggccgtggggttggaagctccggtggaccgtcgctctgctgcttgccgcggccggtaccgccgtgggtgacaggtgcgagcgtaatgaattccagtgccaggacggtaaatgcatttcatacaaatgggtatgcgatgggtcggccgaatgtcaagacggcagcgacgaaagccaggagacttgcctctccgttacctgcaagtctggagacttttcatgcggaggacgcgtaaacagatgtattccgcagttttggcgctgcgacggacaggtggactgcgacaacggatcggacgaacagggctgcccgcccaagacttgctcacaggatgaattcagatgccatgacggaaagtgcatctccaggcaattcgtgtgcgactccgaccgggattgcctggatggcagcgatgaggcctcctgccccgtcctcacgtgtggccccgcctccttccaatgcaattcgtcaacttgcattccgcaactttgggcatgcgataatgacccagattgcgaggacggatccgacgagtggccacagcggtgccgcggactgtatgtgtttcaaggtgattccagtccgtgcagcgctttcgaattccattgcttgtcaggagaatgcatacactcgagctggcgatgcgatggcggaccagattgcaaggacaagtcggatgaggagaactgtgcagtcgccacctgcagaccagatgagttccagtgttcagatggaaattgtatccacggctcgcggcagtgcgaccgagaatacgattgtaaggacatgtccgacgaagtgggatgcgtcaatgtgaccctctgtgagggcccgaacaagttcaagtgtcacagtggtgaatgcatcactcttgacaaagtctgtaacatggcccgcgactgccgtgattggtcagatgaacctatcaaagagtgcggcactaacgaatgcctggataacaacggagggtgttcacatgtctgtaacgacctgaaaatcggatacgaatgcgactgcccggacggctttcaactcgttgcgcaaagacgctgcgaggatatcgacgaatgccaggaccccgacacctgctcgcagctctgcgtgaatctggaaggggggtacaaatgccagtgtgaggaaggtttccaattggatcctcacaccaaggcatgtaaagcagtgggaagcatcgcgtaccttttcttcaccaacagacacgaggtgcgcaagatgaccctggataggtcggagtacacttctctcatccctaacctgcggaatgtggtggcgttggacacggaagtcgctagcaaccgcatctattggtcggacctgtcccaacggatgatctgttccactcagctcgaccgggcacacggcgtttcaagctacgacactgtgatcagtcgcgacatccaagcccccgatggactcgctgttgattggattcattccaacatctactggaccgactcggtgcttgggactgtgtcggtggcagataccaagggcgtgaagcgaaagaccctgtttcgcgaaaatggatccaaaccacgcgccatcgtggtcgacccagtccacgggttcatgtactggaccgattggggcaccccggccaagatcaaaaagggaggattgaatggagtggacatctactcccttgtgaccgaaaacatccagtggccgaacggaatcacgcttgacttgctgtcagggaggctgtactgggtcgactcgaaactccactcgatttcctcaattgatgtcaacggcggtaatagaaagacgatactcgaggacgagaagcggctggcgcatccattcagcttggcggtgttcgaagataaggtgttctggaccgacattatcaacgaagccatattcagcgctaaccgactgacgggatcggacgtaaatctgcttgctgaaaacctgctgagcccggaagatatggtcctttttcataacctgacccagccgagaggcgtgaattggtgcgagcgcaccaccctcagcaacggtgggtgtcagtacctgtgtctcccagcaccgcagatcaacccgcactcgcctaagttcacttgcgcctgtccagacggaatgctgctcgccagggatatgcggtcgtgcctgactgaagctgaggcagcggtggcaactcaagaaacgtccactgtgcgcctgaaggtgtcatctaccgcggtgaggactcagcacactaccactcgccctgtccctgataccagccgcctgccaggagctactccgggactcaccactgttgagattgtgactatgagccaccaagccctgggagatgtggcgggacgcggcaacgagaagaagcctagttccgtgcgggcgctgtccatcgtgctgcccatcgtgctcttggtgttcctgtgcctgggagtctttctgctttggaaaaactggagactgaagaacatcaattcgatcaatttcgataatccggtctaccaaaagaccactgaggacgaggtgcatatctgccataatcaggacggatactcatacccgagccggcagatggtttcgctggaagatgatgtcgcc

SEQ ID NO: 311 - DNA, 2580 bp, Artificial Sequence
  Description of Artificial Sequence: Synthetic Transcript Sequence
atggggccatggggctggaagctgagatggacggtcgcgttgcttctggccgcagcaggtaccgcagtgggcgatcggtgcgagagaaatgaattccaatgccaagacggtaagtgcatttcatacaagtgggtatgcgacggcagcgctgaatgccaagacggctcggatgaaagccaggaaacatgcctttcagtaacatgcaagagtggggatttctcatgtggaggacgggtgaacagatgcatcccgcagttctggcgatgtgacggccaggtcgactgtgataatgggtctgatgaacaaggatgccccccaaagacatgttcccaagacgaatttcgctgccacgacggtaaatgcatcagcaggcagttcgtgtgcgactcagatagagattgtctcgatggcagtgatgaagcatcttgtcctgtactgacctgcggcccggcctcgtttcagtgtaattctagcacatgtatcccgcaactgtgggcctgcgataatgacccagactgcgaggacggttctgacgagtggccacagcgttgtaggggactgtacgtcttccagggggatagctcaccgtgtagtgctttcgagtttcattgcttgtctggggagtgtatccatagttcatggcgttgtgatggcggacccgactgcaaggataaatcagatgaagagaattgtgcagtcgcgacttgcaggccggacgagttccagtgctccgatgggaattgcatccatggctcgcgacagtgtgatcgtgaatatgactgtaaagacatgtcggatgaggttggatgtgtcaacgtgacgctctgcgaggggccgaacaaatttaagtgccactcaggagaatgcataaccctggacaaagtttgcaatatggctcgagattgtcgcgattggtcggacgagcctattaaggagtgtggcacgaacgagtgtctggacaacaacgggggctgtagtcacgtttgcaatgatttgaagatagggtatgagtgcgactgtcctgatggtttccaattggtcgctcagcgccgttgtgaagatattgatgagtgtcaggaccccgacacctgctcgcaactgtgtgtgaacctagagggcgggtataagtgccagtgtgaggaggggtttcaactggatccacatacgaaagcatgcaaggccgttggctcaatcgcttacctgtttttcaccaatagacatgaggttcgcaagatgaccctcgacaggtcagaatacacgtctctgatcccgaacctgaggaacgtggttgccttggatacagaggttgcgtctaacagaatctactggtcagacctgtctcagcggatgatttgctccacacagctcgatcgagctcatggcgtttcttcatatgataccgtgatcagcagggatatccaagcacctgatgggcttgccgtggactggatacactctaatatctattggacagattccgttctaggcactgtttctgtggcagacaccaagggcgtgaaacggaaaaccctgttcagagaaaatggctctaaaccgcgggccattgtggtcgaccccgtgcatggattcatgtactggaccgattggggcactccagccaagattaaaaagggaggcctaaacggtgtcgatatttactccctcgttacagagaatatacagtggccaaatggcatcacccttgacctgctctcaggtaggctatattgggttgacagcaagctgcattctatttcttccatcgatgttaacggaggcaacagaaaaacgatccttgaggatgaaaagcgactggctcacccgttcagcttggctgtgtttgaggacaaggtcttctggactgacattattaacgaagccattttttccgccaaccgccttacgggctctgacgtcaacctgctcgccgaaaaccttctcagccccgaggacatggtgctttttcataatctcactcagccccgcggcgttaactggtgcgaacgcaccaccttgtcaaacggcggctgtcaatatctgtgcctccccgcaccgcagataaaccctcacagcccaaaattcacgtgcgcgtgtccagatggtatgttgctggcgcgagacatgcgttcctgcctgaccgaagctgaggcggccgttgctacacaggagaccagcactgtccggctcaaggtcagttcaacagcggttagaactcaacacacaacaactagacccgtgcctgacacatcccggttaccgggtgcgacaccaggtctaactacggtggagattgtaaccatgagccaccaggccctgggggatgtggccggtagaggcaacgagaaaaagccttccagtgttagagccctgagcattgtgttgccaatcgtgctgctggttttcttgtgcctgggggtcttcctactctggaaaaactggcgcctcaaaaatataaattccattaattttgacaaccctgtgtaccagaagacaacagaagacgaggttcacatctgtcacaatcaggacggatattcatatccctcacgacagatggtatccctggaagatgacgtggcc

SEQ ID NO: 312 - DNA, 2580 bp, Artificial Sequence
  Description of Artificial Sequence: Synthetic Transcript Sequence
atgggaccgtgggggtggaagctgcggtggaccgtcgccctgcttctcgccgccgcgggaacggccgtgggcgatcgctgcgagcggaatgaattccagtgccaggatggcaaatgcatctcctacaaatgggtgtgcgacggctcggccgaatgtcaagatggatcggacgagtcacaggaaacctgcctgtcagtgacttgtaaatctggcgacttctcatgcggaggacgcgtcaatcgctgtatcccgcagttttggagatgtgacggacaggtggactgcgacaatgggtcggacgagcagggatgcccaccgaaaacttgttcccaagatgagttccggtgccacgacggaaaatgcatttcgcggcagttcgtgtgcgattcggacagagactgcctcgacggatcagacgaagcaagctgcccggtgctgacttgcggaccggcctcattccaatgcaatagcagcacttgcataccacagctctgggcctgcgataacgatccggattgtgaagatggatctgacgagtggcctcagcgctgccgaggactctacgtctttcaaggagactcgtcgccttgctccgcattcgagttccactgcctgtccggagaatgtatccactcgtcttggcgatgcgacggaggcccagattgcaaggataagagcgatgaggaaaactgcgccgtcgctacctgtcgtcctgacgaatttcagtgttccgatggcaattgcatccatggatctcgacagtgtgatagggaatacgattgcaaggacatgtccgatgaagtcggatgtgtgaacgtgactctgtgtgagggcccgaataagtttaagtgccattccggggagtgcatcactctggacaaggtgtgtaacatggcgcgcgactgccgggactggtccgacgaaccgatcaaagaatgtggcaccaatgagtgcctggacaacaacggaggatgcagccatgtgtgcaatgacctgaagattgggtacgaatgcgattgcccggatggattccagctggtggcgcagcgccgctgcgaagatatcgacgagtgtcaagacccggatacttgctcgcagctttgtgtgaatctcgaaggaggatacaagtgccaatgcgaggaggggttccaactcgacccgcacaccaaggcatgcaaggccgtgggttccatcgcctaccttttcttcactaatcggcacgaggtgcgcaaaatgactctggaccgaagcgagtacacctcgttgatcccaaatttgaggaatgtggtggcactcgataccgaggtcgcttcgaaccgaatctactggagcgacctgtcacaacgcatgatctgctcgactcagctggatcgggcgcatggtgtctcctcctacgacactgtgatctcacgagatattcaggcccccgacggactggccgtcgactggatccactcgaacatctactggacggacagcgtcctgggaacggtgtcggtggctgatactaaaggcgtgaagcggaaaactctgttccgggagaacgggtccaagccgagagctattgtggtcgatcccgtccatgggttcatgtattggacggattggggaactccggccaagatcaagaagggaggcctgaacggagtggacatttactccctggtgacggagaatatccagtggccgaacggaatcaccctggacctgctgtcgggacgcctgtactgggtggactcgaagctccatagcatctcgtccatcgatgtgaatggcggaaacagaaagactatcttggaagatgaaaagcgcttggcacatcctttctcgctggccgtgttcgaagataaggttttctggacggatatcattaacgaagccatcttctccgcaaaccgtctgaccggcagcgacgtgaacctgctggcagagaacctgctctcaccggaagatatggtcctcttccataaccttacccagccgagaggggtgaattggtgcgaacggaccactctgtccaatggaggatgccagtacctgtgcctcccggcgcctcaaatcaaccctcactcgccgaagttcacgtgcgcttgcccggacggcatgctcctggccagagatatgcgctcgtgtctgacggaagctgaagctgccgtggccacccaggaaacctcaaccgtcaggttgaaggtcagctcgaccgcagttcgcacgcaacacaccaccacccggccagtccctgacacctcacgattgcctggggccactccaggtttgactaccgtggagatcgtgaccatgtcccaccaggccttgggagacgtcgcagggaggggcaacgagaagaagccttcgtcagtgagagcgctgtccatcgtgctgccgattgtgctgctggtgttcctgtgcctcggtgtgttcctgctgtggaagaattggcgcctcaaaaacatcaactccatcaacttcgacaacccggtgtaccagaaaaccaccgaagatgaggtgcatatctgccacaaccaggacggatactcctacccgtcgagacagatggtgtcgctcgaggacgacgtggct

SEQ ID NO: 313 - DNA, 2580 bp, Artificial Sequence
  Description of Artificial Sequence: Synthetic Transcript Sequence
atggggccgtggggctggaaactgcggtggactgtggcactgctgctggctgctgctggtaccgccgtcggggacaggtgcgagcgaaacgagtttcagtgccaagacggcaagtgtatatcttataagtgggtctgtgacggatcagctgagtgccaggatgggtcagacgaaagccaggagacttgtctgtctgtaacatgcaaatcaggagacttcagctgcggcggtagagttaatagatgcataccccagttttggaggtgcgacggacaggtggattgtgacaacggtagtgatgagcaaggatgcccgcccaaaacttgctcacaggacgagtttaggtgccacgacggtaagtgtatcagcagacagtttgtttgtgattcagacagggattgtttggatgggtccgacgaggcttcttgcccagttttgacctgcggacctgcctctttccaatgcaactcttctacatgtatacctcagctttgggcatgtgataatgaccccgactgcgaggacggctctgacgagtggcctcagcgctgtaggggcctgtacgtcttccagggcgattccagtccttgcagtgccttcgagttccactgcctcagcggggagtgtatccattcctcctggaggtgcgacggcgggcctgattgtaaagataaaagcgatgaggagaattgcgctgttgccacatgtcgacccgatgaattccagtgcagtgatggaaactgcatccacggctctaggcagtgcgatagggaatacgactgtaaagacatgtccgacgaagtcgggtgcgtcaatgtgacattgtgtgagggccctaacaagttcaaatgccatagtggagagtgtatcactctggataaggtgtgtaatatggcccgagattgtagggactggagcgatgagcccattaaagagtgcggcaccaacgagtgtctggacaacaatggaggatgtagtcatgtgtgcaacgatctgaagatagggtatgagtgcgactgccctgatggcttccagctggtggctcaaaggcgatgcgaggatattgatgagtgccaggatccagacacatgtagccaattgtgtgtcaatctcgagggcggctacaaatgtcagtgtgaggagggatttcagctcgacccccacactaaggcttgtaaggccgtaggatcaatagcctatctgttttttactaacagacatgaggtgcggaagatgaccctggacagatcagaatacacatctttgatacctaatctgagaaatgttgtcgcactggacaccgaggtcgcctcaaacagaatctactggagtgacctctcccaacggatgatctgcagtacacagcttgatcgcgctcatggcgtctctagttacgacacagttataagccgcgacattcaggcgccagacgggctcgccgtggactggatccattccaacatttattggacagattctgttctcggcactgtatctgtggccgataccaaaggtgtgaagcgcaagactctctttcgggaaaacgggagcaagcctagggccatcgtagtggaccctgtgcatgggttcatgtattggacagactggggcacccctgccaagatcaaaaagggaggtctcaacggtgtggatatctattccctggtcacggaaaatatccagtggcctaatggcatcacgctggatctgctctctggcaggctgtattgggtcgatagcaaactgcactccatctcaagcattgacgtaaacgggggaaaccggaagaccatcctcgaggacgaaaagcggctggctcatccattttccctcgctgtgttcgaggataaggtgttctggactgatattatcaatgaggcaatcttcagtgctaatcgactgactggatcagatgtgaacttgttggctgagaatctcctttccccggaggacatggtcctttttcataatttgactcaacccaggggtgtgaactggtgcgagcggactactcttagcaatggcgggtgtcaatatctgtgtcttcctgccccccagatcaatccccactctccaaagtttacatgcgcctgccctgatggaatgctgcttgcgagagatatgcggagctgtctgactgaagcagaggctgctgtggccacgcaggagacctccacggtgaggctgaaggtcagctctaccgcagtccgcacacagcatactactacgcggcctgtccccgacacctcacggctgcctggagccacacccggcctgacaaccgttgagatagtgactatgtcccaccaagcactgggggacgtcgccgggcggggcaatgagaagaaaccatcaagcgtgagggcgctgagtattgttttgcctattgtactgctggtctttctctgcctgggagttttcctgctgtggaaaaattggagactcaaaaacattaacagcatcaactttgacaatccagtctaccaaaaaactactgaggacgaggtccatatctgtcataatcaagatggctacagctacccgagtaggcagatggtgtctctcgaggatgacgtggct

SEQ ID NO: 314 - DNA, 2580 bp, Artificial Sequence
  Description of Artificial Sequence: Synthetic Transcript Sequence
atgggcccatggggctggaaattgaggtggacagtagcactgttgctagccgccgcaggtaccgccgttggagatcggtgtgaaaggaacgagttccagtgtcaggatgggaagtgtatttcttataagtgggtgtgcgatgggagcgctgaatgccaggacggatccgatgagagtcaggaaacttgtctgagtgtgacatgtaaatcaggggacttctcctgcgggggacgagtgaataggtgtattccacagttctggaggtgtgacggccaggtagactgcgataatggttcagacgagcaggggtgtcctcccaagacgtgcagccaggatgaatttaggtgccacgatgggaaatgtatctcacggcagttcgtttgcgatagcgatagagactgtctggacggctccgacgaggcttcttgtcctgtcctaacatgtgggcccgcaagctttcagtgcaacagctctacttgcattcctcagctgtgggcatgtgataacgacccagactgcgaagatggaagtgacgaatggccacagcgttgccgcggcctgtatgtgtttcagggcgacagtagtccctgttccgcattcgaattccattgcctgtccggcgaatgcatacactcgtcctggcgatgcgacggtggtccagactgtaaggataagagcgatgaagagaactgcgcagtggccacctgccgcccagacgaattccagtgttctgatggaaactgcatccacggaagcaggcagtgcgaccgggagtacgattgcaaagatatgagtgacgaggttgggtgtgtgaacgtcacattgtgtgaggggcccaataagttcaaatgtcacagcggggagtgtataaccttggataaagtatgtaacatggcccgcgattgccgggactggagcgacgagccaataaaagagtgcggcaccaacgaatgtttggataacaacggcggatgctctcatgtttgtaatgatctgaaaattgggtacgaatgtgactgccccgatggatttcagttagtggctcagcggcgttgtgaagacatcgacgaatgccaggatcccgacacctgtagccaactgtgcgtgaaccttgaaggtggttataaatgccagtgcgaggaggggttccagctggatccgcacacaaaagcttgcaaggcagtcggatcaattgcttacttgttcttcacgaatcgccatgaggtaaggaagatgactctagacaggtcagagtacacctccttgatcccaaatcttaggaacgtagttgcactggacacagaagtcgcctctaatcgaatatattggagcgacctctcccaaagaatgatctgctcaacacagctggatcgggcacacggcgtttcttcatatgatacggtcatttcaagggacatccaggcccccgacggcttagccgtagattggatccattctaacatatactggacagacagcgtgctgggcactgtgagcgtagccgacacaaagggggtaaagcgcaagactttgttccgagaaaacggttcaaaaccaagggccattgtggtagatccagtgcacggattcatgtattggactgattggggaactccagctaaaataaaaaaaggaggcctgaacggcgtagacatctattctttggtcactgagaacatccagtggcccaatggtatcaccctggatctgcttagcgggaggctctactgggtcgattctaagctgcattcaatcagctctattgacgtgaacggggggaaccgaaaaacgattcttgaagacgaaaaaagactagcacacccattcagcctggctgtgtttgaggacaaggtgttctggactgacattataaacgaggcaatcttctcagctaatcggctaacaggctctgacgtaaacttgctggccgaaaatctgctgtctccagaggatatggtgctgttccacaacctgactcagccccgcggcgtgaattggtgcgaacggaccacactgtccaatggtgggtgtcagtatctctgcctgccagcgccacagattaaccctcactcccctaagttcacttgcgcgtgccctgacggaatgcttctggccagagatatgagatcatgtctcacagaagctgaagccgcagtggctacccaggaaacgtccaccgtgagattaaaagtctcttccaccgcagtgagaacgcaacatacgaccacacggcccgtaccagacacatctcggctgcctggagcaacccctggactgacaaccgtggaaatcgtgaccatgtcccatcaggccttaggagacgtggcagggagaggcaacgaaaaaaagccaagtagtgtccgcgccctgagcattgttctgcccatcgtcctgctggtcttcctgtgcctgggggtgttccttctttggaaaaattggagactaaaaaatattaatagcattaactttgataaccccgtttatcagaagacgacggaggatgaggttcatatctgccataaccaagacgggtattcgtacccatcccggcagatggtgtcacttgaggacgatgttgcc

SEQ ID NO: 315 - DNA, 2580 bp, Artificial Sequence
  Description of Artificial Sequence: Synthetic Transcript Sequence
atggggccatggggctggaagctccgttggaccgtagcattacttctcgctgccgctgggacagcagttggggatcggtgcgaacgcaacgaatttcagtgtcaggatggcaagtgcatcagttataaatgggtgtgtgatgggagtgcagagtgccaggatggcagcgatgaatcccaggagacatgcctgagcgttacatgcaagtctggagattttagttgtggcgggagagtcaacaggtgtattccccagttctggcggtgtgacgggcaggttgactgcgacaacggcagcgacgagcaggggtgtccgcctaagacctgttcacaggatgagtttcggtgtcatgacggaaagtgcataagtcgccagtttgtctgtgactctgaccgtgactgcctggacggctctgacgaagccagttgcccagtgctgacctgcggtccagcttccttccagtgtaattcctccacatgtatccctcagctttgggcatgtgacaatgatccagactgtgaagacggaagtgatgaatggccacaacgatgccgcggcttatacgtgtttcaaggagactcatcaccgtgcagcgcttttgagttccattgcctgtctggtgaatgtattcacagctcttggaggtgtgacggcgggcctgattgcaaagataaatcagacgaggaaaactgtgctgtcgctacctgtagacccgatgagtttcaatgttcagatgggaactgcattcacggcagccgccagtgcgatagagagtatgattgcaaggacatgtcagacgaagtggggtgtgtgaacgtgaccctatgcgaagggcctaataagtttaagtgccacagcggagagtgcatcaccctggacaaagtctgtaatatggctagggattgccgcgattggtcagacgagcccataaaggaatgtggtacaaatgagtgtctggacaacaatggtggatgtagccatgtttgtaatgatctgaagattggctacgagtgtgactgccccgatgggttccagctcgtcgcacagagaagatgcgaagatatcgacgaatgccaggatccagatacctgcagccagctctgcgttaaccttgagggaggctacaagtgtcagtgcgaggagggttttcagttagatcctcataccaaagcctgcaaagccgttggctcaattgcatatctgttcttcaccaatcgccatgaagtgagaaagatgaccctagacagaagcgaatatacaagtctaatacccaatctgcgcaatgtggtggctcttgatacagaggtagcatctaacagaatttattggtccgatctgtcacagcgtatgatttgtagtacccagctggatcgagcccatggcgtttccagctacgataccgttattagccgggatatacaggcccccgacggcctggccgttgactggatacactccaatatttattggacagatagtgtgctgggcaccgtcagcgtggctgacactaagggggtgaagaggaaaaccctattcagggagaacggttcaaaacctcgagccattgtggtcgatcctgttcatggctttatgtactggactgattggggcacccccgccaagattaaaaaagggggcttgaacggagtggacatttatagcctagtgaccgagaacatccagtggcccaatggtattactctggatttattatctggtcgattatactgggtcgacagcaagttgcacagtatatcatccattgacgttaatggcggtaatagaaagacaatcctggaagacgagaagaggctggctcatccattctccctcgccgtttttgaggataaagtcttctggactgacataataaacgaggccatatttagtgccaataggctgaccggcagtgacgtgaacctgctcgccgagaatctgctcagccccgaggacatggtgctgttccacaatttaacccagcccaggggggtcaattggtgcgagagaaccacattatccaatggcgggtgtcaatacctgtgcctgccagctccccaaataaacccacatagccctaaattcacctgtgcctgcccagatgggatgctcctcgcccgggacatgcggagctgtctgaccgaggccgaagccgcagtggcaacccaggagacatccacagtcagactgaaagtcagttccactgcagtccgcacccagcacaccaccaccaggccagtgcctgacactagtcggctgcccggagcaactcctgggctgacaactgtggagatcgttacaatgagtcatcaagccctgggggatgtggccgggagaggcaatgaaaaaaagccttcttcagtgcgtgcactgtccatagtgctaccaatagtgttgctggtgttcctatgcctgggcgtgttcctactgtggaagaactggcggctaaaaaatattaattcaatcaactttgacaatccagtgtaccagaaaacaactgaggatgaagttcacatatgtcacaatcaggatggatattcttaccccagcaggcaaatggtttctctggaagatgacgtcgct

SEQ ID NO: 316 - DNA, 2580 bp, Artificial Sequence
  Description of Artificial Sequence: Synthetic Transcript Sequence
atgggcccttggggatggaagctgcggtggacagtagctctcttattggcagccgctggaaccgcagttggagatcggtgtgagaggaacgaattccagtgccaggacgggaagtgtatctcatacaaatgggtgtgcgacgggagcgctgaatgccaggacggcagcgatgaatcccaggaaacgtgcctgagcgtgacatgcaaatctggggatttctcttgtggtgggcgcgtgaataggtgcatcccgcagttctggaggtgcgatggccaggtcgattgcgataatggttccgatgagcaggggtgccctcccaagacatgttcgcaggatgagttccgctgccacgatggaaagtgtatctctaggcagttcgtctgcgattcagacagggattgcctcgatggctctgacgaagccagctgtccagtgctgacgtgcggaccggccagcttccagtgcaattctagtacctgcattcctcagctttgggcttgcgacaacgatccagactgtgaagatggtagtgatgaatggccccagcgatgccggggcctgtatgtattccaaggggactcgagcccttgcagcgcgttcgagttccactgcctgtctggagaatgtatacactcttcctggcgatgcgatggcggcccagactgtaaagataaatcggatgaagagaactgtgcagtggccacgtgccggccagacgagttccagtgttccgatgggaattgtatacacggctctaggcagtgtgatcgggagtacgactgcaaggatatgagcgatgaggtggggtgcgtgaatgtgactctttgtgagggacccaacaaattcaaatgtcactcgggtgagtgtatcacactggataaagtatgcaatatggctcgcgattgccgcgactggagcgatgaacccattaaagagtgtggcacaaatgagtgtctggataataacggaggatgctcacacgtgtgcaatgacctgaagattggctacgaatgtgattgccctgatggcttccaattggttgctcagaggcggtgcgaggacatagacgaatgccaggaccctgacacttgtagtcagctgtgcgttaacctggagggaggatacaagtgtcagtgcgaagagggctttcagttggaccctcatacaaaggcttgcaaagcggtgggaagcatcgcatatctcttctttacaaaccgccatgaggttcggaagatgaccctagatagatcagagtacactagcctcatccctaacctgaggaatgtggtggctctggacacagaggtagcgagcaatcggatatactggtccgatctgagccagagaatgatatgcagcacccagctggatagggcacacggcgtctcttcctatgacacagtgatcagcagagacattcaagcccctgatggtctggccgttgattggatacattccaatatttattggacggattcggtacttggaaccgtttcagttgctgatacgaaaggcgtgaagaggaaaaccctgttcagggaaaacggctcaaaaccaagagcaatcgtggtggaccccgttcacggatttatgtattggactgattggggtacgcctgctaaaatcaagaaaggcggattgaacggagtggacatctacagcttagttaccgaaaacattcagtggcccaacggcattaccctggatttgctgtccgggagactgtactgggtggattccaaacttcattcgatctcgagtatagacgtgaacggtggcaaccggaaaaccattctggaagacgaaaagaggctcgcccacccatttagtctggcagtgtttgaggacaaagtgttctggaccgacattattaacgaggctatcttttctgctaacagacttacgggatcagacgtgaatttactcgcggagaacctgttaagtccggaagatatggtgctctttcacaatttaacacagccgaggggcgtgaactggtgtgagaggacgaccctgtctaacggcggctgtcaatatctgtgtttacccgccccacaaataaacccacatagccccaagtttacctgcgcttgccccgacgggatgcttttagctcgggacatgagatcctgtctgaccgaagccgaggcagcggtcgcaacccaagagaccagcaccgtccggctgaaggtgtcatctaccgccgtgcgcacccaacataccacaacccgcccagttcccgacacatctcgtctgcccggcgcaactccgggcctgacaacagtggaaatcgtgactatgtcccaccaagcattaggagatgtcgccgggcggggaaatgagaaaaagccttcttccgtccgggctctgagcatcgtgcttcctatagtcctcctagtgttcctgtgtctcggcgtcttcctgctctggaaaaactggaggctgaaaaacatcaacagtattaactttgataatcccgtctatcagaagaccaccgaagatgaagttcacatctgtcacaaccaggacggctactcctaccccagccggcaaatggtatcacttgaggacgacgtggcc

SEQ ID NO: 317 - DNA, 2580 bp, Artificial Sequence
  Description of Artificial Sequence: Synthetic Transcript Sequence
atggggccctggggctggaaactgcggtggacagtggctttactgctggcggctgccggcacagccgtgggagacaggtgcgaacggaacgaattccaatgccaggacggcaagtgcattagttataaatgggtctgcgacggaagcgccgagtgccaggatggcagcgacgaaagtcaagagacgtgcttgagtgttacctgtaaaagcggggatttctcttgcgggggccgtgtaaacaggtgcataccacaattctggcgttgtgatgggcaagttgactgcgacaatggctctgacgaacaaggctgtcctcctaagacttgtagccaggacgagtttaggtgccacgatggaaaatgcatatctaggcaatttgtctgtgatagtgaccgggattgcctagacggtagtgacgaggcgtcatgccccgtgctcacttgtggccctgcaagtttccagtgtaactcctcaacttgtatacctcagctgtgggcctgcgacaatgacccagactgtgaggatggatcagatgagtggcctcagcggtgtagaggattatacgtgtttcagggggattccagcccatgttcagcctttgagtttcattgcctcagcggtgagtgcattcactcatcatggagatgcgacggcgggcccgactgtaaagacaaaagcgatgaagagaactgtgccgtagccacctgccggccagacgaatttcagtgttccgacgggaactgtatccatggctcccgacagtgcgaccgtgagtatgactgcaaggacatgtctgatgaggtggggtgcgtgaacgttactctctgcgaagggccaaacaagttcaagtgccactctggggagtgcatcaccctggataaagtgtgcaacatggctcgggactgcagggactggtcagatgagccaataaaggaatgcggtaccaatgagtgccttgataataatggcggttgtagccatgtgtgtaacgacctcaaaatcgggtacgaatgcgactgccccgacggctttcagcttgtagctcaacgtcgctgtgaagatatcgacgagtgccaggatccagatacatgttctcagttatgcgtaaatctcgaaggcggttataagtgccagtgtgaggagggcttccagctggatccccacacaaaggcttgtaaggcagtcggctctatcgcatatctgttttttactaacaggcacgaggtcagaaaaatgactctggataggtctgagtacacctccctgatccctaacctccggaacgtcgtagcattggataccgaggttgctagcaacaggatttactggagcgacttgtcccaaaggatgatatgttctacgcaactcgaccgggctcacggagtaagttcttacgatacagtcatttcccgagacatccaggcacctgacggcctcgcagtcgactggattcattcaaatatctactggactgatagtgtgttaggcactgtcagcgtcgcggataccaaaggagtgaagcggaaaactttattccgggaaaacgggtccaaaccccgcgccatcgtggttgaccctgtccatgggtttatgtattggacagactggggtacaccggcgaagatcaagaaaggcggactaaacggcgtagacatctattcattggtcactgagaacatacaatggccaaacggcatcacgctcgacctgctttctggccggttgtactgggtggattcgaagttgcacagtatcagctcaattgatgtgaacggcgggaatcgaaaaaccattctcgaggatgagaaacggctggcacaccccttctctctggctgtgtttgaagataaggtgttctggactgacattatcaacgaggctattttttccgctaatcggctgacagggtctgatgtgaacctgttagccgagaatctgctttctcctgaggatatggtcctgtttcataacctgacccagcctcggggggtgaactggtgtgagaggacgactttgtccaatggcggctgtcagtacctctgcttgccggcgcctcaaatcaaccctcactctcctaaatttacctgcgcctgccccgatgggatgctgctcgctagggacatgagaagctgcttgactgaggccgaggctgcagtggctactcaggaaacaagcacagttcggctaaaagtcagcagcacagccgtgagaactcagcacaccaccacacgacctgttcccgacacaagcaggctgcctggagccactcccgggttaaccacggtggagatcgtgactatgtcacatcaggcactaggggatgtggcgggaaggggcaatgaaaaaaagccctcttcggtccgcgcgctgtcaatagttttaccaatcgtgctgctggtctttctgtgtttaggagtgttccttctctggaaaaattggcggctcaagaacattaattcgatcaatttcgacaatcctgtctatcagaaaacgacagaggacgaagtgcacatctgccataaccaggatgggtatagctacccttcgcgacagatggtcagtctggaggacgacgtagca

SEQ ID NO: 318 - DNA, 2580 bp, Artificial Sequence
  Description of Artificial Sequence: Synthetic Transcript Sequence
atgggtccgtgggggtggaaacttcgctggacggtggcactgctgttggcagccgccgggacggccgtcggggaccgctgtgagcggaacgagtttcaatgtcaggatgggaaatgtatttcgtacaaatgggtgtgcgacggatcagctgaatgccaagatggttcggatgagagccaagagacttgcctgtcagtgacttgtaagagcggcgacttttcatgcggaggaagagtgaaccgctgtattcctcaattttggcggtgtgatggccaagtggactgtgataacggaagcgatgagcaagggtgtccccccaagacttgttcgcaggacgaatttagatgccatgatggcaaatgcatttcacgtcaatttgtgtgtgattcggacagggattgtctggacggcagcgatgaagcatcgtgccctgtcctgacttgcgggccggcatcgttccaatgtaacagctcaacctgcattcctcagctctgggcctgcgacaacgatcccgattgtgaggatggatcagatgaatggccacaaagatgcaggggtctgtatgtgtttcagggtgatagcagtccatgttccgcatttgaatttcattgtctgtcaggcgagtgcattcactcgagctggcgttgtgatggaggtcctgactgtaaagataaaagcgatgaggaaaactgtgcggtggcaacttgtcgccccgatgaatttcaatgcagtgatggtaattgtattcatggtagccgtcagtgtgatagggagtacgactgcaaggatatgtccgatgaagtgggttgcgtgaatgtgaccctgtgcgagggccctaacaagtttaagtgtcactccggcgagtgtatcactctggacaaggtgtgcaatatggcgcgcgactgtcgggactggagcgacgagcctattaaggaatgcgggactaacgaatgtctggacaataatggaggctgtagccatgtttgtaacgacctcaaaattggatacgagtgtgattgcccggatgggtttcaacttgtcgcacagcggagatgtgaagatatcgacgagtgccaggatccagacacctgctcacaactttgtgtgaatctggaaggtggttacaagtgtcaatgtgaggaaggattccaactggacccacataccaaggcgtgtaaagcagtgggatccattgcatacctctttttcaccaataggcatgaagtgagaaaaatgactttggatcgttctgagtacacttccttgattcctaaccttagaaatgtggtggcactggacacggaagtcgcatctaacagaatttactggtccgatttgtcccaaagaatgatatgctcgacccagcttgatcgtgcccatggagtgagttcgtacgataccgtgatttcccgagatatacaggcccccgatgggctggccgtggattggatccattcgaacatctactggactgactccgtccttgggaccgtttccgtggcagatactaagggagtcaaacgtaagactcttttcagggaaaatggctccaaaccacgcgccatcgtggtggaccccgtccatgggttcatgtactggactgattggggaaccccagcgaagattaagaagggaggtcttaacggagtggatatctattcgctggtgaccgagaatattcagtggcccaatggaatcactctcgacctgctttccggaaggctgtactgggtggattccaagctgcattccatatcctcaatcgacgtcaacggaggtaaccgtaagactatacttgaggacgagaagagacttgcacatccattttcgctggcggtgttcgaggataaagttttttggaccgatatcattaacgaagccatattctcggcgaatagactgaccggttccgacgtgaaccttctggcagagaacctgctctccccagaggacatggtgcttttccataaccttactcagccgcgcggggtcaactggtgtgaacggaccactctttcaaacggaggctgtcagtacctgtgtttgccggcacctcaaatcaatccacattccccaaagtttacgtgtgcctgccccgacggaatgctccttgctagggatatgcgctcttgcttgactgaagcagaggcagcggtggctacccaggaaacttccactgtgaggctgaaggtttcgtccacggccgtccgaacgcaacacaccaccactcgtccggtgcctgatactagcaggctccctggagccacccctgggcttaccaccgtcgaaattgtgactatgtcgcaccaagcactcggcgatgtcgcaggtcgtggcaatgaaaagaagccatcgtcggtcagagccctgtcgatcgtcctgccaatcgtcctgctggtgttcctgtgcctgggtgtctttcttctttggaagaactggcgactcaagaacataaactccatcaatttcgacaaccctgtctaccagaaaaccactgaggatgaagtccacatctgtcacaatcaggacggttacagctacccttcacgtcagatggtatcccttgaggatgatgtggcc

SEQ ID NO: 319 - DNA, 2580 bp, Artificial Sequence
  Description of Artificial Sequence: Synthetic Transcript Sequence
atgggcccctggggttggaaattgaggtggaccgtggccttgctgctggcggccgcgggcactgctgtgggagatcggtgcgagcgcaatgagttccagtgtcaagacggaaagtgtatcagctacaagtgggtgtgcgacggttccgcagaatgtcaggacggatctgatgaatcacaggaaacgtgcctgtcggttacgtgcaagtcaggagatttctcctgtggcggcagggtgaacagatgcatcccacagttttggcgatgcgatggacaggtcgactgcgacaacggatccgacgagcaaggatgcccacctaagacttgttcgcaggatgaatttagatgccacgacggaaaatgcatttcgcggcagttcgtgtgcgactcagaccgcgattgtttggacggctccgatgaggccagctgcccagtgttgacttgcgggccggcttccttccagtgtaactcgtctacctgtattccgcagctgtgggcgtgcgacaatgatccggattgcgaggacggatcagacgaatggcctcaacggtgtcgcggactctacgttttccagggagattcatccccttgctccgcttttgagtttcactgcctgtcaggagagtgcatccactcttcgtggcgctgtgacggcggtcccgactgtaaggacaagtccgatgaggagaactgcgccgtggcaacttgccggcctgacgagttccagtgctccgacggaaactgcattcacggatcgcggcagtgtgaccgggaatacgattgcaaggacatgagcgatgaagtagggtgcgtgaacgtcactctctgcgaaggccctaataagttcaaatgtcactctggagaatgcatcactctggataaggtgtgcaatatggctcgggattgcagagactggtcggatgaaccgatcaaggagtgcggtaccaatgagtgcctggataacaatggtggatgcagccacgtgtgcaacgatctgaagatcggatacgagtgcgattgccccgatggattccagctggtggcacaacggcggtgcgaggacatcgatgaatgtcaagaccctgacacttgctcccagctgtgcgtgaatctggagggcggatacaagtgtcagtgtgaggaaggattccagctcgacccacataccaaggcgtgtaaggctgtgggctcaattgcgtacctgtttttcacgaaccgccatgaggtccggaagatgactttggatcgcagcgaatatactagcctgatcccgaatctcagaaatgtggtggcccttgatactgaagtggcctcgaaccgcatctattggtccgatctctcgcagcgcatgatatgttccacccagcttgacagggcccatggagtcagcagctacgacaccgtgattagccgggacattcaggcgccagacggactcgctgtcgactggatacactcgaacatctactggaccgattcggtcttgggtacggtcagcgtggcggacactaagggagtgaagcgcaagaccctgtttcgtgaaaacggctccaaaccccgggccatcgtggtggatccagtgcatggcttcatgtactggacggactggggaaccccggccaagattaagaagggcgggctgaacggagtcgacatctactcccttgtcactgagaacatccaatggccgaacggaatcaccctggatttgctgtcgggccggctgtactgggtcgactcaaaactgcactcgatctcctcgatcgacgttaatggggggaatagaaagactatactggaagatgaaaaaaggctggctcaccctttcagcctggcggtctttgaggacaaggttttctggactgacatcatcaacgaagcgatcttctccgcgaaccgcctcaccggatcggatgtgaatttgctcgccgaaaacctgctcagcccggaagatatggtcctgttccacaacctgactcagccgcgcggggtgaattggtgcgagaggaccactctttccaatggcggctgtcagtacctgtgcctgccagcgccgcaaatcaatccgcattctccaaagttcacctgtgcctgtcctgacggaatgctgctggcgagggacatgagatcttgcctgaccgaggcggaagcagcggtggccactcaggaaacttcaactgttcgcctgaaagtctcgtcaaccgccgtgcgtactcagcataccacgactcgcccagtcccggacacttcccgcctgccaggcgcaacgccgggcttgactactgtcgaaattgtcactatgtcccaccaggcactcggagacgtcgcaggccgcgggaacgaaaagaaaccaagcagtgtgcgagcgctgtccatcgtcctgccaatcgtgctcctcgtgtttctctgcctcggtgtgttcctgttgtggaagaactggagactcaagaacatcaactcaatcaattttgataatcccgtgtaccagaaaactaccgaggacgaagtgcacatttgccataatcaggacgggtactcgtacccttccagacagatggtgtcacttgaggacgacgtggcc

SEQ ID NO: 320 - DNA, 2580 bp, Artificial Sequence
  Description of Artificial Sequence: Synthetic Transcript Sequence
atgggaccttggggctggaaactccggtggactgtggcgcttttgcttgccgctgcagggacggccgtgggagatcgctgtgaacgcaacgagtttcagtgtcaggacggaaaatgcataagttacaaatgggtttgcgacggcagtgccgagtgccaagacgggtctgacgagtcccaggagacatgtctcagtgttacctgtaagtcaggcgatttttcctgcggaggacgcgttaaccgctgtatcccccaattctggcgctgtgacggccaagtggattgcgacaacggctccgatgagcaaggttgtcctcctaaaacctgttctcaggatgagtttcgatgccacgacggtaaatgtatctcacgacagtttgtgtgcgactccgatcgggactgtctggacgggtccgatgaggcttcctgccctgtgttgacgtgtggacctgcctccttccaatgtaatagcagtacctgcataccacagctatgggcctgtgacaatgatcctgattgcgaggacgggagcgacgagtggcctcagcgatgccgtggactctacgtgttccagggcgatagttccccatgtagcgccttcgagtttcactgtctgagcggcgaatgtatccattcaagctggagatgtgatggcggtccagattgtaaggacaaatctgatgaggagaactgtgctgtggctacatgtaggcctgatgagtttcagtgtagtgatgggaactgtattcatgggagccgccagtgtgaccgcgaatatgactgtaaagacatgtctgatgaggtggggtgcgtgaatgtgacattatgcgagggtcccaataagtttaagtgtcatagcggcgaatgtatcaccctggacaaagtttgcaatatggcacgcgattgtcgggattggtccgacgagcctataaaagagtgcggcacgaatgagtgcctggacaataacggtggatgttcgcatgtctgcaatgacctgaagattggatatgagtgtgattgccctgacggattccagctggttgcgcagaggcggtgcgaagacattgacgaatgtcaggaccctgacacttgttctcagttgtgcgtcaatctcgaaggcgggtacaaatgccaatgtgaggaaggctttcagctcgatccacacaccaaagcctgcaaagcggtgggatccatcgcctacttatttttcacgaaccgacacgaggtccgtaaaatgactctggatagaagtgagtacactagtcttatccccaatctcagaaacgttgtggctttggatacagaggtcgcttccaataggatttattggtcagatctttcgcagcgcatgatttgttctactcaacttgacagggctcacggcgttagcagttacgatactgtcattagcagagacatccaggccccagacggcctggccgtggactggatacacagcaacatctactggactgatagcgtgttagggactgtatccgtggcagatactaaaggcgtgaagcgcaaaacgctgttcagagagaatggtagtaaaccacgcgcaatcgtcgtcgatccagttcacggttttatgtactggactgactggggcaccccagccaaaattaagaaaggcgggctcaatggcgtggatatttactctttggtgactgagaacatacagtggcctaatggtatcactctcgacctgcttagtgggaggctgtattgggtcgactccaagctgcactctatctctagcatcgacgtgaatggcggtaacaggaaaaccatcctggaggatgaaaagagactcgcccacccttttagcttggccgtcttcgaagacaaggtcttttggactgatataatcaacgaggctattttcagtgccaatcgtctgaccggctccgacgttaacctgctcgccgaaaaccttctctcccctgaggacatggtgttatttcacaacctaacacagcctagaggagtcaactggtgcgagcgcactaccctgtctaacggcgggtgccagtatttgtgcctgcccgcacctcagatcaaccctcacagtcctaagttcacgtgtgcgtgtccggatgggatgttgctcgcaagggacatgcgctcctgtctgacggaggccgaggccgcggttgcaactcaggagacatccactgtgcgcttaaaagtgtctagtactgcagtcaggacgcaacacacaactacccgccctgtgcctgacacatctaggctgcccggcgctacgccaggcctgaccaccgttgaaatagtgaccatgtcccaccaggccctgggagatgtagcgggtaggggcaatgaaaaaaagccatcttccgtcagagcactgagcatcgtactccccatcgttctgctggtgttcctctgcctgggagtgttccttttgtggaaaaactggagattgaagaatatcaacagcatcaacttcgacaatcctgtgtaccagaagacaaccgaagatgaggtccacatatgccacaatcaggacggttactcatatccatcccgccagatggtgagcttggaagacgacgtcgct

SEQ ID NO: 321 - DNA, 2580 bp, Artificial Sequence
  Description of Artificial Sequence: Synthetic Transcript Sequence
atggggccctgggggtggaaacttcggtggacagtggctctgctcctagctgccgctggaacagctgtgggagatcgatgcgagcggaatgaattccagtgccaggatggaaaatgtatcagttataaatgggtctgtgacgggagtgccgaatgtcaggatgggtcagacgaaagtcaggaaacatgcctttctgttacttgtaaatctggagattttagttgcggagggagagtaaaccggtgtatacctcagttctggcgctgtgatggacaggtggattgcgataatggatctgatgagcagggatgcccccctaagacatgttctcaggatgaatttcgatgtcacgatggaaaatgtataagtagacaattcgtttgcgattctgatagagattgcctcgatggatccgatgaagccagttgtccagtgctaacttgtggacctgcatccttccagtgtaactctagtacatgcatcccccagttgtgggcttgtgataacgatcccgattgtgaagatggatcggatgaatggccacagcggtgtaggggactctacgtgttccagggggattcttctccttgctctgcatttgaattccactgcctctcaggggaatgtattcattctagttggcggtgtgatggaggaccagactgtaaagataaatccgatgaagagaactgtgccgtggcaacttgtcggccagatgaattccagtgctccgatgggaactgcatccacgggtcccgacagtgtgatagggagtacgattgcaaagatatgtccgatgaagtagggtgcgtaaacgttacgctctgcgaagggcctaacaaattcaaatgtcattccggagaatgcatcacattagataaagtttgtaacatggctagagattgtagggattggtctgatgaacctataaaagaatgcgggacaaacgaatgccttgataataatggaggatgctcccatgtgtgtaatgatttaaaaatagggtacgaatgcgattgtccagatgggttccagctcgtggcacagcggcggtgtgaagatatcgatgaatgtcaggatcctgatacatgttctcaactatgcgtgaacctcgaaggagggtataaatgccaatgcgaggaagggtttcagctagatcctcacacaaaagcctgtaaagctgttgggtccattgcctatctcttcttcacaaatcgacacgaagttaggaaaatgactctcgatcgcagtgaatacacatcactcattcccaaccttagaaacgtagttgcactggatactgaagtagcctctaatcgaatttattggtcagatctttctcagagaatgatctgttcaactcagctcgatcgggctcatggagtttcctcatatgatacagtcatttctcgagacatccaagcccccgatgggctagctgtagactggatccactctaatatatattggactgattccgttctcggaactgtaagtgtggccgacacaaaaggggtaaaacgcaaaacactctttagggagaatgggtctaaaccccgcgcgattgtggtggatccagtgcacggatttatgtattggactgattgggggactcccgctaagattaaaaaaggggggttaaacggggtagatatctatagtcttgtaacagagaatattcagtggcccaacgggatcacacttgatctgctatctgggaggctttattgggtggattctaaactccactccatatcttccatcgatgtcaatgggggaaatcggaagacaatcctagaggatgaaaaacgccttgcccatccattttcactggctgtcttcgaagataaagtgttctggactgatataattaatgaagccatcttttcggctaaccgattgacaggatcagacgtgaacctactcgcagagaacttactatctcctgaggatatggtgcttttccacaacctcactcagccccgtggggtgaattggtgtgaacgaactactctgtcaaacggggggtgccagtacctatgtctgccagctccccaaatcaaccctcattcccctaaattcacttgcgcctgccccgatggaatgcttctggccagagatatgcggtcctgcctgacagaagctgaagcggctgttgctactcaagaaacatctacggtacgattaaaagtgtcttccacagcagtgaggactcagcatactactacacgccccgtgccagatacttctagattacccggagctactcctgggctgactactgtagaaatagtaacaatgtcccatcaggctcttggagacgttgcaggaagggggaacgaaaaaaaaccctctagtgtgagggccctgtcgatcgtgttacctatcgtactgctagtctttctatgtctaggagtgttcttactttggaaaaattggagactcaaaaacattaactcaattaattttgacaacccagtctatcagaaaacaacagaggacgaagtacacatttgtcacaaccaggacgggtattcctatcccagtaggcagatggtgagtctggaggatgatgtggca

SEQ ID NO: 322 - DNA, 2580 bp, Artificial Sequence
  Description of Artificial Sequence: Synthetic Transcript Sequence
atgggaccatggggatggaaattacggtggacggtcgctctcctcttggctgctgccggtactgcggtgggagaccgttgcgaacggaatgagtttcagtgccaggatggtaagtgcatttcttacaagtgggtatgcgacggatcggctgagtgccaggacgggagtgatgaatcgcaagaaacatgtttatcggtaacttgcaagtcaggagactttagctgtggcgggagagtcaaccgctgcattccccaattctggaggtgcgacggacaggtggactgcgataatggttccgatgagcaaggttgccccccaaaaacgtgctcccaagatgaatttcgttgtcacgatgggaagtgcatcagtcgtcagttcgtgtgtgatagcgaccgcgactgcctcgatggttcggacgaagcctcgtgccctgttttaacttgcgggccggcatcgttccaatgcaactcaagcacatgtattccacagttgtgggcctgcgataatgatcccgactgtgaggacggcagcgatgagtggccacaaagatgccgcgggctgtatgttttccaaggtgattcgagtccgtgctcggccttcgaattccactgcctttccggggaatgcattcatagttcgtggaggtgtgatggcggacccgattgcaaggataagtcagacgaggagaactgcgcggttgctacttgtcgacctgatgagtttcagtgttccgatgggaactgcatccacgggtctaggcaatgtgaccgggagtatgactgtaaggacatgtcagatgaagtcggctgtgtgaacgttacattgtgtgaaggcccgaacaaatttaagtgccattctggtgaatgcatcacattagacaaagtgtgcaatatggcaagagactgcagggattggtctgatgaacccattaaggagtgcggaacgaatgagtgcttggataataatggcggttgtagccacgtctgcaacgacttgaaaatcggttacgagtgtgattgccccgatggtttccagcttgtcgcccaaaggcggtgcgaggatatcgacgaatgtcaggaccctgatacctgctcacaactatgtgtaaatctcgaaggagggtacaagtgccagtgcgaggagggtttccaattggatccgcatacgaaagcgtgtaaggctgtaggtagtattgcgtatttgttcttcacaaaccgacacgaggtacgtaagatgaccctggaccgttcagagtacacgtctttaattccgaatctgcggaatgtcgttgcactcgatactgaagttgcgtctaatcgaatttattggtccgacctgtcccagcgcatgatctgcagcacccagctcgacagggctcatggcgtgagttcgtatgatactgttatttcacgggacattcaggctccagatgggctggcggtcgactggatacactctaacatctactggacagattctgttctaggaactgtgtccgttgctgatacgaagggagtgaagcgcaagacactctttcgggagaatggcagtaaaccacgtgcaattgtcgttgatccggtccacggatttatgtactggaccgattggggcacacccgcaaagatcaaaaaaggcggcttgaacggcgtcgacatatatagcttggtgactgagaatatccagtggcctaacggaattacgctggatttactttctggcagactctattgggtggattcaaagttacatagtatctcctctattgacgttaatggaggcaatcgaaaaactatcctggaggacgagaagcgcctagcccatcctttcagtctagctgtcttcgaagacaaagtcttttggactgatatcattaacgaggcaatattctccgccaatcgtttaaccggttctgacgttaatctcctcgctgagaacctgctctccccagaagacatggtattattccataacctcacccagccacgtggggttaactggtgcgagcgcaccacactatcgaacggaggatgccagtatctctgcttaccggccccgcaaattaatccccacagccccaagttcacgtgcgcatgtcctgatggaatgcttttggcacgagacatgcgaagctgcctaaccgaagcggaagccgcggtggcaacgcaggagacttcaacggttcgtctcaaggtctcctctactgccgtgcgaactcagcacacaactacccggccagtgcctgacacctctcgcctgccgggagccacaccggggttaacaacagtggaaatcgtgaccatgtcccaccaggccctcggcgatgttgcgggtcgtggaaacgagaagaaaccttcgtccgtccgcgcgttgtctatcgttctgcctatcgtcttactagttttcctgtgtctgggcgtcttcctcttgtggaagaattggaggttaaagaacattaactccataaatttcgacaaccctgtctaccaaaagactactgaggacgaagtgcatatttgccacaaccaggacggttacagctacccatccagacaaatggttagcttagaggacgacgttgcc

SEQ ID NO: 323 - DNA, 2580 bp, Artificial Sequence
  Description of Artificial Sequence: Synthetic Transcript Sequence
atggggccttgggggtggaaattgaggtggacggttgccctgctgctggcagccgcggggacggctgtgggagataggtgcgaaaggaatgagttccaatgtcaagacgggaagtgcatttcatacaagtgggtgtgtgatgggtcagcagaatgtcaagacggcagcgacgagtctcaagagacatgtctgagtgtcacctgtaaatctggagacttttcttgtggagggcgtgttaaccggtgcatcccacagttttggcggtgcgatggccaagtcgattgtgacaacgggtcagatgagcaggggtgtccaccaaaaacgtgctctcaagacgaatttcggtgccacgatggaaagtgcatatcccggcagttcgtgtgcgattctgatagagactgcctggacggctcggatgaagcatcctgccccgtgctgacatgcgggcccgcctcttttcagtgcaatagcagtacatgcatcccccagctttgggcatgcgataatgaccccgactgtgaagacggctccgacgagtggccacagaggtgccgaggcctctatgtgtttcaaggagacagttccccttgtagtgcatttgaatttcattgcctttccggagagtgcatacactcttcctggaggtgtgacggcggtcccgactgcaaagacaaaagcgacgaagagaattgtgccgttgccacatgtcgtcccgacgaattccagtgctcggatggcaattgcatccatgggagcagacaatgcgatagagaatatgattgtaaggacatgtcggatgaggttggctgtgttaatgtgactctttgcgagggacctaataagttcaaatgccatagcggggagtgcatcaccctggacaaagtctgtaacatggccagagattgtcgagattggagcgacgaacccattaaggagtgtggtacaaacgaatgcctggataacaacggcggttgttctcacgtgtgtaacgatctgaagattggatacgagtgtgactgtccagacgggttccagctggtagcccagcgccgctgtgaggacattgatgagtgccaggatccagacacttgcagccagttgtgcgttaatctggagggagggtacaaatgtcagtgcgaagagggcttccagttggatccacacactaaagcttgcaaggccgtgggctcgatagcttatttgttttttactaataggcacgaggttcgaaagatgaccctcgatcggagtgaatacacaagtctaattccaaacctccggaacgtggttgctctggacaccgaagtcgctagcaatagaatctactggagtgatttgagtcaacgaatgatatgctccacccagcttgacagagctcacggtgtctccagctatgataccgttatctcaagggacatacaggcccccgatggactcgcagtggattggattcactctaatatctactggaccgactccgtactaggaacggtgtccgtggcagacaccaagggtgttaagcgcaagacactgttcagggagaacggcagtaaacccagggccatagtcgtggacccagtgcacggatttatgtactggaccgactggggcactccagccaaaattaaaaaggggggcctgaacggtgtggacatctactcccttgttacagaaaacatccagtggccaaacggaattactttagatctgttgagtgggagattatattgggtggatagtaagctgcacagtatcagttctattgatgtgaatggagggaaccggaaaacgatccttgaagatgagaagcggctcgcccaccctttttccttggcagtgttcgaagataaggtgttttggacagatattattaacgaggccatcttttctgccaaccgcctaacggggtcagatgtgaatctacttgctgagaatttgctctcaccagaagatatggtgttgtttcataatctcacccagccacgcggcgtaaattggtgcgagaggacgaccctgtccaatggtggatgccagtacctgtgcctgcccgcgccacagatcaatccccactcacccaagtttacttgtgcatgtccagacgggatgctgctagctcgcgacatgcgatcctgtctgacggaggccgaggctgcggtggccacccaggaaaccagtactgttcggctgaaagtgtcctcgacagcagtgcgtacgcagcacaccaccactcggccagttcccgacacttctaggctccctggcgccacccccggactgaccacggtggaaatagttaccatgtcccaccaggctttgggcgacgtggcgggcaggggcaacgaaaagaaaccttctagcgtacgggccctctccatcgtgttgcccatagtcctcttggtattcctgtgtctcggcgtatttttgctctggaagaattggagactcaaaaacatcaactctatcaattttgataaccccgtgtaccagaagaccactgaagacgaggtacacatttgccataatcaagacgggtattcctacccctccagacagatggtgtccctcgaagatgatgttgcc

SEQ ID NO: 324 - DNA, 2580 bp, Artificial Sequence
  Description of Artificial Sequence: Synthetic Transcript Sequence
atgggaccgtggggatggaagctgcggtggaccgtggcgctcctcctggcggcagcaggaacggcagtgggtgaccgctgcgagaggaatgagttccaatgtcaggacgggaagtgcatctcctacaagtgggtgtgcgacggatcggccgaatgccaagacggctcagatgaatcgcaagaaacttgcctgtcagtgacctgtaaatcgggcgatttcagctgtggaggcagagtcaatcggtgtatccctcagttctggagatgtgacgggcaagtggactgcgataacggtagcgacgaacagggatgccctcccaagacttgttcccaagatgaattccggtgtcatgacggcaaatgcatttccaggcagtttgtgtgcgactcagatcgggactgcctggacgggtccgatgaggcttcctgcccggtcctcacctgcgggccggctagcttccaatgcaattcatcgacctgcatcccccaactttgggcatgcgacaacgaccccgattgtgaagatggatcagacgaatggccccagaggtgccgaggactgtacgttttccagggcgactctagcccgtgctcagcgttcgaattccactgcctctcgggagagtgcatccatagttcctggaggtgcgacggtggtccggactgtaaagacaaatccgacgaggagaactgcgcagtggctacgtgccggcccgacgaattccagtgctccgatggtaactgcatccacggaagcagacagtgtgaccgcgagtacgactgcaaggatatgtcggatgaagtgggctgcgtcaacgtgactctgtgcgaaggtccgaacaagtttaagtgccactcgggtgagtgcatcaccctcgacaaggtgtgtaatatggccagagattgtcgtgactggtccgacgaacctatcaaagagtgcggaactaatgaatgcctcgacaacaatgggggatgttcccacgtttgcaatgacctgaagatcggttacgagtgtgactgcccagacggcttccaactggttgcgcagcgccgctgcgaggacatcgacgagtgccaggatccagatacctgcagccagctgtgcgtgaacctcgaaggaggatacaagtgccagtgcgaggaaggattccagttggaccctcacaccaaggcgtgcaaggcagtcgggagcatcgcttatttgttcttcaccaatagacatgaggtgaggaagatgaccctggatcgctctgagtatacgtccctcatcccaaacctgcggaatgtcgttgcattggacaccgaagtggcctccaaccgaatctactggagcgacctctcgcagaggatgatctgctcaactcagctggaccgagctcatggagtgtcgtcttacgatactgttatctcccgggatatccaggctccggatggcctcgccgttgactggatccattcgaacatttactggaccgattccgtgctcggaaccgtctcagtggcggatacgaagggcgtgaagcgcaaaaccctgttcagagagaatggatcgaagccaagagcgattgtcgtcgacccagtgcatggctttatgtactggaccgactggggaaccccagcaaaaatcaaaaagggcgggcttaatggcgtcgacatctacagtctggtcactgaaaacattcaatggccgaatggaatcacccttgacctgctttcgggacgactctactgggtggattccaagctgcactccatctcctcgatcgacgtgaacgggggaaaccgcaagacgattctcgaggacgagaagcggcttgctcacccattctcattggctgtattcgaagataaagtgttttggaccgatatcatcaatgaggcgatcttcagcgcgaaccgcctcactggaagcgatgtgaacctcctggcggaaaatctcctgtcgcccgaggatatggtgctctttcataacctcactcaaccacgcggagtgaactggtgtgagcggacgactctgagcaacggaggttgccagtacttgtgcctcccggctccccagattaatcctcactcccctaaattcacgtgtgcttgtccggacgggatgctcctggcacgcgatatgagatcatgcctcaccgaagcggaagccgcggtcgcaacccaggagactagcactgtgcgcctgaaggttagttccactgcagtccgcacccagcacaccaccactcgccctgtcccggacacctcccgccttcccggggcgaccccaggacttactactgttgaaatcgtgacgatgagccaccaggccctgggcgacgtagccgggcgtggcaacgaaaagaaaccgtcctcggtgcgcgccctgtccattgtgttgcctatcgtgctgctggtattcctgtgcctgggcgtgtttctgctctggaagaattggcggctgaagaacattaactcgatcaactttgataacccggtgtaccaaaaaactactgaggatgaagtgcatatatgtcacaaccaagatggctacagctacccatcgagacaaatggtgtcattggaagatgatgtggcc

SEQ ID NO: 325 - DNA, 2580 bp, Artificial Sequence
  Description of Artificial Sequence: Synthetic Transcript Sequence
atggggccttgggggtggaagctgcggtggactgtcgctctgctgttggcggcggccggcactgctgtgggagatcgttgcgagcgcaacgagttccaatgccaggacggaaaatgcatcagctacaagtgggtctgcgatgggtcagccgaatgccaagacggatccgacgaatcccaagagacttgtcttagcgtcacgtgtaaatccggcgacttctcgtgtggtggccgtgtgaatcgctgcataccccagttctggcggtgtgatggtcaggtggactgtgataacgggtccgatgaacaaggatgtccaccaaaaacgtgctcccaagatgagttccgatgccacgacggaaagtgcatctcgagacaattcgtgtgtgactccgaccgagactgcttggatggctcggatgaagcctcctgccctgtgctcacttgcggccccgcgtctttccagtgcaacagctctacttgtatcccgcagctgtgggcctgtgacaatgacccggactgtgaggacggatcggatgaatggccacagagatgtcgcgggctgtacgtgttccagggggacagctcgccttgctcggccttcgagttccactgcctgagcggagagtgcatccactcctcatggcggtgtgacggaggcccagattgcaaggataagtccgatgaagaaaactgcgccgtggcgacgtgtagacctgacgaatttcaatgctcagatggcaactgcatccacggaagcaggcagtgtgatcgcgaatacgactgcaaagatatgtcagacgaggtgggatgtgtgaacgtgactctgtgcgaaggtcccaacaaattcaagtgccactcgggggagtgcattacgctggataaggtgtgcaatatggcccgggactgcagagactggtctgacgagccaatcaaggaatgcggaaccaacgaatgcctcgacaataacggtggctgctcgcacgtctgcaacgatctgaaaatcggctacgagtgcgattgcccagatggttttcaactcgtggcccaacgcagatgcgaggacatcgacgagtgccaagacccggacacttgctctcaactgtgtgtgaatttggaaggcggatacaagtgccagtgcgaagagggattccagttggatccacacaccaaggcgtgcaaggcggtgggatccattgcctatcttttctttactaacagacatgaagtcaggaagatgactctcgacagaagcgaatacacgtctctgatccccaatctccgcaacgtggtcgcgctggacacggaagtggccagcaatcgcatctactggtcagatctctcgcaacggatgatctgttcgacccagctggatcgcgcccacggagtctcgagctacgacaccgtcatctcgcgggacatccaggcacctgacggactggcagtggattggatccattccaacatttactggactgactctgtcttgggcaccgtgtcggtcgcggacactaaaggagtgaagagaaagaccctgttccgggaaaacggcagcaagcctcgcgcgatcgtggtggaccctgtccacggtttcatgtattggaccgactggggaactccggccaaaatcaaaaagggaggtcttaacggagtggacatttactcgttggtcaccgaaaacatccagtggccgaacgggattaccctggacctgctgtccggtagactttactgggtggatagcaagctccacagcatcagcagcatcgatgtgaacggagggaaccgcaagactattctcgaagatgagaagcggttggcacacccatttagcctcgcggtgttcgaggataaggttttttggacggatatcatcaacgaggcgatcttctccgcaaaccggctgaccggctccgacgtgaatctcctcgccgaaaatctgctctcgccagaggacatggtcctgtttcacaatctgacccaacctagaggggtcaattggtgcgagcgcaccaccctcagcaacggaggatgccagtacctttgtctgccggccccgcagattaatccgcactcgcctaagttcacttgcgcatgccccgatggaatgctgctggccagagatatgcgctcctgtctgactgaagctgaggcggcagtggcaactcaggagacttccaccgtgcgcctcaaagtctcctctaccgcggtgcggacccagcataccactactcgcccggtgccggacacctcccgcttgcctggcgccaccccaggattgactaccgtggaaatcgtgaccatgtcacaccaggctctgggcgatgtggctggtcggggaaacgagaagaaaccctcctccgtgcgggctctgtcgatcgtcctgccgattgtgttgcttgtgttcctgtgtctgggggttttcctcctctggaagaactggcggttgaagaacatcaactcaatcaattttgacaatccggtgtaccagaaaactaccgaagatgaagtgcatatctgtcacaaccaggacggatactcctacccgagcaggcagatggtgtcactcgaggacgatgtcgcg

SEQ ID NO: 326 - DNA, 2580 bp, Artificial Sequence
  Description of Artificial Sequence: Synthetic Transcript Sequence
atgggtccgtgggggtggaagctccggtggactgtggccctgctgctggcagccgctgggactgctgtcggcgacagatgcgaaagaaacgagttccagtgtcaggacggcaagtgtatctcatacaagtgggtctgcgacggcagcgccgagtgccaggacggatcagacgagtcgcaggagacttgcctgagcgtcacttgtaagtcaggagatttctcgtgcggaggtagagtgaatcggtgcatccctcagttctggcgctgtgatggacaggtggactgtgacaatggatccgacgagcaaggatgcccgccaaaaacgtgctcccaagatgagttcaggtgccatgacggaaaatgcatctcacggcaatttgtctgcgattccgatagggattgcctggatggtagcgacgaggcctcttgccctgtgctgacctgcggaccggcctcttttcagtgcaattcctctacttgcattcctcagctctgggcatgcgacaatgatcccgactgtgaggacggatccgacgaatggccgcagcggtgccggggactgtacgtgttccaaggagactcctcaccctgttccgcgtttgagttccactgcctgtccggagagtgtatccattcctcctggcggtgcgatggaggacccgactgcaaggacaagtcggatgaggaaaattgcgcagttgccacttgtcggccggacgagttccaatgctcagacggcaactgtatccacggatcgaggcaatgtgatcgggagtacgactgcaaagatatgtccgacgaagtgggatgcgtgaacgtgactttgtgcgaaggtccgaataagttcaagtgccactcgggtgaatgcattaccctcgacaaagtgtgcaatatggcacgcgactgtcgcgactggtccgatgaaccgatcaaagaatgcggtacgaatgagtgcctcgacaacaacgggggatgttcacacgtgtgtaacgatctcaagatcggttacgaatgcgactgcccggatggctttcagcttgtggcgcagcggaggtgtgaagatatcgatgagtgccaagacccggatacttgcagccaactgtgcgtgaacctggaaggaggatacaagtgtcagtgcgaagaaggttttcagctcgatccacataccaaagcgtgtaaggctgtcggctcgatcgcctacctgtttttcacgaatagacatgaagtgaggaagatgaccctggaccggtcggaatacacttcgctgattccgaacctgagaaacgtggtggccctggacaccgaagtggcctccaaccggatctactggtcagatctgagccaacggatgatctgttccacccaactggaccgagcccacggcgtctcgtcctacgataccgtcatatcgcgggacattcaggcgccggacggactggcggtggattggatccactccaacatctactggaccgattcagtgctgggaaccgtctcggtcgcggacaccaagggcgtgaagcgcaagaccttgttccgggagaatggatcaaagcctcgagccatcgtggtggaccctgtgcacggcttcatgtactggacggactggggaacccctgcaaagatcaaaaaaggtggtttgaatggagtggacatttactcgcttgtgaccgaaaacatacaatggcccaatggcatcaccctggacttgctgagcggccgcctgtactgggtggactccaagttgcattccatctcatcgattgatgtcaacggaggaaacagaaaaaccatcttggaagatgagaagagactggctcatcccttctccctcgctgtctttgaggataaggttttctggaccgacatcatcaacgaagctatcttctcggccaacaggctgaccgggtcggacgtgaacctgctcgccgaaaatctgctgagcccagaagatatggtcctgttccacaacttgactcagccacgcggcgtgaactggtgcgagaggaccactctgtcaaatggaggctgccaatacctctgtctcccggcgccgcagatcaacccgcactcaccgaaattcacctgcgcctgtcctgatggcatgctgctggcccgggatatgcggtcctgcctgacggaggccgaggctgcggtggccactcaggaaacctccactgttcgcctgaaagtgtccagcaccgcagtgcggacccagcatactacgacccggcctgtgccggatacttcgcgcctgcctggagccaccccgggactgacgactgtcgagatcgtgaccatgtcgcaccaagcgctgggtgatgtggccgggaggggaaacgaaaagaaaccatcctcagtcagagcgctgagcatcgtcctccccatcgtgctgctggtgttcctttgcctcggggtctttctgctgtggaaaaactggcggctgaagaatatcaattccattaacttcgacaacccagtctatcaaaagacgaccgaagatgaagtgcacatctgccacaaccaagacggttattcttacccatcacgacagatggtgtctttggaagatgacgtggcg

SEQ ID NO: 327 - DNA, 2580 bp, Artificial Sequence
  Description of Artificial Sequence: Synthetic Transcript Sequence
atgggtccgtggggttggaaactacgttggacggtagcgctactattagcggcggcgggtacggcggtaggtgatcgttgtgaacgaaatgaatttcaatgtcaagatggtaaatgtatatcgtataaatgggtttgtgatggttcggcggaatgtcaagatggttcggatgaatcgcaagaaacgtgtctatcggtaacgtgtaaatcgggtgatttttcgtgtggtggtcgtgtaaatcgatgtataccgcaattttggcgatgtgatggtcaagtagattgtgataatggttcggatgaacaaggttgtccgccgaaaacgtgttcgcaagatgaatttcgttgtcatgatggtaaatgtatatcgcgtcaatttgtatgtgattcggatcgtgattgtttagatggttcggatgaagcgtcgtgtccggtactaacgtgtggtccggcgtcgtttcaatgtaattcgtcgacgtgtataccgcaactatgggcgtgtgataatgatccggattgtgaagatggttcggatgaatggccgcaacgttgtcgtggtctatatgtatttcaaggtgattcgtcgccgtgttcggcgtttgaatttcattgtctatcgggtgaatgtatacattcgtcgtggcgttgtgatggtggtccggattgtaaagataaatcggatgaagaaaattgtgcggttgcgacgtgtcgaccggatgaatttcaatgttcggatggtaattgtatacatggttcgcgacaatgtgatcgtgaatatgattgtaaagatatgtcggatgaagttggttgtgtaaatgtaacgctatgtgaaggtccgaataaatttaaatgtcattcgggtgaatgtataacgctagataaagtttgtaatatggcgcgagattgtcgtgattggtcggatgaaccgataaaagaatgtggtacgaatgaatgtttagataataatggtggttgttcgcatgtatgtaatgatctaaaaataggttatgaatgtgattgtccggatggttttcaactagttgcgcaacgacgttgtgaagatatagatgaatgtcaagatccggatacgtgttcgcaattatgtgtaaatttagaaggtggttataaatgtcaatgtgaagaaggttttcaattagatccgcatacgaaagcgtgtaaagcggtaggttcgatagcgtatctattttttacgaatcgacatgaagttcgtaaaatgacgttagatcgatcggaatatacgtcgctaataccgaatctacgtaatgtagtagcgctagatacggaagttgcgtcgaatcgaatatattggtcggatttatcgcaacgtatgatatgttcgacgcaactagatcgagcgcatggtgtatcgtcgtatgatacggtaatatcgcgagatatacaagcgccggatggtctagcggttgattggatacattcgaatatatattggacggattcggtattaggtacggtatcggttgcggatacgaaaggtgtaaaacgtaaaacgctatttcgtgaaaatggttcgaaaccgcgtgcgatagtagtagatccggtacatggttttatgtattggacggattggggtacgccggcgaaaataaaaaaaggtggtttaaatggtgtagatatatattcgctagttacggaaaatatacaatggccgaatggtataacgttagatctattatcgggtcgtttatattgggtagattcgaaactacattcgatatcgtcgatagatgtaaatggtggtaatcgaaaaacgatactagaagatgaaaaacgtttagcgcatccgttttcgctagcggtttttgaagataaagttttttggacggatataataaatgaagcgatattttcggcgaatcgattaacgggttcggatgtaaatttattagcggaaaatctattatcgccggaagatatggttttatttcataatctaacgcaaccgcgtggtgtaaattggtgtgaacgtacgacgttatcgaatggtggttgtcaatatttatgtttaccggcgccgcaaataaatccgcattcgccgaaatttacgtgtgcgtgtccggatggtatgttactagcgcgagatatgcgatcgtgtctaacggaagcggaagcggcggttgcgacgcaagaaacgtcgacggtacgtttaaaagtatcgtcgacggcggtacgtacgcaacatacgacgacgcgaccggtaccggatacgtcgcgtttaccgggtgcgacgccgggtctaacgacggtagaaatagtaacgatgtcgcatcaagcgctaggtgatgttgcgggtcgtggtaatgaaaaaaaaccgtcgtcggtacgagcgctatcgatagtattaccgatagtattactagtatttctatgtctaggtgtttttctactatggaaaaattggcgactaaaaaatataaattcgataaattttgataatccggtatatcaaaaaacgacggaagatgaagtacatatatgtcataatcaagatggttattcgtatccgtcgcgacaaatggtttcgctagaagatgatgtagcg

SEQ ID NO: 328 - DNA, 2580 bp, Artificial Sequence
  Description of Artificial Sequence: Synthetic Transcript Sequence
atgggcccatggggctggaagctgaggtggaccgtggccctgctccttgccgctgccggaaccgccgtgggtgaccgttgcgagagaaacgagttccaatgccaagacggcaaatgtatttcctacaagtgggtgtgtgatggctctgccgagtgccaggacggctcagatgagagtcaggaaacctgcctgagtgtaacttgtaaatctggtgacttttcatgtggaggcagggtgaacagatgtattccccagttctggcgctgcgatggacaggtcgactgtgataatggcagcgatgagcagggttgcccaccaaaaacttgttcccaagacgaatttcgttgtcacgatggcaagtgcatatcaagacagtttgtctgtgattcagaccgcgattgtctggacggttctgacgaggcaagctgtccagtcctgacatgcggtcctgcttcttttcagtgcaatagctctacatgtattcctcagctctgggcttgtgataacgaccccgattgtgaagacggaagcgacgaatggccacagcgctgccgtggactgtacgttttccaaggtgactcttccccctgctcagctttcgaattccactgtctgtccggcgagtgtatccattcaagctggcgttgtgacggcggacctgactgtaaggataaaagcgacgaggagaattgtgccgtcgcaacttgccgtccagacgaattccagtgctcagatggtaattgtattcatggtagtcgtcaatgcgacagggagtatgactgcaaagacatgtcagacgaagtgggttgcgtgaatgtaaccctctgtgagggacccaacaaatttaagtgtcattctggtgaatgtattacccttgacaaggtctgcaatatggctcgcgattgcagagattggtccgacgagcccatcaaagaatgtggtactaacgagtgtctcgataataatggtggttgctcccacgtttgcaacgacctcaaaatcggatatgagtgcgactgcccagacggcttccaattggtggcacagagacgttgcgaagatatcgacgagtgccaggaccctgacacttgtagtcagctgtgtgtcaacctcgagggcggatacaagtgccaatgtgaggagggtttccaacttgacccacacacaaaggcatgcaaggctgttggcagtatcgcctacctgtttttcaccaatcgccacgaggtgcgtaagatgactctcgatcgttctgaatacactagtcttatccccaacctcaggaacgttgtggccttggatacagaagtagccagcaatcgcatctactggtctgacctgtcacagaggatgatatgctccacccagttggaccgcgcccatggtgtttcctcctacgacactgtcatctctcgtgatatacaggccccagatggacttgccgtggactggatacactctaacatttactggactgattctgtgcttggaaccgtttctgtggccgatactaagggagttaaaagaaaaaccctgtttagggaaaacggcagtaagccacgtgcaattgtggttgatcctgtccacggctttatgtactggaccgattggggcacccctgcaaagattaagaaaggcggtctgaacggcgtagacatctattctttggtgactgaaaacattcagtggcctaatggtattactctggaccttctctccggtaggctctactgggtagacagcaaactgcattccatttcaagcatcgacgtcaacggaggcaacaggaaaaccattctcgaggacgagaagagactcgctcatccattttctcttgctgtgtttgaggacaaagtgttctggaccgatattatcaatgaggccatttttagtgctaacagactgactggtagcgatgtgaacctgcttgctgaaaacttgctctctcctgaggacatggtattgtttcacaatctgacccagccaagaggtgtgaattggtgtgaacgcaccactctgtcaaacggtggatgccagtatctgtgcctgcctgctccacagatcaaccctcactctccaaagtttacatgcgcatgcccagatggtatgctcctcgctagggacatgagatcctgcctcacagaggcagaggctgcagtggcaactcaggaaacttcaaccgtgaggctgaaggtgagctctaccgctgttcgcacacagcacaccacaacacgtcctgtccccgatacttctcgtctcccaggcgccacacctggtttgacaaccgttgaaattgtgactatgtctcaccaggctttgggagatgtagccggccgtggcaatgaaaagaagccctcttccgttcgcgcactgtccatagtgttgcctattgtgctgttggtgtttctctgtcttggtgtgtttctcctgtggaagaattggagactgaagaacattaactcaatcaatttcgataacccagtgtatcaaaagactactgaggacgaagttcacatttgccacaaccaagacggctactcatacccctctcgccagatggtatccctggaagacgacgtggct

SEQ ID NO: 329 - DNA, 2580 bp, Artificial Sequence
  Description of Artificial Sequence: Synthetic Transcript Sequence
atgggaccctggggctggaaactgcggtggactgttgctttgctgttggcggccgcgggaacggccgtgggcgatagatgcgagcggaatgagttccagtgccaagatggaaaatgcatctcatacaagtgggtgtgcgacggatccgccgaatgtcaagacggctcggacgaatcacaagaaacttgcctgtcagtgacttgtaagtccggggacttctcctgcggtggccgggtgaaccgctgcattccacagttctggcgctgcgatggacaagtggactgcgacaatggctcggatgaacagggatgcccaccaaagacctgttcacaggatgaattccgctgccacgatggaaagtgtatctcaaggcagtttgtctgcgacagcgacagggactgcctggacgggagcgacgaagcatcatgtccggtgcttacttgcggacctgccagcttccaatgcaatagctcgacgtgcatccctcagctgtgggcctgtgacaatgatccggattgcgaagatggctcggacgagtggcctcaaagatgcaggggactgtacgtgttccaaggagactcgtccccttgctcggctttcgagtttcattgccttagcggagaatgcattcattcatcctggaggtgtgacggagggccggactgcaaagacaagtcagacgaggaaaattgtgccgtcgcgacgtgcaggcctgacgaattccagtgctcggacggcaactgtatccacggttcccgacagtgcgatagagaatacgactgtaaggacatgtcagacgaggtgggttgcgtgaacgttactctgtgtgagggtcctaacaagtttaagtgccacagcggcgaatgcatcactcttgacaaagtctgtaacatggcgcgagactgcagagactggtccgacgaaccaatcaaagagtgtggcactaatgaatgtcttgataacaacggtggatgctcccacgtgtgcaacgatctgaaaatcgggtacgagtgtgactgtccggacgggtttcagctcgtggcgcaacggcggtgcgaggatatagacgaatgccaggatcctgacacgtgctcacagctctgtgtgaacctcgagggcggatacaaatgccagtgcgaagagggattccagctggacccgcataccaaggcatgcaaggctgtcggctcgatcgcttatctgttctttactaaccgccacgaggttagaaaaatgactctcgaccgctcagagtacacctcgctgataccgaaccttcgcaacgtggtggctctggacactgaagtggcaagcaatcggatctactggtccgatttgtcgcagagaatgatctgctcaacccagctggacagagctcacggcgtatcatcatacgacaccgtgattagccgcgatatccaggcaccggacggcctcgcagtcgactggatccattcgaacatctactggaccgactctgtcctcggaaccgtgtcggtggccgataccaaaggggtgaaacggaaaacgctgtttcgggaaaacggctcgaaaccgcgggccatcgtcgtcgatccggtgcacggattcatgtactggaccgattgggggaccccggcaaagatcaaaaagggcggacttaatggggtggacatctactccctggtgaccgaaaacattcagtggccgaacggaatcactctggatctgctcagcggtcgcctgtattgggtcgactcgaagctgcactccatatcatcaatcgatgtgaatggaggcaacaggaaaaccatcctcgaagatgaaaagaggttggcccatcctttctcgctggccgtgttcgaggacaaggttttctggaccgatatcattaatgaagctatcttctcggcgaaccgcctgaccggaagcgacgtgaacctgctcgcagaaaacctgctgtccccggaggatatggtgctgttccacaatctcacccaaccgcggggtgtgaactggtgcgaacgcaccactctgtctaatggaggatgtcaatacctgtgtttgccggcgccgcagatcaatccacattcgcccaaattcacctgcgcttgcccggatggaatgctgctggcacgcgatatgagatcctgtctgactgaggctgaagccgcagttgccactcaggaaacttcgacggtccgcctgaaggtatcgtcaactgccgtgagaacccagcatacgaccacgcgcccggtccccgatactagtagactgcctggtgccaccccaggacttactaccgtcgagattgtcacgatgtcccatcaggcgctcggcgacgtggccggacgggggaacgaaaagaaaccgtcgtccgtgcgggctctgtcaattgtgctgccgatcgtcctgttggtgtttctctgcctgggggttttcctcctgtggaagaactggagactgaagaacatcaactcgatcaatttcgataatccagtctaccaaaagaccactgaggatgaggtgcacatctgtcacaatcaggacggatactcatacccgtcgcgccagatggtgtcactggaggacgacgtggca

SEQ ID NO: 330 - DNA, 2580 bp, Artificial Sequence
  Description of Artificial Sequence: Synthetic Transcript Sequence
atggggccatggggatggaagctgcgttggacagttgccctacttctcgcagcggcgggaacagcagttggagacagatgtgagcgtaatgaattccagtgccaggatggaaaatgcattagttacaaatgggtctgtgatggcagtgctgagtgccaagacggatcggatgaatctcaagagacgtgccttagtgtcacgtgcaagtctggggacttctcctgtggtggaagagttaatagatgtattccacaattttggcgctgcgatggtcaagtggattgtgacaacggatcagatgaacaaggatgtccacccaaaacatgttctcaggatgaattccgttgtcatgacggaaagtgtatctcgcgccagttcgtgtgcgacagtgatcgagattgtctggatggatctgatgaagcgtcttgcccagttctcacttgcggtccagcatcattccagtgtaattcaagtacatgtatcccacagttgtgggcctgtgataacgatccggattgtgaagatggtagcgacgagtggccacaacgttgtcgcggactttacgtatttcagggagatagttcaccgtgtagtgcttttgaatttcattgtctctctggagaatgcattcacagttcatggagatgcgatggaggtccggactgtaaagataagtcagatgaggagaactgtgctgtggccacctgccgtccggacgagttccaatgtagcgacggtaattgcattcacggatcgagacaatgcgatcgagaatacgattgcaaggatatgtcggatgaagtggggtgtgttaatgttacactttgtgaaggaccaaacaagtttaaatgccattcgggggagtgtatcacattggataaggtctgtaatatggcgcgtgattgtcgtgattggtcagacgaaccaataaaggaatgcggaacgaatgagtgtttggataacaacggtggatgctcccacgtttgcaatgatctgaaaataggatacgagtgtgactgtcctgatggttttcaattagtggcacaaagacgttgcgaagatatcgatgagtgccaagatccagatacatgctcgcaactttgtgtaaatttggagggaggatacaaatgtcaatgtgaagaaggattccaacttgatccacatacaaaggcctgtaaggcagttgggagcattgcataccttttcttcacaaaccgccatgaagttcgaaaaatgacactcgacaggagcgagtatacttcgctgataccgaatctaaggaatgtggttgcgctggacacggaagttgcatccaaccgaatttactggagcgacttgtcacaaagaatgatttgctctacacagcttgatagggcccatggagtgtcatcatatgatactgtcatttcaagagatattcaagcccctgacggactcgcagtggattggattcattcgaatatctattggaccgatagcgtgttgggaaccgtctccgtggccgatactaagggtgttaaaaggaagaccctctttagggagaacgggtctaagccgcgagcaattgtcgttgatcctgtacatggatttatgtactggacagactggggaactccagctaaaataaagaaaggaggtctgaatggagttgatatttactctctggtcacagaaaatatccagtggccgaatggtatcaccttggatttattgagtggcagactttactgggtggactcaaagctccactctattagctcgattgacgttaacggagggaataggaagacaattttagaggacgagaaaagactcgctcacccattttccttggctgtgttcgaggataaagtcttctggaccgacatcatcaatgaagcaattttctccgcaaatcgactgacaggaagtgatgtgaatctgctcgctgagaacttgctctccccagaggacatggtactgttccacaatctcactcaaccacgaggagtaaattggtgcgaacgtactaccctatcgaacggaggatgtcaatatttatgtttgcctgcaccacaaattaacccgcattctccgaagtttacatgtgcttgtccagatggaatgctgttggctagagatatgcgatcctgccttacagaggctgaagctgcagttgcgacgcaggagacaagtacggttcgtctcaaggtctcttcgacagccgttagaacgcaacatactactactagaccagtaccggatacttcacgactcccaggagcaacaccaggtctgaccaccgtggaaattgttactatgtcgcatcaggcattaggtgatgtggctggacgaggaaacgaaaagaagccaagttcagtgcgagcactctctatcgtgctcccaatagtgttgcttgttttcctttgcttgggagtttttctcctttggaaaaattggcgactcaaaaatattaatagcatcaactttgataacccagtctatcagaaaacgacggaagatgaagtccacatttgccataaccaggacggatatagttatccaagccgtcagatggtatcacttgaggatgatgttgct

SEQ ID NO: 331 - DNA, 2580 bp, Artificial Sequence
  Description of Artificial Sequence: Synthetic Transcript Sequence
atgggaccttgggggtggaaactgcgctggactgtggccctccttctggccgctgccggcaccgcagttggcgacagatgtgagcggaacgagttccaatgccaagatggcaagtgcatatcgtacaaatgggtgtgcgatggatcggcagagtgtcaggatggctccgatgagtcgcaagagacttgtctgagcgtgacttgtaagtcgggagatttctcgtgtggaggtcgcgtgaaccgatgtatcccacagttctggagatgcgatggtcaagtcgactgtgacaatgggagcgacgaacaaggttgccctcccaagacctgctcccaggatgaatttcgatgccatgacgggaagtgcataagccggcaatttgtctgcgatagcgatcgggattgtcttgacggcagcgacgaagctagctgtcctgtgttgacctgcggccccgcatcgttccaatgcaattcgtctacctgcattcctcagctgtgggcctgtgataacgatccagattgcgaggacggaagcgacgaatggcctcagcgttgccggggtctgtacgtgttccagggagattcctcgccttgttccgccttcgagttccactgtctttccggcgaatgtatccatagctcgtggaggtgcgatggcggccctgactgtaaggataagtcggacgaagaaaattgtgctgtggcaacctgtcgtcctgatgaatttcagtgttcagacggtaactgcatccacggatcacgccaatgtgatagagaatacgattgcaaggacatgagcgacgaagtcggatgtgttaacgtgaccctctgtgaagggcctaacaagtttaagtgtcattccggtgaatgtattacgctggataaggtgtgcaatatggccagggactgtcgcgactggtccgatgaacctatcaaagaatgcggaactaacgaatgtctggataacaacggaggctgctcgcatgtgtgcaatgatcttaagattggatatgaatgtgactgccctgatggattccagctcgtggcacaacggaggtgtgaagatatcgacgaatgtcaggatccagacacttgctcgcaactgtgcgtgaaccttgaaggaggatacaagtgccagtgcgaggaaggtttccaactggatcctcatactaaagcgtgtaaggcggtcggctccattgcatacctgtttttcactaatagacatgaagtgcgaaaaatgaccctggatcggtcggaatacacctcgttgatccccaaccttaggaacgtcgtggcccttgataccgaggtggcatcaaaccgaatatactggtcggatctgagccaaagaatgatttgctcaactcagcttgatcgagcacatggagtttcctcctacgacaccgtcatttcgcgggacattcaagcaccagacgggcttgcggtggattggatccatagcaacatctactggaccgatagcgtcctgggcaccgtctccgtggcagataccaaaggagtcaagcgtaagactctgtttcgagagaacggaagcaagccgcgagcgattgtggtggatcctgtgcacggctttatgtactggacggattggggtaccccggccaaaatcaagaaggggggcctgaacggagtggatatctatagtcttgtgactgaaaacattcaatggccaaacggaatcactcttgacttgctctcaggacggctctactgggttgactccaagctccactccatttccagcattgacgtgaacggaggaaaccggaaaacgattctggaagatgaaaagcgtctggcacaccctttttcccttgcagtgttcgaggataaagtgttttggacggacattatcaatgaggcgattttctctgcaaacagattgaccggtagcgatgtcaatcttcttgccgagaacctcctttcgcctgaggatatggtcctgttccataacctgacccagcctcgcggcgtgaactggtgtgagagaaccacgctgagcaacggcggatgtcaatacttgtgtctgccagcaccacaaatcaatccccattcaccaaagttcacctgtgcatgccctgatggcatgttgctggcccgggatatgcgctcctgccttaccgaggcagaggccgcagtcgctacccaggaaacgtcaactgtgaggcttaaggtttcgtcgaccgcagtccggactcaacataccaccactcggccagttcccgatacctcgagactgcctggcgccactcctgggttgacgaccgtcgaaattgtgactatgagccaccaagcacttggggatgtcgcaggacgcggtaacgaaaagaaaccatcgtctgtgagagcactgagcattgtgctccctatagtccttctggtgttcctgtgtcttggggtgtttcttctttggaagaactggagacttaagaacatcaactccataaactttgataacccagtctaccagaaaaccacggaggatgaggtgcatatttgccacaaccaggacggttactcatacccttcgcggcagatggtgtcattggaagatgatgtggca

SEQ ID NO: 332 - DNA, 2580 bp, Artificial Sequence
  Description of Artificial Sequence: Synthetic Transcript Sequence
atggggccttggggatggaagctgaggtggacggtcgcccttctcttggctgccgctgggactgccgttggagatcgttgcgaaagaaacgagttccagtgccaggatggcaagtgtatctcatacaaatgggtttgcgacggcagcgctgagtgtcaggacggttcagacgagagccaggagacttgtctctcggttacgtgtaagtcgggtgatttctcttgtggtggacgggtgaaccgttgcatcccgcaattctggcgttgtgacggccaggtggattgcgataatggctccgatgaacagggctgccccccaaagacttgcagccaagatgagttccgatgccacgatggcaagtgcatttccagacagttcgtctgcgacagcgacagagactgtctcgatggaagcgacgaggcgtcgtgccccgtcttgacctgcggccctgcttcgttccagtgcaattcctccacgtgcatcccccagctgtgggcgtgcgacaatgatcctgattgcgaggacggatcagacgagtggcctcaaaggtgtcgcgggctctatgtgtttcaaggcgatagctcgccatgctccgccttcgagttccactgcctgtccggcgaatgtattcatagctcttggcgttgcgacggtggccccgactgcaaggacaaatccgatgaagagaactgtgccgtcgcgacttgccgtcccgacgagtttcagtgcagcgatggtaactgcattcatggttcacgtcagtgcgatcgagagtacgattgcaaggatatgagcgatgaggtcggttgcgtcaatgtaaccttgtgtgagggtccaaacaagttcaagtgccatagtggagagtgcatcactctggacaaggtgtgcaacatggctcgtgactgcagggattggtcggacgagccaataaaagaatgtggaaccaatgagtgcttggacaataacggcggatgctcccacgtatgcaacgatcttaagatcggctacgagtgcgactgtcccgatggctttcaactagtggcccagaggcgctgcgaagatatcgatgagtgccaggatcccgatacctgttcgcagttgtgtgtcaatctggagggcggctacaagtgtcagtgcgaggagggttttcaacttgacccacacactaaggcgtgcaaagccgtgggatccatcgcttacctcttcttcactaacaggcacgaggtcagaaagatgactctggatcggtccgagtatacttcgctcattcctaatctacgcaacgttgtggccctggacaccgaggtcgcctccaacaggatctactggtcggatctctcccagcgtatgatctgtagcacccagctggatcgcgcgcatggtgtctcgtcgtacgataccgtcatctctcgggacattcaggcacctgatggccttgccgttgactggattcatagcaacatttactggaccgattctgtcctcgggaccgtttccgtggccgataccaagggagtcaagcgaaaaaccctctttcgcgagaatggttccaaacctcgtgctatcgttgtcgatcccgtgcatggcttcatgtattggacggactggggtaccccggccaagatcaaaaagggcggcctcaacggtgtggacatctacagccttgtaactgagaacatccagtggcccaatggaattacgctggatctattgagcggacgcctatactgggtcgattcgaagctgcactctatctctagcatcgacgtcaatggcggcaaccggaaaactatcttggaggacgagaagcgcctggctcatcccttctcgctcgccgtgttcgaggacaaagtgttctggaccgacatcatcaatgaagccatcttctccgctaaccgtctgaccggctccgacgtcaatcttctggccgaaaacctcttgtcccccgaggatatggtgctcttccacaaccttacccagccccgcggagtgaactggtgcgagagaacgacactaagtaacggaggatgccagtatctgtgtctacccgcgccccagattaacccccactcccccaagtttacctgtgcctgccccgatggtatgctgttggcacgcgatatgcgctcctgcctgactgaggccgaggccgctgtggcgacccaggagacgtccactgtacgcctaaaagtgtccagcaccgcggttcgaacccaacacaccacgacccgacccgtgcccgatacaagtcgtttgcctggcgcaacaccagggctgaccacagtggagatagtcaccatgtcccatcaggcactgggagacgtcgccggccggggcaacgagaagaagccctcatccgtccgtgccttgtcaatcgtcctccccattgtgttgctggttttcctctgtctgggggtttttctactttggaagaactggcgcttaaagaacattaactccataaacttcgataaccctgtctaccaaaagaccactgaggatgaggttcacatctgccataaccaagatggctactcttatccatcgcgccagatggtgtctctcgaggacgacgtcgcc

SEQ ID NO: 333 - DNA, 2580 bp, Artificial Sequence
  Description of Artificial Sequence: Synthetic Transcript Sequence
atgggaccctgggggtggaaacttcgatggactgtggcactgcttctggccgcggcgggaaccgcagtgggagatcgctgcgaaagaaatgagtttcagtgtcaggatggaaaatgcatctcatacaagtgggtgtgtgatggtagcgctgagtgtcaagatggatcagatgaatcgcaggaaacttgtctgtccgtgacctgcaagagcggtgactttagctgtggcgggcgcgtcaatcggtgtataccacaattctggcggtgtgacggccaagtggactgtgataacgggtcagatgagcagggttgtccaccaaagacttgttcacaggatgaatttaggtgccatgacggaaagtgcatttcccgccagtttgtgtgtgattccgatcgagactgtctcgacggatcggatgaagcatcttgccccgtccttacctgcggaccggcatcatttcagtgcaacagctcaacttgtattccgcaactgtgggcttgcgataatgaccccgactgtgaagatggctcagatgaatggccccagcggtgcaggggcctttacgtgtttcagggtgattcttcgccatgctcggcattcgaattccattgcctctccggtgaatgtattcattcatcatggcgatgtgatggaggcccagattgtaaggataagtcggacgaagagaattgtgccgtggcaacgtgtcgaccagatgaatttcaatgctcagatggaaattgcatacacggttcgaggcaatgcgaccgcgaatacgattgtaaagatatgagcgatgaagtcggttgtgtcaacgtgactctttgtgagggtccgaataagttcaaatgccattcgggcgaatgtattactcttgataaagtttgtaacatggcacgtgattgcagagattggagcgatgaacctatcaaggaatgtgggactaacgaatgtctcgataacaatggaggatgctcgcatgtgtgcaacgaccttaagattggatacgaatgcgattgccctgatggatttcaacttgtggcccagcggcgctgtgaggacatcgatgaatgccaggatcctgacacctgttcccagttgtgcgtgaatctggagggaggttacaagtgtcagtgtgaagagggatttcagctggacccacacactaaggcttgcaaagcggttggatccattgcatacctgtttttcactaaccgacatgaagtgcgtaagatgactctcgatcgcagcgagtacactagccttattcctaacctgcggaacgtagtcgccctggatactgaggtggcaagcaacaggatatactggagcgacctgtcgcagcgaatgatttgctcaacccaacttgatagagcgcatggtgtgtcaagctacgatacggtcatttcgcgcgatattcaagcacctgacggtcttgcagtggattggatccattccaacatttactggaccgactccgtgctgggtaccgtctcggtggctgacaccaaaggggtcaagagaaagactctcttccgcgagaacggttccaagccaagagcaattgtcgtcgatccagttcatggatttatgtactggactgattggggcacgccagccaagataaagaagggaggactcaatggtgtggacatttactcgcttgtgacggaaaacatccagtggccaaacggtataactctggatctgctttcaggcagactctactgggtcgattccaagttgcactcaatctcgtcgatcgatgtgaacggaggtaataggaaaaccattctggaggacgaaaagcggctcgcacatccattctccctggcagtctttgaagataaggtgttctggaccgatatcatcaatgaagcaatcttttccgccaaccgactcactggttcggacgtcaaccttctggccgaaaatcttctgtcccccgaggacatggtgctgttccataacctcactcaacctcgcggagtgaattggtgcgagcgcactactctgtcgaacggtggctgtcaatacttgtgcctccctgcaccacaaatcaaccctcattccccgaagttcacctgcgcatgcccagatggaatgttgctggcaagggacatgagatcctgtttgactgaggccgaggcagccgtcgcaactcaagaaacctccactgtcagactcaaagtctcgtctactgcagtccgcacccagcatactaccacccggccggtgcctgacaccagcagactccctggagcaacccccggactgactactgtcgaaatagtgactatgtcacatcaagcacttggggacgtggcaggacgcgggaacgagaaaaaaccctcctctgtccgcgcactctctattgtgcttcctatcgtccttctggttttcctttgcctgggagtgtttcttttgtggaaaaactggagactgaagaacattaactcgatcaactttgataaccctgtctatcaaaagaccaccgaagatgaagttcatatttgccacaaccaagacggatactcgtacccgtccaggcaaatggtgagccttgaggatgatgtggcc

SEQ ID NO: 334 - DNA, 2580 bp, Artificial Sequence
  Description of Artificial Sequence: Synthetic Transcript Sequence
atgggcccttggggctggaaactgaggtggacagtggcgctgctcctggctgctgccggcaccgccgttggtgacaggtgcgaaaggaatgagttccagtgtcaagatggcaaatgcatcagttataaatgggtctgtgatgggtccgccgaatgtcaggacggcagcgacgagtcgcaggaaacatgtctgagtgtgacctgtaaatcaggagatttcagctgtggcggaagggttaataggtgtatcccacagttttggcgctgcgacggccaggtggattgcgacaacgggagtgacgagcaagggtgtccccccaaaacctgttctcaagacgagttccgatgtcatgacgggaagtgcatctcacgtcagtttgtgtgtgactctgacagagattgcctggatgggagtgatgaggcctcctgtccggtattgacatgtggccccgcgtcattccagtgcaattcttccacctgtattccccagctctgggcctgcgacaacgatccggactgtgaagacggatctgacgaatggcctcagaggtgcagaggactgtacgtttttcagggggattcgagtccatgctcagcattcgagttccactgcctgtcgggtgaatgcatccactccagctggaggtgcgatggggggcctgattgtaaggataaatctgacgaagagaattgtgcggtggcaacctgtaggcccgatgagttccagtgctctgatggcaactgcatacatgggtccagacagtgtgaccgagagtacgattgcaaggatatgtctgatgaagttgggtgtgttaatgtcactctctgcgaggggcccaacaagttcaaatgtcactccggcgaatgcataaccttggataaagtttgcaacatggccagggattgtagggattggtccgatgagccgatcaaggaatgtggaaccaacgagtgcctggataataacggcgggtgctcccacgtatgcaacgatctgaaaatcggctatgagtgcgattgtcctgacggatttcagcttgtagcccagcggcgatgtgaagatatcgacgaatgccaggatccagacacgtgttcccagctgtgtgtgaatctggaggggggttataaatgccagtgtgaggaaggattccagctggatcctcacacaaaggcttgtaaggccgtaggatctatagcttacttgttttttacaaacaggcacgaagttagaaaaatgaccctcgatagatccgaatacacttcccttattccgaatctccggaacgttgttgccctggacactgaagtggcttcaaatcgaatttactggagcgatctcagtcagaggatgatctgcagtacccaacttgacagggcccatggggtgtctagttatgataccgtaatttccagagacatccaggccccagacggtttagcggtggactggattcactcgaatatctactggactgactccgtccttggcaccgtgtccgtggccgataccaagggtgtgaagcgcaaaacccttttcagggaaaatggcagcaagccgcgcgctatcgttgtcgatcctgtacatggattcatgtactggacagactggggtacacccgccaagatcaagaaagggggacttaacggcgtagacatctacagcctcgttaccgagaacattcagtggccgaacggaatcacacttgatctgctgagcggcaggctgtactgggttgattccaaattgcattccatcagtagtattgatgtgaacggaggtaaccgtaaaacaatccttgaagatgaaaagaggctggcgcatcctttttcgttggcagtgtttgaagacaaggtgttctggacagacatcataaatgaagctatcttcagcgccaatagactgacaggtagcgacgtgaacctgctggctgagaacttgctgagcccggaggacatggttctgttccacaatctcactcaacccaggggcgttaactggtgcgaacgaacaaccctgtccaatggtggctgccagtacctctgtttgcctgctccccagatcaacccccatagcccaaagttcacatgcgcttgcccagatggaatgttgctagccagagacatgcgatcgtgcctgacagaggcagaagcggccgtggccacacaggaaacttccactgtgcgacttaaggtgagctccacagccgtacgaacccagcatacgacgactcgccctgtccctgacaccagcaggctgcccggagccacccctggactaactacggtggagatagtaactatgtcacatcaggccctgggcgatgtagctggtcgcgggaacgagaaaaagcccagctctgtgagggccctctcaatcgttttacccattgtgcttttggtgttcttatgtctgggtgtgttcctcttgtggaaaaactggagactgaagaatattaacagtattaattttgataaccccgtttatcaaaagaccaccgaagatgaagtgcacatctgccataatcaggatggctacagttacccgtcacgacagatggtttctctcgaggatgacgttgct

SEQ ID NO: 335 - DNA, 2580 bp, Artificial Sequence
  Description of Artificial Sequence: Synthetic Transcript Sequence
atggggccgtggggatggaaactccgttggaccgttgctctcttgctggctgcggcaggcacggccgtgggcgaccgttgcgaacgcaatgagttccagtgccaggatggtaagtgcatcagctataaatgggtgtgtgatggctccgccgaatgccaggatggctctgatgaaagccaagagacctgcctcagcgtcacctgcaaatctggtgatttttcgtgcggcggacgagtcaataggtgcataccgcagttctggcggtgcgatggccaagtcgactgtgataacggcagcgatgagcagggctgtcctccaaaaacctgctcccaggacgaattccggtgccacgatggaaaatgcataagtcgccagttcgtgtgtgactcggaccgcgattgcctggatggctccgacgaggcgtcgtgtcccgtgctgacatgtgggcccgcttcctttcaatgtaactcctccacctgtataccccaattgtgggcgtgcgacaacgatcccgactgtgaggatggctcggatgagtggccgcaaaggtgccgaggactgtatgtttttcagggcgattcgtctccgtgctcagcgttcgaattccactgcctgtcgggtgaatgcatccactcaagttggcgctgcgacggggggccagactgcaaggataaatcggatgaggaaaattgcgctgtcgcgacatgtaggcccgatgaattccagtgctccgacggaaattgcatccatggcagtcgccaatgcgatcgggagtacgactgcaaagatatgagtgacgaagtgggatgtgtcaacgttaccctatgtgagggtccgaacaagttcaagtgccacagtggcgagtgcattaccttggacaaggtttgtaacatggcgcgagattgcagagactggagtgacgagcctatcaaggagtgtggaacaaacgagtgcttagacaataacgggggatgctcccacgtgtgtaacgacctgaagatcggatatgagtgcgattgtcctgacggtttccagctcgtggcgcagcggcgatgcgaggatattgacgagtgccaagaccctgatacctgttcacagttatgcgtgaaccttgagggtggatataaatgtcagtgtgaggagggctttcagctcgatccccacacaaaagcgtgcaaggccgtgggttccatcgcttacctgttcttcacgaaccgtcacgaggtgcggaaaatgactcttgatagatcggagtatacttcgcttatccctaacttgcgtaacgtcgtggccctggacacagaagtcgcttcgaaccgcatttactggagtgacctctcccaacgcatgatctgcagcacgcaactggatagggcgcatggcgtgagctcctacgataccgtgatctcgagggatattcaggccccggatggcctcgctgtggattggatccactccaacatatactggaccgactcggttttaggcaccgtcagcgtggccgataccaaaggagtaaagcggaagacgcttttcagggaaaacggaagtaagccccgggccatagtggtggatcccgtccacggatttatgtactggacggattggggaactccggctaagatcaaaaagggcggcctgaatggagtggatatctactccctggtgacagagaatatccagtggcccaatggcataactctggatttgctttcgggccgcttgtattgggtggactccaaattacattctatttctagcatcgacgtgaacggtggcaatcgtaagacgatcctggaagatgaaaaacgtctagcgcacccattttcactcgccgtctttgaagacaaggttttttggactgacatcattaacgaagctattttttccgcgaaccgtctcacgggatccgatgtgaatctgctggcagagaatctgctctcgcccgaggatatggtcctgttccataatctcacccagccaaggggagtaaactggtgcgaacgcacgacgctcagcaatggaggctgccagtacctgtgtctgcccgccccccaaataaatccgcattccccaaagtttacgtgcgcctgccctgatggtatgttgcttgcgcgcgatatgcggtcgtgcctgaccgaggcagaggccgcggtggccacacaggaaacgtccaccgtgcgcttgaaggtgagtagtactgcggtgcgcacccagcacacgacaacccgtccggtcccggacacatctcgcttgccgggcgcaaccccgggactgacaacggtggagatagtcactatgtcacaccaggctctgggcgatgtcgcgggtcgagggaatgagaagaagccaagttctgtccgggctctatccattgtgttgccgatcgtgctgcttgtcttcttgtgccttggtgtctttttgctgtggaagaactggcggttgaagaacatcaactccataaatttcgataacccagtttaccagaaaaccactgaagacgaggttcacatctgtcataatcaagatggctactcgtatccgtctcgccagatggtcagcctggaggatgatgttgca

SEQ ID NO: 336 - DNA, 2580 bp, Artificial Sequence
  Description of Artificial Sequence: Synthetic Transcript Sequence
atggggccttgggggtggaagctgcgctggactgtggcattgctgctcgctgcagcgggaaccgcggtgggagatcgatgcgaaaggaatgagtttcagtgtcaagatggcaagtgtatttcgtataagtgggtctgtgatggttcggctgagtgccaagatggatcggatgaatcgcaagaaacgtgcctctcagtgacctgcaagagcggggacttttcgtgcgggggaagagtcaacagatgtatcccgcaattttggcgttgcgatggtcaagttgactgtgacaatggctcggacgaacaggggtgtccccctaagacctgctcccaagatgaatttaggtgtcatgatggaaaatgtatcagccgccaattcgtgtgtgacagcgacagagactgtctggatgggtccgatgaggcttcctgccccgtgttgacctgtgggcctgcctcctttcaatgtaatagctccacctgcataccgcagttgtgggcatgcgacaatgaccctgactgtgaagatggttcggatgaatggccccagagatgccgggggctctacgtattccagggagattccagtccatgctcggcatttgaattccactgtctgagcggagaatgtattcattcatcgtggagatgtgatggcggtcccgattgtaaggataagagcgatgaggagaactgtgcagtggcaacctgtcgtccagacgaatttcaatgttcggatgggaactgcattcatggatcgcgacaatgtgatcgtgagtatgactgtaaggatatgtccgatgaagtgggatgcgtgaacgtgactctttgtgaaggtcccaacaaattcaagtgtcattcgggggagtgtattacgctcgacaaggtctgtaatatggccagggactgtagagattggagcgacgaaccgattaaagagtgtggaacgaacgaatgtctcgataacaatggaggatgcagccatgtgtgcaatgaccttaagattgggtacgagtgtgattgtccagacggttttcaactcgtcgcacaacggcgctgcgaggacatcgatgagtgccaggacccagatacctgctcccagctgtgtgtgaacctcgagggtggctacaagtgtcaatgcgaagaggggttccagctggatccacataccaaagcatgtaaagcggtgggttccattgcctacctgttctttactaaccggcacgaagtgcgcaagatgaccctggatcgttctgaatacactagcctcattcccaaccttagaaacgtggtggccttggacacggaagtggcctccaatcgcatctactggtccgatctttcgcaaagaatgatctgctccacccagctggatcgcgcacatggagtgtcatcgtacgacacggtgatttcacgcgatatccaagcaccagatggccttgcggtcgattggattcacagcaacatatactggactgattcagtgctggggaccgtgtcagtggcagatactaagggagtgaagagaaaaactctgtttcgagagaatgggtcaaaaccaagggcgattgtggtggaccctgtgcacggctttatgtactggaccgattggggtacgccagcaaagatcaaaaagggcgggctcaacggtgtggacatttactcgctcgtgactgaaaacattcagtggccaaacggtattactcttgatcttctgagcggacgcctgtactgggtggattccaagttgcactcgatttcatcgattgatgtcaacggcggaaaccgtaagaccatcttggaggatgaaaagagacttgcccacccattttcgcttgcagtgttcgaggataaggtgttctggaccgacatcataaatgaagccatcttcagcgcaaatcgtctcactggctcggacgtcaaccttcttgctgaaaacctcctttcgcctgaggatatggtgttgttccacaacctgacccagccaagaggcgtcaactggtgtgaaaggaccactctctccaacggaggatgtcagtacttgtgcttgcctgcaccacaaatcaatccgcattccccgaaattcacctgtgcgtgtcctgacggtatgctgcttgcacgggacatgaggtcatgcctgactgaagccgaagcagcagtcgcaacccaggaaacgtccacggtgcgcttgaaggtcagcagcaccgcagtgagaacccagcatactactactagacccgtgcctgatacctcgaggcttccaggagccactccaggcttgaccaccgtggaaatcgtgactatgtcccatcaagcccttggcgacgtggcaggtaggggaaatgaaaagaaaccatcgagcgtgcgagcactttccatcgtccttccaattgtgctcctggtgtttctctgccttggtgtgtttctgctgtggaaaaactggagattgaagaacattaactcaattaactttgacaatcccgtgtaccaaaagaccaccgaagatgaagtgcatatctgtcataaccaagatggatactcgtacccgtcccgccagatggtgtccctggaagatgatgtggca

SEQ ID NO: 337 - DNA, 2580 bp, Artificial Sequence
  Description of Artificial Sequence: Synthetic Transcript Sequence
atgggcccatgggggtggaaactgcggtggactgtggcgctgctcctggcggccgccgggactgcagtgggcgatcggtgcgagcgtaacgaatttcagtgccaagatggcaagtgtatctcatacaagtgggtgtgcgatgggagcgccgaatgtcaagatgggtccgatgaatcccaggaaacttgtctgtccgtgacgtgcaagtcgggagacttcagctgtggaggaagagtgaatcggtgtataccgcagttttggagatgcgatggccaagtcgactgtgataacggatcggatgagcagggatgcccacctaaaacctgttcgcaagatgaatttcgatgtcacgatggaaaatgcatttcgcgacagtttgtgtgcgactccgatcgggactgtcttgatggatccgacgaagcatcatgtccagtgcttacttgcggaccggccagctttcaatgtaatagctccacttgtatccctcaactttgggcatgcgataacgatcctgattgtgaggacggaagcgatgagtggcctcagagatgtagaggactttatgtgtttcaaggagactcctcgccatgtagcgcatttgaattccattgtcttagcggcgaatgtatccattcctcgtggcgatgcgatggcggtccggattgtaaggacaaatctgatgaagagaactgcgctgtggccacttgtcggcctgacgaattccagtgtagcgatggaaactgcattcatggatcacgccagtgtgatcgagaatacgattgcaaagacatgtcagatgaagtcggttgcgtgaatgtgactttgtgtgaaggacccaataagtttaagtgccattccggtgaatgtataacgcttgataaggtgtgtaatatggcaagagactgcagagactggtcggatgaaccaattaaggaatgtgggacgaacgaatgcctcgacaataacgggggctgttctcatgtgtgtaatgatctgaagatcggatacgagtgtgattgccctgatggttttcaactggtcgcccagcggagatgtgaagatatagacgagtgtcaggatccagatacctgttcccaactgtgtgtgaacctggagggtggctataagtgccagtgtgaggagggatttcagctggacccccataccaaggcctgtaaggccgtgggaagcatcgcgtacctcttcttcactaaccgccacgaagttaggaagatgacgcttgaccgcagcgaatatacttccctcattcccaacctgcgcaacgtcgtggcacttgacactgaggtggcatcaaaccgcatatactggagcgatctgtcgcagagaatgatttgttcaactcaactcgatcgcgctcacggtgtgtcaagctatgacaccgtcatttcgcgggatattcaagcacccgacggactggcggtcgattggatccattcaaatatctactggacggactcagtcctggggactgtgtctgtggcagacacgaagggcgtgaagcgcaagactctgtttcgggagaatggttccaagccacgtgccattgtcgtcgatcctgtgcacggattcatgtactggactgactggggcaccccagcgaagataaagaagggtggacttaatggagtcgacatttactcgcttgtcaccgagaacatacagtggccaaatgggataaccctggatcttctttctggtcgtctctactgggtggactcgaagctccattccatttcctcaatcgatgtgaacggtggtaaccgaaagaccattctggaagatgaaaaacgtctggctcatccatttagccttgcagtgtttgaggacaaggtgttttggactgatatcattaacgaggcaattttctcggccaatcgccttacggggtcagatgtgaacctgctggcagaaaacctgctttcgccagaggacatggtgcttttccataatctgacccaacctcgaggtgttaattggtgtgaaaggaccaccctctccaacggaggctgtcaatacctttgtctgcctgcccctcagatcaaccctcattcgcccaagtttacttgcgcatgtccggatggaatgcttctcgctcgggatatgaggtcgtgtttgactgaggcagaagctgcagtggccacccaggaaacgagcactgtcagacttaaggtgagctcgactgcagtccggacccaacatactactacccggccagtgcctgatacctcgcgcctgccgggtgcaaccccagggctcaccaccgtcgagattgtcactatgagccaccaggcgcttggtgatgtggcaggcaggggaaacgagaaaaagccgtcctccgtgcgggcactctccatagtgctgcccatcgtgctgcttgtctttctttgtcttggagtgtttttgctttggaagaactggaggctcaagaacatcaactcgatcaactttgacaacccagtgtaccaaaaaactaccgaagatgaagttcacatttgccacaaccaggatggatactcatacccatccaggcaaatggtttcacttgaggatgatgtggcc

SEQ ID NO: 338 - DNA, 2580 bp, Artificial Sequence
  Description of Artificial Sequence: Synthetic Transcript Sequence
atgggcccgtggggctggaagctccgctggaccgtggcgctcctgctggccgccgcggggaccgcagtgggggaccgctgcgaacggaacgagttccagtgccaagacggaaaatgtatttcgtacaaatgggtgtgtgacgggtctgctgagtgccaggacggctcagatgagtctcaagaaacctgcctgagcgtcacttgcaagtccggcgatttctcctgcggagggagagtgaaccggtgcatcccccagttttggcgctgtgacggccaggtggactgcgacaacggcagcgatgaacaggggtgcccgccgaaaacctgctcccaggatgagtttcgctgccatgatggtaagtgcatcagcagacaatttgtgtgtgattcggatcgtgactgcctcgacggaagcgacgaggcgtcctgtccagtgctcacttgtggacctgcatccttccagtgtaacagctccacctgcattccgcagctgtgggcctgcgacaacgacccggattgcgaggacggatcagacgaatggccccagcggtgccgcggcctgtacgtctttcagggggactcctcgccttgctccgcgttcgaatttcactgcttgtcaggagaatgcatccactcatcctggagatgcgacggaggtcctgactgcaaggacaaatcagacgaagaaaactgcgccgtggctacctgccgcccagacgaattccagtgctccgacggcaactgtatccacgggtcgcggcagtgcgaccgcgagtacgactgcaaagacatgtcggacgaagtcggctgcgtgaatgtgaccttgtgcgaaggaccgaacaagttcaagtgtcacagtggtgagtgcatcactttggataaggtgtgtaacatggcgcgcgattgcagagactggtccgacgaacctatcaaagaatgtggaaccaacgagtgcctggataacaatggcgggtgttcccatgtgtgtaacgatctgaagatcggttacgagtgcgactgtccggacggctttcagctggtggcgcagcgacgctgcgaagatatcgacgaatgtcaggatccggacacgtgctcccagctctgcgtcaatctggagggaggttacaagtgccaatgcgaagagggatttcagctcgatccgcataccaaggcgtgcaaggccgtgggctcgattgcctacctgtttttcacgaaccgccacgaagtgcggaaaatgaccctggatagatccgagtacacctccttgatccccaaccttagaaacgtcgtcgccctggataccgaagtcgcatcaaatcggatctactggtccgacctgtcgcagaggatgatctgctcaactcaactggaccgcgcgcacggagtttcttcgtacgatactgtcatttcgagagacatccaagcgccagatggactggcagtggattggatccactctaacatctactggaccgactcggtcctgggaactgtgtccgtcgccgacaccaagggtgtcaagcggaaaaccctgttccgcgaaaatggatcgaagccgcgcgcgatcgttgttgacccggtccatggattcatgtactggactgactggggaactccagccaagatcaagaagggaggcctgaatggagtggacatatactcgctggtgaccgaaaacatccagtggcctaatggcattactcttgatctgctgtccgggcgcctctactgggtcgactcgaagctgcattccatctcgtcgatcgatgtcaatggaggtaaccggaaaaccatcctcgaggacgagaagcgcctggcgcacccgttcagcctggcggtattcgaggacaaggtgttctggaccgatatcattaatgaggcaatcttctcggcaaacagacttaccggatccgacgtcaacctgctggcagaaaatcttctttcgccggaagatatggtgctgttccacaacctcactcagccacgcggcgtcaactggtgcgagcgcactactctctccaacggaggatgccagtacctttgcctgccagctcctcaaatcaatccacactcgccgaaattcacctgcgcgtgcccagacggcatgctcctggcccgggatatgagaagctgcctgactgaggccgaagcagcggtggcaacccaggagactagcactgtgagactgaaggtgtcgtcgaccgctgtgaggacccaacatactacgactcgtcctgtgccagatacttcccggctgccgggtgccactccggggctgactactgtcgaaattgtgactatgtcccaccaagccctgggcgatgtggccggacgcgggaacgagaaaaaaccttcctcggtgagagcgctgagcatcgtccttcccatcgtcctgctcgtgtttctgtgtctgggcgtctttctgctgtggaagaactggaggctcaaaaacatcaattccatcaattttgataatccggtgtaccagaaaactaccgaagatgaagtgcacatctgccacaaccaagatgggtactcgtacccgagcagacaaatggtgtccctggaggatgatgtggct

SEQ ID NO: 339 - DNA, 2580 bp, Artificial Sequence
  Description of Artificial Sequence: Synthetic Transcript Sequence
atggggccatggggctggaaactgaggtggacagtcgcgcttctacttgcagcggctgggacagcagtgggtgataggtgcgagagaaacgagttccagtgtcaggatgggaaatgcatttcgtacaaatgggtgtgcgatggatcagcagagtgtcaagatggatctgatgagagtcaagagacatgtctctccgtcacttgcaaatcaggggactttagctgcggaggacgcgtcaaccggtgcattcctcagttctggcggtgtgacggccaggtggattgcgacaacgggtctgatgaacaaggatgtcccccaaaaacatgttcacaggacgagttcaggtgccacgatggaaagtgtatttctagacaatttgtgtgcgactcagatagggactgtttggacggaagcgatgaagccagctgccccgttctgacatgtggccctgctagctttcaatgcaacagcagcacctgtattccccaactttgggcctgcgataacgacccagactgtgaggatgggagcgatgaatggcctcaaagatgtaggggtttgtatgtattccagggcgactcgagtccgtgctccgctttcgagttccactgccttagcggcgagtgtatccacagctcatggcggtgcgacggtggacccgattgcaaagacaagagcgatgaagaaaactgtgccgttgctacctgccgccccgatgaatttcaatgctccgatggcaattgcatacatgggtccagacagtgtgatagagaatatgactgtaaagacatgtccgatgaggtgggctgcgtgaacgtgactttgtgcgaaggacccaacaagtttaagtgccatagcggtgaatgcatcacactggataaagtctgcaacatggcaagagattgcagggactggtcagatgagcctattaaagagtgtggaacaaacgaatgtctcgacaacaatggaggctgctctcatgtatgtaacgatttgaaaatcggatacgagtgcgattgtcccgacggctttcaacttgtggcccaacgcaggtgcgaggatatagatgaatgtcaggatccggatacctgcagccagctgtgcgtcaacctggaaggggggtataaatgtcagtgtgaagaaggttttcaactcgatcctcacactaaagcatgtaaggctgtcgggagtatcgcttatcttttttttacgaataggcatgaggtgcgtaaaatgacactggacagaagcgagtatactagccttatcccaaatctgcgcaatgtggtggctttggataccgaggtagccagcaaccgcatatactggtctgacctgtctcaaagaatgatatgctcaacccagctggatagagcacatggagtgtcctcctacgacactgtcatctcaagagatatccaggcacccgacggacttgctgtcgattggatacatagcaacatttactggacagattcagtacttggaacagtctctgtcgcggatacaaaaggagttaagcgcaagaccctgttcagggagaacggctcaaaacctcgcgcaattgtggtggatccggtacatgggtttatgtactggactgattggggaactccagctaagatcaagaaaggcggtctcaatggagttgatatctattctctcgtgaccgagaacattcagtggcctaatggcattaccctcgatttgctgagcggacggttgtattgggtggacagcaagcttcacagcatcagctctatcgacgtaaacggcggcaacagaaaaacaattctggaagatgaaaaaaggctggcccacccattttcgttagctgttttcgaggacaaagtcttttggactgatatcatcaacgaagccatctttagcgctaaccggcttacaggtagcgacgtgaatctgctagccgaaaacctgttgtcacctgaggatatggttctgttccataaccttacacaaccgcggggagtcaactggtgcgagcggactaccttatctaacggaggttgtcaatacttgtgcttgccggccccccagataaacccacacagccccaagttcacttgcgcttgccctgatggaatgctgcttgcaagagatatgaggagctgtctgactgaggctgaggctgcagtggctacccaagagacctccacagttcgactcaaagtcagcagcacggccgtgaggacccagcacacgacgaccaggcctgtgcccgacacatcgcggctccctggcgctacgccaggtctgacaaccgtcgagattgtcacaatgagccaccaggcactgggcgatgttgccggcaggggtaatgaaaaaaagccgtccagtgtgagagcactttctatagtgttacccatcgtattgcttgttttcctctgccttggcgtctttctgctctggaagaactggcggctcaaaaacatcaattcaatcaactttgataaccctgtttatcaaaagacaaccgaagacgaggtgcacatctgtcacaaccaggatggatatagctatccatcccgtcaaatggttagcctggaggatgacgtggca

SEQ ID NO: 340 - DNA, 2580 bp, Artificial Sequence; identical to SEQ ID NO: 316
  Description of Artificial Sequence: Synthetic Transcript Sequence

SEQ ID NO: 341 - DNA, 2580 bp, Artificial Sequence
  Description of Artificial Sequence: Synthetic Transcript Sequence
atgggtccatggggctggaaactgcgctggactgtagcactgctgctggcagccgcgggcacggcggtgggtgatcgatgtgagcgcaacgagttccagtgccaggatggtaaatgcatttcctacaaatgggtgtgtgatggctccgctgagtgccaggacggcagcgatgaaagccaggaaacctgtcttagcgtcacctgtaaaagcggtgacttttcctgtggcggacgggtcaatcgttgtatcccgcaattttggcgctgtgatggccaagtggactgtgataatgggtctgatgaacagggttgtcctccaaagacctgctctcaagacgaatttcgctgccatgatgggaagtgcatcagccgccagtttgtctgcgacagcgatcgcgactgtctggatggttcagacgaagcttcctgcccagtactgacctgtgggcccgcaagttttcaatgcaattccagcacctgtatcccccagttgtgggcgtgcgacaacgacccagactgtgaggacggtagcgatgaatggcctcagcgctgtagaggtctgtacgtgtttcagggcgattcgtcaccatgctccgcgttcgagtttcattgcctgagcggcgaatgtattcatagcagttggcggtgcgacgggggcccggattgtaaagacaagtctgatgaggaaaactgcgcagtggccacatgtcgcccagacgagttccagtgttccgacgggaactgcatccacggcagccgccaatgcgatcgcgaatacgattgcaaggacatgtcggacgaggtcgggtgcgtaaatgtcactctgtgcgagggccctaacaagttcaagtgccactctggcgagtgtattacgttagataaggtctgcaatatggctagggattgtcgtgactggagcgatgaaccgattaaagagtgcggtaccaatgagtgtttagacaacaatggtggttgctcccacgtgtgtaacgatctgaaaatcggttatgaatgcgattgtccagacggtttccagctggttgcccaacgtcgctgcgaagatatcgatgaatgccaggatccagacacctgctcccagctctgcgtgaacttggagggcgggtacaagtgccagtgcgaggaaggcttccagttagatccacacactaaagcttgcaaggccgtcggttctatcgcatacctgttcttcactaatagacacgaagtgcggaaaatgaccctggatcggagcgagtatacgagcctgataccgaatctgcgcaatgtcgtcgccctggacactgaagtcgcgagcaaccgcatctactggagcgatctgtcacagcgcatgatttgttcaacccaacttgatcgcgcccacggggtgtcaagctatgataccgttatctctcgggacattcaggctccggacggtctggcggtcgactggatccacagcaacatttactggacggatagcgtcttgggtacggtgagcgtggccgacacgaagggcgttaagcgtaaaaccttgttccgcgagaacggcagcaagcctcgcgcaatcgttgtcgaccctgtccacggtttcatgtactggactgattgggggacccctgcaaagattaaaaaaggaggcttgaacggcgtggacatctactctctggtcacggagaatatccagtggcctaacggaattactctggacctgctgagcgggcgcctatactgggttgattcaaagctgcacagcattagcagcattgacgttaacgggggcaaccggaaaacgattctggaagacgagaagaggttggcccaccctttttcacttgctgtgttcgaggataaagtgttttggaccgatatcatcaatgaagcaattttcagcgcgaaccgcctgaccgggagcgacgtcaatctgctagccgagaatctgctgagccctgaagatatggtgctgttccacaatctgacccaaccacgcggtgttaactggtgcgaacgcaccactcttagcaacggcggatgccagtacctgtgcctgcctgctccacaaattaacccacactctccgaaatttacctgcgcttgcccggacggtatgctcttggcccgcgacatgcgctcctgcctgactgaggcggaggccgcggtggctacgcaggagacttctactgtccgcctgaaggtcagcagcactgccgtccggactcaacataccacgacccgcccggttcctgatacttcccgattaccgggtgccaccccgggcctgaccactgtggaaatcgtgacgatgtcacaccaagccctgggggatgtcgctggacgcggtaatgaaaagaagccttccagcgttcgcgctctgagcattgtgctcccgatcgtcctgctggtctttctgtgcctcggggtatttctgctgtggaagaactggcggctgaagaatattaacagcatcaactttgacaatcctgtctaccagaaaacaaccgaggatgaggtccatatctgtcacaaccaggatggttacagctatccttcccgccagatggtttcactggaggacgatgtcgct

SEQ ID NO: 342 - DNA, 2580 bp, Artificial Sequence
  Description of Artificial Sequence: Synthetic Transcript Sequence
atgggaccatggggctggaagctgcgctggaccgtcgcactcctcctggcagcggcaggtaccgcggtcggcgatcgatgtgaacgaaacgaatttcagtgccaagatggcaagtgtatatcatataagtgggtgtgtgatggttcggctgaatgtcaggacggaagcgatgaatcgcaagaaacgtgtctctcggtgacctgtaagtccggcgacttcagctgtggtggaagagtcaacaggtgcatcccccagttctggaggtgtgatgggcaagtggactgcgataatggcagcgacgaacaagggtgtcctccaaaaacctgctcccaggacgaatttaggtgtcatgatggcaaatgtatatcacgtcaatttgtgtgcgactcggaccgagattgcctcgatggatccgatgaagcctcctgtcctgtgctcacctgtggccctgcatcgtttcaatgcaattcatcaacttgtattccccaactgtgggcctgtgataatgacccagattgtgaagatgggtccgacgagtggcctcaacggtgtcgggggctgtacgtgtttcaaggggactcgtcaccctgtagcgcattcgaatttcattgcctttccggtgagtgtatccatagcagctggcggtgtgacggtggaccagactgtaaggataagagcgacgaagaaaactgtgcagtggccacttgtcgcccagacgaattccaatgcagcgatggaaattgcatccatggtagccgccagtgcgatcgcgaatacgattgtaaggatatgtccgacgaagttggatgtgttaatgtcaccctctgcgaagggccaaacaaattcaagtgtcatagcggcgagtgcattaccctggacaaggtgtgtaatatggcaagagactgtagagactggtcggatgagccaatcaaggaatgtggcactaatgagtgtctcgataacaacggaggttgttcgcacgtgtgtaacgatctcaaaattgggtacgagtgtgactgtcctgatggatttcagctggtggcgcaaagaagatgtgaagatatcgatgagtgccaggatcccgatacctgcagccaattgtgcgtgaacctggaaggaggatacaaatgccaatgtgaagagggattccaactggaccctcacaccaaggcctgtaaagcagtcgggtcgattgcatacctgttctttaccaatcgccatgaagtgaggaagatgaccctggatcgatctgaatacacttcgctgattccgaatttgcgtaatgtggtcgcattggataccgaggtggcaagcaaccgaatctactggtcagatttgagtcagagaatgatttgctcgacccagctggatcgagcccatggagtctcctcatacgacactgtgatctcgagggatatccaagcaccagacggtctggcagtggattggatacactcgaacatttactggaccgacagcgtccttgggaccgtgtcagtggctgacactaagggagtcaagcggaaaactctgttccgggaaaacggctcgaagccccgagcaattgtggttgatcccgtccatggattcatgtactggactgactggggcacccccgccaagattaagaagggaggtcttaacggcgtggacatttactcgcttgtcacggagaatattcagtggcctaatggtataaccctggacttgctttccggccgcctttattgggtggattcaaagttgcatagcatctcttcgatagatgtcaacggaggaaaccgcaaaactatcctcgaagatgagaagaggcttgcgcatccattttccctggcagtgttcgaggacaaagtcttttggacggatatcatcaatgaagcgatattctccgcaaaccgacttaccggaagcgacgtcaacctgctcgcagaaaatctgctgagccctgaagatatggtcctgtttcataatctcactcaaccccgcggcgtgaattggtgtgaaaggaccaccctgtccaacggtggctgtcagtacctttgtctgcccgctccacagattaaccctcattcgcctaagtttacctgtgcatgcccagacggcatgctcctggcaagagatatgcgttcctgtctcaccgaagccgaagcagcagtcgcaacccaagaaacttcgactgtgaggctgaaggtatcctcgactgcagtgagaacccagcatactaccactcgcccagtgcctgatacgtcgagactgccaggtgcaactcctgggctgaccactgtggaaatcgtcaccatgtcacatcaggcacttggggatgtggccggccgtggaaacgaaaagaagccttcatcggtccgggctttgtcgattgtgctccctatcgtgctgctggtttttctttgtctcggagtctttctcctctggaagaactggcggctgaaaaacataaacagcattaactttgataaccctgtctaccaaaagactactgaggatgaagtgcatatctgtcataaccaggacggttactcttacccatccaggcaaatggtcagcctggaggatgatgtggcg

SEQ ID NO: 343 - DNA, 2580 bp, Artificial Sequence
  Description of Artificial Sequence: Synthetic Transcript Sequence
atgggaccttgggggtggaaactacgctggaccgttgcactgctgcttgctgctgctggaacagctgtgggagatcggtgcgagaggaatgagttccagtgtcaggacggcaagtgtattagctacaaatgggtgtgtgatgggtctgcagagtgccaggacgggtcggatgagagtcaggagacctgcctatctgtaacgtgcaaaagcggggacttttcttgcggcggaagagtcaaccgttgtattccacagttctggagatgcgacggccaggtcgactgcgataacggctctgacgagcagggctgcccccccaagacttgctcacaggatgagttcagatgtcatgacggaaagtgcatctcacgccagtttgtatgtgatagtgatagggattgcctggacggatctgacgaggcctcgtgcccggttcttacctgcggacctgcctcattccagtgtaattcatcaacttgtatcccacagctgtgggcttgtgacaatgaccctgactgcgaggacggaagtgatgagtggccacagcggtgtcggggtctctacgtatttcagggggatagctctccctgctccgccttcgagtttcactgtctctctggagagtgtatccactctagctggaggtgtgatggcggtcctgactgtaaggacaaatcagacgaggaaaactgtgctgtggcaacctgccgccctgacgagtttcaatgtagtgacgggaactgcattcacggctcccgccagtgtgaccgggagtatgactgtaaagacatgagcgacgaggtcggttgtgttaatgtcactctctgtgaaggcccgaacaagtttaagtgtcatagtggcgaatgcatcacgctagacaaggtgtgtaatatggccagagactgcagagactggtcagatgagccaattaaggagtgcgggaccaatgagtgccttgataacaatggggggtgctcacacgtgtgtaacgatcttaaaatcggttatgagtgcgattgtccagatggttttcagctcgtggcacagcgacgttgcgaggacatcgacgaatgccaggaccccgatacatgttctcagctgtgcgtgaatcttgaaggcggttataaatgtcagtgtgaagagggctttcagctcgacccacataccaaagcctgcaaggccgttggctcaatagcctacctctttttcacaaacaggcatgaagtgaggaagatgacgctggacaggagtgagtacacgagtctgatacccaatctgcggaatgtggttgcactggatacagaggtggcgagcaaccgaatctactggagcgatttgtcacaacggatgatctgctccacccagctcgaccgagcacacggtgtgagctcttacgatacagtcatcagtcgggatatccaggctcctgatggactggcagtcgactggatacattcaaatatctactggaccgactccgtcttggggaccgtgtctgtcgcagacacaaagggcgtgaaacgcaaaaccctttttagggaaaacggctcaaagccccgagcaattgtcgttgatcccgtccatggtttcatgtactggactgattggggtacaccggcaaagataaaaaaggggggactcaacggagtcgatatttattctctggttaccgagaatatacaatggcccaatggcattacactggatctcttaagtggccggctgtactgggtggactctaaattgcacagcattagctctatagacgtgaatgggggcaaccgtaagaccattcttgaggatgagaaaagactggcccacccattttctctagccgtcttcgaggacaaagtcttttggacagatattattaatgaggccattttttctgccaacaggctgactggctccgacgtgaacctccttgctgaaaatctattgagtccggaggatatggtcctgtttcacaacctgacacagccacgtggcgtgaactggtgtgaaagaacgacccttagtaatggcggctgtcaatatctttgtcttccagctccacagatcaatccacactctcctaagttcacctgcgcatgtcctgatggcatgctgctcgcccgcgacatgaggagctgtttgacggaagccgaagcagctgttgcaacccaggagacatccacggtccggctgaaggtaagcagcactgccgtaagaacgcagcacacgaccacacggcccgtgcccgatacgagccggctccctggcgcaactccgggactgactactgttgagatcgttaccatgagtcaccaggctctgggagacgtggctggcagaggtaacgaaaaaaaacccagctctgtgcgcgccctcagtatcgtgttacccatcgtgctcctggttttcctgtgcttaggggtcttcctattatggaagaactggcggctgaagaacatcaacagtatcaacttcgacaatcccgtttatcagaagaccactgaagatgaggtacatatatgccacaatcaggatggatactcctacccttctcgtcagatggtaagtctagaggacgatgtggcc

SEQ ID NO: 344 - DNA, 2580 bp, Artificial Sequence
  Description of Artificial Sequence: Synthetic Transcript Sequence
atgggtccatgggggtggaagctgcgctggactgtagccttactcctagcagcagcagggaccgcggtgggagaccggtgcgagcgcaatgagttccaatgccaagatggtaagtgcatcagttacaaatgggtgtgtgatggttcagccgaatgccaggacggcagtgatgagtctcaagaaacatgcctgtccgtgacatgtaagtcgggggacttcagttgcggcggccgcgtaaaccggtgcattccccaattctggagatgcgacgggcaggtggactgcgacaacggcagcgacgaacagggctgcccacccaagacctgttctcaggatgaattcaggtgtcatgacggcaaatgtattagtcgacaattcgtctgtgactcagatagggattgcctggatggatcagatgaagcatcctgccctgtgctcacatgcggaccagcatctttccaatgtaattcctccacctgcatcccccagctgtgggcgtgcgacaatgaccccgattgcgaggatggcagcgatgagtggccccaacgatgcagaggactgtacgtttttcagggggactccagcccatgcagtgccttcgaattccactgtctgagcggtgaatgcatacattctagctggcggtgcgatgggggtcctgattgcaaggacaaatctgatgaggaaaactgcgcagtagctacctgtcggcctgatgagtttcagtgcagtgatggaaactgcatacatggttctaggcagtgtgatcgcgagtacgattgcaaagatatgtctgatgaggtgggctgcgtgaatgtgacactgtgcgagggtccaaacaagtttaagtgtcatagtggagagtgtataactctcgataaagtgtgcaatatggccagggattgccgcgattggtctgatgagcctatcaaagagtgtggaactaacgagtgtttggacaacaacggtggttgcagtcacgtctgtaacgatttaaaaatcgggtacgaatgtgattgtccagatggcttccagctagttgcccaacgccggtgcgaggacatcgatgagtgtcaagatcctgacacctgttcccagctttgtgttaacttggaaggaggatacaagtgtcagtgtgaagaaggattccaattggacccccacactaaggcctgtaaagccgtcggcagcatcgcatatttgttctttaccaacaggcatgaagtgagaaaaatgactttggatcgctctgagtatacctccttgatacctaacttacggaatgtggtggccttggatacagaagtcgcttctaaccgcatttactggagcgacctcagccagcggatgatttgcagcactcaactggaccgggcgcatggtgtctcctcatatgatacagtgatttcccgcgacattcaggcccccgacggcctggctgttgattggattcactccaacatctattggacagacagcgtgttgggcactgtgtccgttgccgacaccaagggagtcaaaagaaagaccctgttcagggagaatggatctaaaccccgcgccattgttgtagaccccgtccacggtttcatgtactggacagattggggtaccccagccaaaattaagaaaggggggttaaacggtgtggacatttacagcctggtgaccgagaatattcagtggcctaacggcattactcttgatctcctgtctggccgcctctattgggttgattctaaactgcatagtatctcctcaatcgatgtcaatgggggaaaccgcaaaactatccttgaggacgagaaaaggctagctcaccctttctcactggctgtattcgaagataaagtgttttggactgatatcataaatgaagcgattttttccgccaacaggctgacaggaagcgatgttaatcttcttgcggagaatttgctaagccccgaagatatggtgttgtttcataacttaacccagccccgaggtgtcaactggtgcgagaggaccactctttccaatggtggatgtcagtacttgtgtctgccggcgccccagataaatccgcactcacctaagtttacatgtgcgtgccccgacggaatgctgcttgctagagatatgcgatcctgcttaacagaagccgaggccgctgtggccacccaggagaccagtactgtgaggcttaaggtgtcttccaccgccgtacgcacacaacacacaacgactaggccagtgcccgacacgagtagactccctggcgccacaccgggattgaccactgtggagatcgtgaccatgtcacatcaagcacttggagatgtcgcggggcgaggaaacgaaaagaaaccttcatcagtgagagcactgagcattgtcctgcccatcgtactactggtgtttttatgcctgggggtgttcttgctgtggaaaaattggcgcctgaagaatatcaacagcatcaactttgataaccccgtatatcagaaaactaccgaggatgaggtgcacatatgtcataaccaggatggctattcctacccctcccgccagatggtctccttggaggacgatgtcgca

SEQ ID NO: 345 - DNA, 2580 bp, Artificial Sequence
  Description of Artificial Sequence: Synthetic Transcript Sequence
atggggccatgggggtggaaactgcggtggacagttgcgcttctactagctgcggcagggaccgccgttggggatagatgtgagcggaatgagttccagtgccaggatggtaaatgtattagttataagtgggtctgcgatggttcagccgaatgccaggatggtagtgatgaatcccaggagacatgtctcagcgttacatgtaaatccggagatttcagctgcggagggcgggtgaatcgctgtatccctcaattctggaggtgtgatggacaggtcgattgcgacaacggatctgacgaacagggatgcccaccaaagacctgtagtcaagacgaattccggtgccacgacggcaagtgtatctcccggcagttcgtctgtgacagcgatcgggactgcttggacgggtcggatgaagcctcatgccccgtgctgacatgcggcccagcttcctttcagtgtaattcctccacatgtatcccacaattatgggcgtgcgacaacgaccctgattgcgaggacgggtcggatgaatggccccagagatgccggggcctgtacgtgttccagggtgacagcagtccctgctcagccttcgaattccactgtcttagcggcgaatgtattcactcttcctggagatgtgacgggggcccagactgtaaggataagtccgatgaggaaaactgcgccgtggccacctgtcgtcccgacgagttccaatgctccgatggaaactgcatacacggctctagacagtgtgatcgcgaatatgattgcaaggacatgagcgacgaagtgggctgtgtcaatgtgacactctgcgagggccctaacaagtttaaatgccacagcggtgagtgtatcaccctggataaggtctgcaacatggctagagattgccgagactggtctgacgagcctatcaaagaatgcggaaccaacgaatgcctggacaataatgggggatgctcccatgtgtgtaacgacctgaagatagggtacgagtgtgattgccctgatggattccagctggttgcacaaagaagatgtgaggatatcgatgagtgccaggatccagacacctgttcccagctatgcgtgaacctcgagggaggttataagtgccagtgcgaagaaggcttccagctcgacccccatacgaaggcatgcaaagcggtgggcagtatagcttatttgttttttactaataggcacgaggttcgaaaaatgacactggatcgatctgagtatacctcgcttattcctaacctacgcaatgtcgtggctctggacaccgaggtagcttctaaccggatctattggtccgacctatcccagcggatgatctgctccactcagctggatcgcgcacacggtgtctcctcatacgacaccgtgatttctcgggacatacaggccccggacggcttggctgtcgactggatacactcaaacatctactggactgattcagtccttggtacggtgtcagtggcagatacaaagggggtgaagcggaagacactgtttcgggagaatggctccaaacctagagcgatcgtggtggatcccgtccacggcttcatgtactggacggactggggcacaccagcaaaaattaaaaagggtggcctcaacggcgtggacatttactctttggttacggagaacattcagtggcctaatggtatcaccctggacctccttagtggacgcctctactgggtggacagcaagcttcactctattagctccatcgacgtgaatggcggcaacaggaaaactattctggaagatgagaagcgtttggcgcacccctttagcctggctgtgtttgaggataaggtattctggacggatattattaacgaggccatctttagtgcaaaccgcttgacagggagtgacgtgaatcttctggctgaaaacctgctgtcccccgaggatatggtcctgttccacaacttgacacagccaaggggcgtcaattggtgtgaaagaacaacactgagcaatggtggctgtcagtatctgtgcctcccagcgccacaaattaacccacactcacccaaattcacctgcgcctgccccgatggtatgctcctcgcgcgggatatgaggtcatgtctcacagaggcggaagccgcagtggccacacaagaaacctcaactgtgagactgaaggtatcctctacagcagtccgaacacagcacaccacgaccaggccagtgcctgacacttcacggctgcctggagctacccctggcttaactacagtcgaaattgtaaccatgtcacaccaggcgcttggcgacgtcgcggggagaggcaatgagaagaagccctcaagcgtaagagccctcagcatcgtcttgccgatcgtcctgctggtcttcctgtgcctgggagtgtttctcttgtggaagaactggagactaaagaatataaattcaatcaatttcgacaaccctgtgtaccagaagaccacggaggatgaagtgcatatttgccacaaccaggacggatatagttacccaagcagacagatggtgtccctggaagatgacgtcgcc

SEQ ID NO: 346 - DNA, 2580 bp, Artificial Sequence
  Description of Artificial Sequence: Synthetic Transcript Sequence
atgggaccctggggttggaaacttaggtggaccgtcgcactgcttcttgccgcagccggaactgctgtgggtgatcgctgtgaaaggaacgaatttcagtgtcaagatggcaagtgtatctcctacaagtgggtgtgtgatggatccgcagagtgtcaggatggatcagatgaatcccaagaaacttgcctctccgtgacttgtaagtcgggggactttagctgcggtggtcgagtcaatcgatgcatccctcaattctggagatgtgatggacaggtggattgcgataacggatcggacgaacagggatgcccaccaaagacctgtagccaagatgaattcagatgtcatgacgggaagtgtattagccgacaatttgtgtgtgacagcgaccgggattgccttgacggctcagacgaggcctcttgcccagtgctgacttgcggaccggcctcgttccagtgcaactcgtccacctgtattcctcagctttgggcgtgcgacaacgatcctgattgcgaggacggatccgatgagtggccccaacgttgtagagggctctacgtgtttcagggagactcatccccatgctctgcctttgaattccattgtctttccggcgaatgcatccattcctcgtggcgctgcgatgggggacctgattgcaaggataagtcggacgaagaaaactgcgcagtcgcaacgtgccgcccagatgaattccagtgttcagacggtaattgtattcacggctcaaggcaatgcgaccgcgaatacgactgtaaggatatgtccgacgaagtcggttgtgtgaacgttaccctgtgcgagggtcccaacaagtttaagtgccattcgggagagtgtataacccttgataaggtgtgcaacatggcacgggactgtcgggattggtccgatgaacctatcaaagaatgtgggaccaacgagtgtctggacaacaacgggggctgctcgcacgtgtgtaacgatttgaaaattgggtacgaatgcgattgtcctgatggttttcaactcgtcgcacagaggcgctgtgaggacatcgatgagtgtcaggaccccgacacttgctcccaactttgtgtgaatctggaaggtggatacaagtgtcaatgtgaagagggctttcagctggacccacatactaaagcatgcaaagcagtgggttcgattgcatacctgttctttaccaatagacatgaagtccgaaagatgaccttggaccggtcggagtacaccagcctgattccgaatctgagaaatgtggtcgcactggataccgaagtcgcatcaaaccgcatatactggagcgatttgtcgcagaggatgatttgtagcactcagctggacagagcacatggcgtttcgtcatacgataccgtcatttcgagggacatacaggcgcccgatggtcttgccgtggattggattcactcgaatatctactggaccgatagcgtgctgggcacggtgagcgtcgcagacaccaagggtgtcaagcggaaaaccctctttcgcgaaaatggttcaaaaccaagagccatcgtggtggatccagtgcatggatttatgtactggactgattggggaactccagcaaagataaagaaaggtgggctgaatggagttgatatctattcgttggtgaccgagaatatacaatggcctaatggaatcaccctggacctgttgtcaggacggctgtattgggtggattccaagctgcattcgatttcgtccatagatgtgaatggcggtaacaggaaaaccattcttgaagatgaaaagagacttgcgcatcccttttccctcgcagtgttcgaagataaggtgttctggaccgacattatcaatgaggcaatcttttccgcaaaccggctgaccggttcggacgtgaatctgcttgcggaaaacctgttgtcgcccgaggacatggtcctgtttcataacctgacccagccacggggagtgaactggtgcgaacgcactactctttcgaacggaggatgccaatacctctgtctccctgcacctcagattaaccctcatagccctaaattcacttgtgcatgcccagacggtatgctgcttgcaagagatatgagatcgtgcctgacggaggcagaagcagcggttgcaacccaagagacttctactgtgcgactgaaagtcagcagcaccgccgtgcgcacccaacacacgaccacccgccctgtgccggatacctcccgtttgccgggcgcgaccccagggcttaccaccgtggaaattgttaccatgtcacaccaggcgcttggcgatgtcgcgggccggggaaatgagaagaagccttcctcggtgcgcgcgctgtcgattgtccttcccattgtgttgctcgtgtttctttgcctcggagtctttctcctttggaagaactggcggctgaaaaacattaactccatcaactttgacaacccagtctaccaaaaaaccacggaggacgaagtccacatatgtcacaaccaagatggttactcgtacccttcccggcaaatggtttcacttgaagatgatgtggcc

SEQ ID NO: 347 - DNA, 2580 bp, Artificial Sequence
  Description of Artificial Sequence: Synthetic Transcript Sequence
atgggtccgtggggctggaagctgcgttggactgtggctcttctcctggctgccgccggaacggcggttggcgaccgctgcgaaagaaacgaattccagtgccaagacggcaagtgtataagctacaagtgggtgtgcgacggatcggccgaatgtcaggatggatcagacgagtcccaggagacttgcctgagcgtgacctgcaagtccggagacttctcatgcgggggacgggtcaatcggtgcatcccacagttttggagatgcgacggtcaggtggactgcgataatggaagcgacgaacagggctgtcctccaaagacttgttcgcaggacgagtttcggtgtcatgatggaaagtgtattagccggcaattcgtgtgcgattcagacagagattgcctcgacggatccgatgaagcctcctgccccgtgctgacctgcggacctgcgtcgttccagtgcaattcgtcgacctgcatccctcaattgtgggcctgtgacaatgatccggactgcgaagatggctcggatgaatggccacaacggtgccggggcctttacgtgttccaaggggactcatccccgtgctcggcgttcgaattccactgcttgtccggcgaatgcatccactcatcgtggagatgcgatggaggaccggactgtaaggataagtccgacgaggaaaactgcgccgtggcgacttgtagaccggatgagttccagtgttccgatggcaattgcatccacggatcgaggcagtgcgaccgggaatacgattgcaaagacatgtcagatgaagtgggatgtgtgaatgtcactctttgcgaaggccctaacaaattcaaatgccactctggggaatgcatcaccctcgacaaggtgtgcaatatggcgcgggattgcagagattggagcgacgagcctatcaaggaatgtggcactaacgagtgtctcgacaataatggagggtgcagccacgtgtgcaacgacttgaagatcggatacgagtgtgattgcccggacggatttcaactggtcgcccagcgccggtgtgaggatattgatgagtgccaagacccagatacctgctcgcaactgtgcgtgaatctggagggtggatacaagtgccaatgcgaggagggcttccagcttgatccgcacactaaggcgtgcaaagccgtgggatccatagcgtacctgtttttcaccaaccgccacgaagtccgcaagatgaccttggacagatccgaatacacttcactcatcccaaacctgcgaaacgtggtcgccctggacactgaagtggcatcgaacagaatctactggagcgacctgagccaacgcatgatctgctcaactcagcttgatcgcgctcacggcgtgtcaagctacgacaccgtgatctccagagacatccaagcgccggatggactggctgtggactggatccacagtaacatctactggacggattcagtgctgggaactgtctcggtggcagacaccaagggagtgaagcgcaagactctgttccgcgaaaatggctccaagccaagagccattgtggtcgacccagtccatggattcatgtactggaccgactggggaaccccagccaagatcaagaaggggggcctgaatggcgtcgacatttactcactcgtcaccgaaaacatccaatggcctaacggaataaccttggatttgctgagcgggcgcctgtattgggtcgactcgaaactgcattcgatctcgagcatcgatgtgaacggaggaaaccgcaaaaccatcctggaagatgaaaagcgactggcgcatccgttttcgctggccgtgttcgaggacaaagtgttctggaccgacatcatcaacgaggccatcttctccgcgaaccgcctcaccggctcggacgtgaacctcctggcggaaaacttgctctcacccgaagatatggtgctctttcacaacctgactcagccacggggagtgaattggtgcgagcgcaccactttgtcgaacggaggctgtcaatacctttgtttgccagccccgcaaatcaatccgcacagccccaagttcacttgcgcatgcccagacggtatgctcctggcacgcgatatgcgctcctgcttgactgaagccgaagcagccgtggctacccaggaaaccagcaccgtgcgcctcaaggtgtcaagcactgcagttagaactcaacacactaccacgcgccccgtcccggacactagccgtctcccaggcgcgactccgggcctgacgaccgtggaaatcgtgaccatgtcgcatcaggctctcggtgacgtggccgggaggggaaatgaaaagaagccctcgtcggtgcgcgccctgtccatcgtgctcccgattgtcctgctcgtgtttctgtgcttgggcgtgttcctgctgtggaaaaactggcggctgaagaacatcaactcgatcaactttgacaatccggtgtaccagaaaactactgaggacgaggtgcatatctgccacaaccaagacggttactcgtacccgtcgcggcaaatggtgtcgttggaggacgacgtggct

SEQ ID NO: 348 - DNA, 2580 bp, Artificial Sequence
  Description of Artificial Sequence: Synthetic Transcript Sequence
atggggccctggggatggaaactgagatggactgtggccctgctgctcgcggctgctggcactgccgtgggcgacagatgcgagaggaatgagtttcaatgccaggacggcaagtgtattagctacaagtgggtctgtgatggcagtgccgagtgccaggatggctccgatgaatcccaggaaacgtgtttgtctgttacgtgtaaatcaggggacttcagctgtggaggacgagtgaatcgctgcatcccccagttttggcggtgtgacggccaggtcgactgtgacaatggaagcgatgagcaagggtgtccacccaagacctgcagccaggatgagtttagatgtcacgacgggaagtgtatttcaaggcagttcgtgtgtgactccgacagggattgcttggacggtagcgatgaagcatcctgcccagtactgacatgtggacctgcatcatttcaatgtaactctagtacctgcattcctcaactgtgggcctgtgacaacgacccggattgtgaggacggtagcgatgaatggccacagcgatgtcggggactgtatgtgttccagggtgactcctcaccctgttccgcttttgaatttcactgcctgagtggggagtgcatccacagttcctggcgctgtgacggcgggccagactgtaaggataagtctgatgaagaaaactgtgccgtggcaacctgcaggccagatgagttccagtgttctgacggtaactgcatccatggcagtaggcaatgcgaccgggaatacgattgcaaggacatgtccgacgaagtgggttgcgtcaacgtgacattgtgtgaggggccaaacaagtttaaatgccactccggcgagtgcataacccttgacaaggtatgtaatatggccagagactgcagggattggagcgatgaacccatcaaagaatgtgggacaaacgagtgtctggataataatggtggttgcagccacgtgtgtaatgacctcaaaatcggctacgagtgcgactgccccgacggattccagctggtggcccaaaggcgctgtgaggacatcgacgagtgtcaggacccagatacctgctcccagctgtgcgtgaaccttgagggaggctataaatgtcagtgcgaagaaggcttccagctggatccccacacaaaagcctgcaaggccgttgggtctatagcgtacttgttctttaccaatcggcacgaagtgaggaagatgacccttgaccgctctgagtatacctcactgattcccaacctccggaatgtcgtggctctggacacagaagtggctagcaatagaatctactggtcagacctgagccagcggatgatctgctcaacccagcttgacagggcccacggcgtttcaagctacgatacggtgatcagtagagacattcaggcacccgacggtctggccgtagactggatccattctaatatctattggactgatagtgtcttgggcacggtatccgtggccgacaccaagggtgttaaaaggaaaaccttgttccgagagaatgggtctaagccccgagcaatcgtggtcgacccggtgcacggttttatgtactggactgactggggaacgcccgccaagattaagaaaggtggcctgaatggtgtggacatttacagcctggtaactgaaaatatccagtggccgaacggcatcacccttgacctgcttagcgggagactctactgggtggactcaaagctgcacagcataagtagcatagatgtgaatggaggtaatcgaaaaaccatactcgaagacgagaaaagactggcccatcccttttccctggcagtgtttgaagataaagtattctggacagatattattaacgaggccatttttagtgccaataggctgaccggttccgacgtaaatctgctggcagagaatcttttgtctccagaggacatggtgttgtttcataatttgactcagccgcggggcgtaaactggtgcgaacggactaccttgagtaatggaggatgtcagtatctgtgcctgccggccccacagatcaaccctcatagccccaagttcacctgtgcctgtcccgatgggatgctgcttgcccgggatatgcgcagctgcttgactgaagcggaagccgctgtagctactcaggaaacctcaaccgtgaggcttaaggttagttccactgctgtgcgcacacaacacacaactacgcgccccgtgccagatacttctcgcttgccaggtgctacccctggactcaccacagtggagattgtgaccatgtcccaccaggccctcggagacgtcgctggtcgcggcaacgagaagaaaccatcctccgttcgggctctctcaattgttctgccaattgtgctgcttgttttcctgtgcctgggcgtattcctgctgtggaaaaattggcgcctgaaaaatatcaactccatcaatttcgataaccccgtataccagaaaacaacagaggatgaagttcacatatgtcataaccaagacggctacagctatccatccaggcagatggttagtttggaggacgatgtggcc

SEQ ID NO: 349 - DNA, 2580 bp, Artificial Sequence
  Description of Artificial Sequence: Synthetic Transcript Sequence
atgggaccctggggctggaagcttcggtggacagttgccctcttgctggcggcggccgggaccgcagtgggagaccggtgcgagcgcaacgaatttcagtgccaggacggtaagtgtatctcatacaagtgggtctgcgacgggtccgcagagtgtcaagacggctcagatgaaagtcaggagacttgtctttctgttacctgtaagtctggcgacttttcttgcggagggagggtgaacaggtgcatccctcagttctggaggtgcgatggtcaggtcgattgtgataacgggtcggacgagcaggggtgcccaccaaagacgtgttctcaggatgagtttcgctgccacgatggtaagtgcatttcacggcaattcgtttgcgatagtgatagagactgcctcgatggaagtgatgaggcttcttgtcctgtgctgacatgtggccctgcctcttttcagtgcaatagcagcacctgcatccctcagctgtgggcgtgcgataacgacccagattgtgaagatggaagcgatgaatggccccagaggtgtcggggtctctatgtattccagggggattcctccccttgttcagcttttgagtttcactgcctttccggggagtgcatccacagttcctggaggtgcgatggtgggccagactgcaaggacaaaagtgacgaggagaactgtgccgtggcaacatgtcggccagatgagttccagtgctccgacgggaactgtatccacggctctcgccagtgcgatagagaatatgactgtaaggatatgtccgatgaagtgggctgcgtcaatgtgaccctgtgtgaggggccgaataaatttaagtgtcatagtggcgaatgtattacgctggacaaggtctgtaatatggccagagattgccgtgactggtcggacgagccaataaaggagtgtgggacaaacgaatgccttgataacaacggtggatgctcgcacgtctgtaacgatctgaaaattgggtatgagtgcgactgccctgacgggtttcagttggtggctcagcggcgctgcgaggacattgatgaatgccaggacccagacacatgttctcagctgtgtgtgaatctggaaggaggatacaagtgccagtgtgaagagggcttccaactcgatccccacactaaggcttgtaaggccgttggcagtatagcgtacctctttttcacaaatcggcatgaagtgcgtaaaatgacgctggacagatcggagtatacatcgttgattccaaacctccgtaatgttgtggcactggatactgaggttgcatccaaccgcatatactggtctgatttgagccagaggatgatttgttcgacccaattggatcgcgcacacggagtgtcatcgtacgataccgtcatctcaagggatatccaagcacccgatggccttgctgtcgattggatccactccaacatctactggacagattctgtgcttggtacagtgagcgtggccgacaccaaaggagtcaagagaaaaaccctgttccgcgagaacggatcaaagcccagggcaattgtcgtcgatccagtgcatggtttcatgtactggaccgattgggggacccccgcgaaaatcaaaaagggaggactgaacggcgttgacatctacagcctagtgacggaaaacatacagtggccaaatgggatcaccctcgatcttctaagtgggcgtctgtactgggtcgatagtaagctgcattccatctcatctatcgacgttaatggaggcaacaggaagacgattctggaagatgagaaaaggctggcccatccattttctctggccgtgttcgaagataaggtattttggacggacattattaacgaagcgatcttttcggcgaatcggcttacagggtccgatgttaaccttttggccgaaaatctgctgtctcccgaggacatggtgcttttccataacctgactcagccccgaggagtgaactggtgtgaaaggactacattgtccaatggaggctgccaatacctctgtctgccagccccacagataaatccgcacagccctaagttcacttgtgcctgccccgacggtatgctgcttgctagggacatgagaagttgtttaaccgaagctgaggctgcagtggccacacaagagacctcaaccgtgagactcaaagtctcttccaccgcagtgaggacacagcatactaccactcgtccggtgcccgacaccagccgcctccctggcgcgactcccggtctgacaactgtggagattgttaccatgtctcaccaggccctgggggatgtagcgggtcgagggaacgagaagaaaccatcttcagtccgagcactatcaatcgtcctgccaatcgtcctgttggtatttctgtgcctgggagtgtttttattgtggaaaaactggagacttaagaatattaatagcatcaacttcgacaatccggtttaccagaaaacaaccgaggatgaggtccacatttgccacaaccaggatggctactcctacccatcgcggcaaatggtgtcgctggaggacgatgtagcg

SEQ ID NO: 350 - DNA, 2580 bp, Artificial Sequence
  Description of Artificial Sequence: Synthetic Transcript Sequence
atgggaccatggggatggaagctgcggtggactgtggcacttctccttgctgccgcaggcaccgcggtcggtgatcgctgcgagaggaacgagttccaatgccaggatggcaagtgtattagctataagtgggtgtgtgacggttccgcagaatgccaggacggcagcgatgaaagccaagaaacctgtctgagcgtcacttgtaagtcaggtgattttagctgtggaggacgcgtaaatcgctgcatcccacaattttggcggtgcgatggccaagtggactgtgataacggatcggacgaacaaggatgcccacctaagacctgttcccaggacgagtttcgatgccatgatggtaagtgtatttcgagacagtttgtgtgcgatagcgatcgcgattgtcttgatggttccgatgaagcgtcgtgcccagtgcttacgtgtggacctgcctcgtttcagtgtaatagctcaacctgtatccctcaactttgggcctgtgacaatgatcctgattgtgaggacggttcagacgaatggccccagaggtgcagaggactttacgtgttccaaggtgattcctccccctgttcagcattcgaattccactgtctgagcggggagtgcatccacagctcctggcgttgtgatggaggccctgattgcaaggataagtccgatgaggagaactgcgcggtcgcaacctgtagacctgatgaattccagtgttcggatggcaattgtattcatgggtctaggcaatgcgacagagagtacgattgtaaggatatgtcagatgaggtgggttgtgtgaatgttactctgtgcgaagggccaaataagttcaagtgtcattctggtgagtgtatcacgctggacaaggtgtgcaacatggctcgggattgccgcgactggagcgacgaaccaatcaaagagtgcggtaccaatgaatgcctggataacaacggtggatgttcccatgtgtgcaacgatcttaagattggatacgaatgtgactgtcctgacggatttcaattggtcgcacagcggcggtgtgaagatatcgatgagtgtcaggatccggacacttgttcacaactttgtgtgaacctggaagggggatacaaatgccaatgtgaagaaggatttcaactggaccctcacactaaggcctgcaaggcggtgggaagcatcgcttatctgtttttcaccaacagacatgaggtgagaaaaatgactcttgataggtccgagtacacttccctcatccccaacctgagaaatgtggtagcactggacaccgaagtggcttcaaacagaatttactggtccgacctctcccagaggatgatctgctctactcaacttgatcgggcacacggagtctcttcgtacgatactgtgatctcccgggacattcaggcaccggacggtcttgccgttgattggatacattccaacatctattggactgattccgtgctggggactgtgagtgtggctgataccaaaggagtgaagcgcaagactctgtttagggaaaatggctcgaaaccacgcgcaatcgtggtggatccagtgcacggttttatgtactggactgattgggggactcctgcgaagataaagaaaggtggcctgaacggtgtggacatatactcacttgtgaccgagaacatccagtggccgaacggaataactcttgaccttctcagcggacgactttactgggtggactcgaaacttcattcgatatcgtcgattgacgtgaatggaggaaatcgaaagaccattctggaagatgaaaaaagactcgcacacccgttttcgctcgctgtctttgaggacaaggtcttttggaccgatatcataaacgaagcgatattctctgcaaatagacttaccggatcggacgtcaacctccttgcagagaaccttctctccccagaggacatggtgctgtttcacaacctcacccagcccaggggggtgaactggtgtgagcggaccactttgtccaatggtggatgtcagtacctttgtctgcctgcaccacagatcaaccctcactcgccgaaattcacgtgcgcatgccccgatggtatgctccttgcacgtgacatgcgcagctgtcttaccgaggcggaggcagcagtggcgactcaagaaaccagcaccgtgaggttgaaggtgtccagcaccgcggtgaggactcagcataccacgactagaccagtcccagatacctcgagactcccgggcgcaacccctggacttactactgtggagattgtcactatgtcccaccaggccctgggcgacgtggcaggtcgcggtaacgagaaaaaaccatcgtcggtgcgagcactgtcaatcgtgcttccaattgtgctgctggtctttttgtgcctgggggtgtttcttctgtggaagaattggcggctgaagaacattaactcaattaactttgataacccggtctaccaaaagaccaccgaggatgaagtccacatttgtcataaccaagatggatactcgtacccctcacggcagatggtgtcactcgaggacgatgtcgca

SEQ ID NO: 351 - DNA, 2580 bp, Artificial Sequence
  Description of Artificial Sequence: Synthetic Transcript Sequence
atgggaccttgggggtggaagctgagatggactgttgctttgcttctcgcagcagccggcacagctgtcggcgacagatgtgaacgaaacgagttccaatgccaggatggaaagtgcatatcttacaagtgggtttgcgatggatctgcagagtgccaagacggctctgatgagtcccaggagacatgcctaagtgttacctgtaagagcggagacttcagttgcgggggcagagtgaacagatgtatccctcagttctggagatgcgatggacaggtggattgcgataatggcagcgatgaacagggttgtcccccaaagacctgttctcaggatgaatttcgatgccacgatgggaaatgtatcagcagacagttcgtgtgcgattccgacagagattgcctggatggcagcgatgaagcttcttgcccagtcttgacctgcggcccggcctcattccagtgtaactcatccacctgcatcccacagttatgggcttgcgataacgaccctgattgtgaagacgggagcgatgagtggccccagaggtgtagaggcttgtacgtcttccaaggtgactcatccccatgttctgctttcgaattccattgcctcagtggcgagtgcatacatagcagctggagatgcgatggaggacctgactgcaaggataagagtgatgaggagaattgcgcggtagcgacatgccgtcctgacgagttccagtgttcagatggaaactgtattcacggctctcgccaatgtgatagagagtatgattgcaaggacatgagcgatgaagttggctgcgttaacgtgacattatgtgaaggaccaaacaaatttaagtgtcacagcggagaatgcattacactggataaggtctgcaacatggcacgcgactgccgcgactggagtgacgagcctatcaaagaatgcggcactaatgagtgtctcgataacaacggggggtgtagccatgtgtgcaacgatctaaagataggctacgaatgcgactgcccagatggattccagctggttgcacagaggaggtgcgaagatatcgatgaatgccaggatcctgatacctgcagtcagctctgtgttaacttggagggtgggtataaatgtcaatgcgaagagggatttcagctcgacccccatacaaaggcctgcaaggctgtgggctctatcgcctacctgttcttcacaaataggcatgaggtgagaaagatgaccctcgacaggtccgagtacactagcttgataccaaacctgagaaacgttgtggcgcttgacacagaggtcgctagtaatcggatatactggagcgatctgtcacagaggatgatctgtagtacacagctcgatcgggcacacggagtcagtagctacgacacagtgataagccgcgatatccaagcacctgatggccttgcagtggattggatacatagcaacatctattggacagacagtgtgttggggaccgtcagcgtggccgatactaagggagtgaagaggaagacactgttccgtgaaaacggctcgaaaccgagggctatcgtggtcgatccagtacacgggtttatgtactggactgattggggcactcctgcaaaaatcaaaaaagggggactgaacggcgtggatatctacagcctggtcactgaaaacattcagtggccaaatggcatcacactagacctgttgagtggcagactttactgggtcgattccaagcttcacagtatctcttcaattgatgttaatggtggaaatcggaagaccatcctcgaagacgagaagcgactggcccacccctttagcctggccgtattcgaggataaagtcttctggaccgacatcataaacgaagcaattttttccgccaacagactcaccggatccgacgttaatttactagccgagaacctgctgtccccagaagacatggtgctattccataacctgacccagcctcggggggttaattggtgcgaacgcacaaccctcagcaacggcggatgccaatatttatgcctcccagctcctcagattaatccccacagccccaaattcacttgcgcgtgccctgatggaatgcttctggcaagagacatgcggagctgtctcacagaggccgaggctgctgttgctacccaagagacaagcaccgtccgattgaaagtttccagtaccgcggtccggacacaacacactactaccaggcctgtgcccgatacatctcggctgcctggggctacgccagggctaaccactgtcgagatagtcacaatgagccaccaggcattgggcgatgtggcaggccgcggcaatgagaagaaaccgagctccgtcagagcactcagtatcgtcctgcctattgtgctgttagtgttcctgtgtctgggagtcttccttttgtggaagaactggcgtctgaaaaacatcaacagtatcaattttgataacccagtctaccagaagaccacagaggacgaggtccatatttgccacaaccaagatgggtactcctatccgtcccggcagatggtgtctctggaggacgatgtggcc

SEQ ID NO: 352 - DNA, 2580 bp, Artificial Sequence
  Description of Artificial Sequence: Synthetic Transcript Sequence
atgggaccatggggttggaagctgagatggactgtggcgctccttctggcggccgccggtactgcagttggtgacagatgtgaacgcaacgaatttcaatgtcaagacggtaaatgcatttcctacaagtgggtgtgcgacggatcagcagaatgccaggatggttcagacgaatcccaagaaacctgcctgagcgtgacttgtaagtcgggagatttcagctgcggagggcgggtgaatcggtgtatcccccaattttggaggtgcgatggtcaagtggattgtgataatggatcagatgagcagggatgtccccctaagacctgttcacaggacgagtttaggtgtcacgacggaaaatgtatcagcagacaattcgtctgtgattcggatagagattgtctggatggctccgacgaagcatcatgcccagtgctcacgtgtggacctgcgtcgtttcagtgtaactcctctacttgtattccacaactttgggcatgtgataacgatccggattgtgaagatggcagcgatgaatggccacaaagatgccggggactgtatgtgtttcagggagattcgtccccttgttccgcctttgaatttcattgtctttcgggagaatgtattcattcgtcgtggcgatgcgacggtggccctgactgtaaggataagtctgatgaagagaactgtgccgtggcaacttgcagacctgacgagtttcaatgttccgatggaaattgcattcatggttcgagacaatgtgatagagagtacgattgtaaggacatgtcggatgaagtcgggtgtgtgaacgtgacgctgtgtgaaggcccaaacaagttcaaatgccatagcggcgaatgcatcaccctggataaggtttgcaatatggcaagggactgcagggactggtccgacgaacccatcaaggaatgcggaaccaatgagtgcctggacaacaacggtggatgttcgcatgtatgcaacgacctcaagattgggtacgaatgtgactgtcccgatggcttccaactggtggcacaaagaagatgcgaggatattgacgaatgtcaagacccagatacctgcagccaactttgtgtgaaccttgagggaggatacaagtgtcagtgtgaagaaggttttcaattggatccacacaccaaggcgtgcaaggcagtaggttcaattgcctacctgtttttcaccaatcggcatgaagtcaggaagatgacgctggatcggtcggagtatacctcccttatccctaaccttagaaacgtggtggcacttgataccgaggtggcctcaaacagaatatactggtcggatctgtcgcagcggatgatttgctccactcagcttgaccgggcacacggggtcagctcctacgatactgtcatttcaagggacatccaagcacctgacggtctggcagtggactggattcactccaacatttactggacggactcggtcttgggaactgttagtgttgccgatactaaaggggtgaagcgcaaaaccctgtttcgggaaaacgggagcaagccgcgcgccattgtcgtggaccctgtgcatggattcatgtactggaccgactgggggaccccagctaagatcaagaaagggggacttaatggagtggatatctacagccttgtgacggaaaacattcagtggcctaatgggattacccttgatctgctgtccggccgcctgtactgggtcgattcaaaactgcattcaatttcctcgatcgatgtaaatggtgggaataggaaaactattctggaggatgagaaaagacttgctcatccctttagcctggccgtgtttgaagataaggtattctggaccgatatcataaatgaagcaatcttcagcgccaaccgccttactggttcggacgttaatcttcttgctgaaaacctgctgagccctgaagatatggtgctcttccacaacctcacccagcctagaggtgtgaattggtgtgaaagaactaccttgagcaatggaggttgtcaatacctctgtctccccgctcctcagattaatccacattcaccgaaattcacttgtgcctgtccggacggcatgctccttgcgagagatatgagaagctgtttgactgaggccgaggcagctgtggcaacccaggaaacgagtactgtgagactgaaagtttccagcactgcagtgagaacccagcataccactacccgtcctgtccctgacacttccaggcttcctggcgcaaccccaggcctcaccaccgttgagattgtgaccatgtcgcaccaagcactcggtgatgtggctggccgcggcaacgaaaagaagccttctagcgtgcgtgccttgtcgattgtgctgcccattgtcctgctcgtgtttctgtgtcttggtgtgttccttttgtggaagaactggaggttgaaaaacataaactccatcaatttcgataaccctgtgtaccagaaaactacggaggacgaagtgcacatctgccataaccaggatggatacagctaccctagcagacagatggtcagccttgaggatgacgtggca

SEQ ID NO: 353 - DNA, 2580 bp, Artificial Sequence
  Description of Artificial Sequence: Synthetic Transcript Sequence
atggggccctggggttggaaactgcggtggactgttgcccttctgctagctgctgcaggcaccgccgtgggggacagatgcgaacgcaatgaatttcagtgccaggatgggaagtgcatatcctataaatgggtttgtgacggcagcgcagagtgccaggacggtagcgacgaatcacaagaaacctgcctgagtgtcacctgcaaaagcggggactttagttgtggcggacgtgtcaacaggtgcattccccagttctggcggtgcgacgggcaggtggactgcgataacggatctgatgagcagggatgtccccccaagacttgctctcaggatgagtttcggtgccatgacggcaaatgcatatccagacagttcgtgtgcgattctgatcgagattgtctggatgggtcggatgaggcctcctgccccgtgctgacgtgtggtccagcatccttccagtgcaactcttcgacatgtatcccacagctgtgggcgtgcgacaacgatcccgattgcgaggatggttctgacgagtggccccagcgttgtcggggcctctacgttttccaaggcgattcttccccgtgtagcgcattcgagtttcactgcctctctggggaatgcatccactccagttggagatgcgacggcggacctgattgcaaagacaagagcgacgaggagaattgcgcggtcgcaacctgtaggcctgatgagtttcaatgctcagacggaaattgtattcacggaagtcggcagtgtgaccgcgaatatgactgtaaagatatgtctgatgaggtagggtgtgtgaacgtaacactgtgcgagggacctaacaagttcaaatgccactcgggggaatgtatcaccttggacaaggtttgcaacatggctagggattgtcgggattggagtgacgagcccatcaaggagtgcggaacaaatgagtgcctggataacaacggtggatgcagtcatgtgtgcaatgacctgaagatcggctatgagtgcgattgtccggatgggtttcagctcgtggcccaacgacgttgcgaagacatagacgagtgtcaggatccagatacttgctcccaattatgtgtcaatctagagggaggctataagtgtcagtgcgaggagggcttccagctggaccctcatacgaaggcctgcaaagctgtcggatccattgcgtacctgttcttcaccaaccgtcacgaagtccgaaagatgactctcgataggagtgaatacaccagcctaattcctaacctgaggaatgtcgtggcactggacaccgaggtggcctcgaatcgcatttactggagcgacctgagtcaacgtatgatctgcagtacccaactggatagggcacatggagtttcatcatatgatactgttatctcgagagacattcaggcacccgacggcctggcggtggactggatccatagcaatatctactggacagacagtgtgctggggaccgtatcggtggccgacacaaaaggagtgaagcgtaaaaccctgttcagagaaaatgggagtaagcccagggccatcgttgtggaccctgtacacggcttcatgtactggacagattggggcacacccgcaaaaatcaaaaagggtggactcaatggcgtcgacatatactctttggtaaccgagaatatccagtggccaaatggcatcaccttggaccttttatctggccggctctattgggtggattctaaactgcattctatcagcagtatcgacgtaaatggaggcaatcgcaagactatcctcgaagatgaaaaacgactagcccatccattctcactggctgtgtttgaagacaaggttttttggactgatattattaatgaggccatcttcagtgccaaccgcctaaccgggagcgatgtgaatttgttggccgaaaatttactgtcccctgaggacatggttctctttcataatctgacccagcctaggggcgtgaactggtgtgagcgcacaacactaagcaacggagggtgtcagtatctctgcctgccagccccacagattaacccacatagtccaaagtttacctgcgcttgtcctgacggcatgctgctggcccgggatatgagatcatgtttgaccgaggctgaggctgcggtggcaacgcaagagacaagtaccgtacgtctgaaggtttctagcaccgccgtacggacacaacacaccactactaggcccgtccctgacacctcccgactgcctggtgctaccccgggacttactacggttgaaatagtcactatgtcgcaccaggcactgggcgacgttgccggccggggtaatgaaaagaaaccgtcatccgtgagggcactgtcgattgtgctgcctatcgttctactggtgttcctgtgtttgggggtgttcctgctatggaaaaattggcgcctgaaaaacattaactccatcaacttcgataatcctgtatatcaaaagaccaccgaagacgaagtacacatatgtcacaatcaggatggttacagctacccaagtcggcagatggtgtcactcgaagatgacgtggcc

SEQ ID NO: 354 - DNA, 2580 bp, Artificial Sequence
  Description of Artificial Sequence: Synthetic Transcript Sequence
atgggaccttgggggtggaagctgcggtggaccgtggcgctgctccttgccgccgcggggactgccgtcggggatcgctgcgaacgcaatgaattccagtgccaagatggaaagtgtatctcctacaagtgggtgtgcgacgggtccgccgaatgtcaggatggttcagacgagtcacaggaaacctgcctgtccgtgacttgtaagtcaggagatttctcgtgcggaggaagggtgaatagatgtatcccgcagttctggaggtgcgatggacaagtggattgcgacaacggatcggatgagcagggatgcccgccgaagacctgcagccaggatgaattcagatgccacgatggtaaatgcatttccagacaatttgtgtgtgacagcgacagggactgcctggacggatcagatgaggctagctgcccggtattgacctgtggacccgccagcttccagtgcaacagctccacctgcatacctcagctgtgggcgtgcgataatgacccagattgtgaagatggatcagatgaatggccgcaaaggtgccggggcctgtacgtgttccagggtgactcctccccctgcagcgcgttcgagttccactgcctgtcgggagaatgtatccactcctcctggcggtgcgatggaggcccagactgcaaggacaagagcgacgaagagaactgcgcagtcgctacctgtcgcccggacgagtttcagtgctcagacggcaattgcattcatggatctcggcagtgcgacagagaatacgactgtaaagacatgtcggacgaggtggggtgcgtgaacgtgactctctgtgagggacccaataagtttaaatgtcattcgggagagtgtattacccttgacaaggtgtgcaacatggcccgcgactgtcgggattggtcagatgagccaatcaaagagtgcggtaccaatgagtgtctggacaacaacggaggttgcagccacgtgtgcaatgatttgaagattggttacgaatgcgactgcccggacggtttccaacttgtggcacaacggagatgcgaggatatcgacgaatgccaagatccggatacttgctcccaactctgtgtgaacctcgaaggagggtataaatgccagtgtgaagaaggattccagctcgacccgcacaccaaggcctgcaaggcagtgggatccatcgcctacctgtttttcaccaaccggcatgaagtcagaaagatgacgctcgaccgcagcgagtacactagcctcattccaaatctccgcaatgtggtggcactggatacggaagtggcctctaacagaatctactggtctgatttgagccaacgcatgatctgcagcacccaactggatcgggcccatggcgtgtcttcgtacgacaccgtgatctcacgggatatccaggccccggacgggttggcagtcgattggatccacagcaacatctattggactgactccgtcctcgggactgtctcagtcgctgacactaaaggagtgaagagaaaaaccctgttccgcgaaaacggctcaaaaccaagagcgatcgtggtggacccggtccacggattcatgtactggaccgactggggaaccccggcgaaaatcaaaaagggaggactcaacggggtcgacatctactccttggtgaccgaaaacatccagtggccaaacggaataaccttggatctgctttccggtagactgtactgggttgacagcaagctccatagcatcagctcgatcgatgtcaacggaggtaatcgaaaaacgattttggaagacgaaaagcgcctcgctcaccccttttcgctggcggtgttcgaagataaagtcttttggactgacatcatcaacgaggcgattttctccgccaaccggctgacgggatcggacgtgaatctcctggccgagaatttgctcagcccggaagatatggtgcttttccataaccttacccaaccgcggggcgtgaactggtgtgagcgcacgactctttccaacggcggatgccagtacctttgcttgccagcccctcaaatcaatccgcattctcctaagtttacctgcgcctgcccagatggaatgctccttgcgcgcgatatgcggtcctgcctgaccgaagccgaggctgcagtggcgacccaggagactagcactgtgcgcctgaaagtctccagcaccgccgtcaggacccagcatactaccactcgcccggttccggacacctcgcggctgcccggagctacccctggactgaccactgtcgagatcgtcacgatgtcacatcaggcgttgggtgacgtggccgggcgcggcaacgagaagaagcccagctcagtgcgcgctctctcaatcgtgctcccgatcgttctgctggtgttcctgtgccttggagtgttccttctttggaagaactggcggctcaagaatatcaactcaatcaacttcgacaacccggtgtaccagaaaactaccgaggatgaggtgcatatctgccacaatcaggacggatactcctacccttcacgtcagatggtcagcctggaggacgatgtggcc

SEQ ID NO: 355 - DNA, 2580 bp, Artificial Sequence
  Description of Artificial Sequence: Synthetic Transcript Sequence
atgggaccatggggctggaagttgagatggactgtggccctccttctcgcagcagcggggacggcagtcggcgataggtgcgagcgtaacgagttccaatgccaggacggcaagtgcatctcatacaagtgggtctgtgacggtagcgcagagtgtcaagacggatcagacgaatcacaggaaacctgcttgtcggtgacctgtaagtccggggatttcagctgtgggggtcgggttaatcgatgcattcctcagttttggagatgcgatggacaagtggattgcgataatggatccgacgaacaagggtgtcctcctaaaacctgttcccaagacgagttccgctgtcatgatggtaagtgcatatcacgccaatttgtgtgcgattccgatagagattgtctcgatggctcggatgaagcaagctgtccagtgctcacctgcggacccgcatcgtttcagtgtaatagctcaacgtgcatcccgcagctctgggcctgtgataacgatcccgattgtgaagatggatcggacgaatggcctcagcgatgtcggggtctttacgtgtttcaaggagattcctcaccctgcagcgcttttgaattccactgcctctcgggggagtgcatccattcatcgtggagatgtgatggaggacctgattgtaaagacaagtcggatgaagaaaactgtgcggttgcaacctgcagacctgatgagtttcaatgctcggatgggaactgcatccatgggtcccgacaatgcgaccgggaatacgattgtaaagatatgtcggatgaggtgggttgtgtcaacgtgactctctgtgaaggccctaacaaattcaagtgtcatagcggcgaatgtatcaccctggataaggtctgtaatatggccagggattgtagggattggtccgatgaaccgattaaagaatgtggtaccaacgaatgccttgataacaatgggggctgtagccatgtgtgcaatgacctcaaaatcggatacgaatgtgattgccctgatggttttcaactggtggcacagcgtagatgtgaggacattgatgaatgtcaagatccagacacctgttcacaactgtgcgtgaatctggaaggggggtacaaatgtcaatgcgaggaaggattccaacttgatccgcatactaaggcctgcaaggcagtgggaagcattgcataccttttctttaccaatcgccacgaagtgcgaaaaatgaccctggatcggtcggaatacaccagcctcattcccaatctccggaatgttgtggccctggacactgaagtggcatccaatagaatatactggagcgatctttcacagcgcatgatttgttcaacccagttggaccgcgcacacggtgtgtccagctacgacacggtgatctcaagagatattcaagcgccagacggccttgccgttgactggattcacagcaacatttactggactgattccgtgcttgggactgtgagcgtggcagatactaagggggtcaagcggaaaactctgtttagagaaaacggctcaaagcctcgcgctatcgtggtggaccctgtccacggtttcatgtactggactgactggggtactccagcaaagataaagaaaggaggtcttaacggggtggacatttactccctcgtgacggaaaacattcagtggcctaacgggattaccctggatcttcttagcggacggctgtactgggtcgattctaaacttcactccatctcctcgattgatgtcaacggaggcaacaggaaaactattctcgaagatgaaaagaggcttgctcatccctttagcctggccgtttttgaagataaagtgttctggaccgacatcattaacgaggcaatcttcagcgcaaacagattgactggttcagatgtcaatcttctggcagaaaacctgctgtcccccgaagatatggtgctctttcataatcttactcagccccggggcgttaattggtgtgagcggaccaccctctccaatggtggatgtcagtacctttgtctcccagcaccacagattaatccgcactcgccaaagttcacctgtgcctgccccgatggcatgctcctggcacgcgacatgcgttcgtgtcttacggaagcggaagcggcagtggcgacccaggaaacttcgacggtccggctcaaggtgtctagcaccgcggtccgcacccaacataccactaccagacccgtgcctgacacttcacgacttcctggagcaactcctgggctcacgaccgtcgaaattgtgaccatgtcccatcaggccctcggtgacgtggctggaaggggcaatgaaaagaaaccttcgtcagtgcgagcactttcgattgtcctgcctatcgtgctgctggtgtttctttgtcttggtgtgttcctgctctggaaaaactggcggctcaagaacatcaactccattaacttcgataaccctgtctaccaaaagactacggaagatgaggtccatatatgtcataatcaggatgggtacagctatccctcacgacagatggtgagcctggaagatgacgttgcg

SEQ ID NO: 356 - DNA, 2580 bp, Artificial Sequence
  Description of Artificial Sequence: Synthetic Transcript Sequence
atgggcccttggggatggaaactgcgctggacagtggcactgctgttggccgcagccggaaccgccgtcggagaccggtgtgaaaggaacgaatttcagtgccaggatggcaagtgtatttcatataaatgggtctgcgatggttccgctgaatgccaggacggcagtgatgaaagtcaggagacttgtctgtccgtgacctgcaagagcggcgattttagttgcgggggccgtgttaatcgttgcattcctcagttttggagatgcgacggtcaggtagactgcgataacggttccgatgagcagggatgcccaccaaagacatgttcccaggatgaattccggtgtcatgacgggaaatgcatctctcgccagttcgtgtgtgattccgaccgcgactgccttgacgggtctgacgaagcctcttgccccgtacttacatgtggtcctgcctctttccagtgcaactcgtctacatgcattccccagctgtgggcatgtgacaatgacccagattgcgaagatggcagtgatgagtggccccagcgatgcaggggactgtacgtgtttcagggtgacagcagtccctgttccgcttttgaattccattgtcttagtggcgagtgcattcactcttcatggagatgcgacggcggtccagactgcaaggataagtctgatgaggagaactgtgccgtcgccacctgtcggcccgacgagttccagtgttcagacgggaactgcatccacggaagccgtcagtgtgatcgcgagtacgattgtaaggacatgtctgacgaagtcggttgcgtgaatgtcaccctctgcgagggacctaacaagtttaaatgtcactctggggagtgcatcaccctcgataaagtctgtaacatggcccgggattgtcgggattggtcagatgaaccaataaaggaatgcggaaccaatgaatgcttagataataacgggggctgcagtcacgtttgtaatgatttgaagattggttatgaatgtgactgccccgacggcttccagttggtggcccagcggcggtgtgaggacattgacgagtgccaagaccctgatacatgtagccagttatgcgtcaatctggagggtggctataagtgtcagtgcgaagagggctttcaactggacccgcatacaaaggcctgcaaggccgtgggcagtatcgcctatctattttttaccaatcgccacgaagtgaggaaaatgacacttgatcgctctgagtacacatctctcatccctaatctccgcaatgttgttgcgctggatactgaggtcgcctcaaatcggatttattggtctgatcttagccagaggatgatctgttctactcagctcgaccgagcccatggagtctcttcatacgatactgtcatatctagggatatccaggccccagatggtttggctgtagattggatccattccaacatctattggaccgacagcgtgttggggactgttagcgtggcagacacaaaaggcgtcaagcgaaagaccctcttcagagagaacggatctaaacctcgagccattgtcgtggaccccgtgcatggcttcatgtactggactgattgggggactcccgctaagatcaagaagggaggcttgaacggggtcgacatatatagcctcgtgactgagaatattcagtggcctaacggcatcaccctcgacctgctgtctgggcggctctattgggtggatagcaagttacattcaatctcaagcatcgatgtaaacggtggcaacaggaaaaccatcctggaagatgaaaagcggctggcacatcctttcagcctggccgtgtttgaggataaggttttctggactgacatcatcaacgaagccatcttttccgccaataggcttacaggatcggacgtcaacttgctggcagagaacttgctctcacctgaagatatggtgctgttccataacctaactcagcctcggggagtcaattggtgtgaaaggactactctgtctaatggaggatgccagtacctttgtttacctgcaccgcaaatcaatccccactcaccaaagttcacttgcgcctgtcctgatgggatgttgttggcccgagatatgagatcctgccttaccgaagctgaagctgctgtggccacacaagagaccagtactgttagactgaaggtgagttcaactgccgtacggacacagcacaccaccacccgacctgttcccgataccagtaggttgcctggcgctacacctggtctgacaacggtggagattgtgactatgtctcaccaggctttgggggatgtggctggacgtggtaatgaaaaaaaaccttcttccgttcgagccctgtccatcgttctgcctattgtgttactcgtgttcctgtgtcttggagtatttctgctgtggaagaattggcgcctcaagaatatcaattcaattaacttcgataacccagtgtaccagaaaacaaccgaggatgaggtgcacatctgccataaccaagatgggtattcatatcccagccgtcaaatggtaagcttagaggatgatgtggct

SEQ ID NO: 357 - DNA, 2580 bp, Artificial Sequence
  Description of Artificial Sequence: Synthetic Transcript Sequence
atggggccttggggctggaaactaagatggaccgtcgccctgctcctggctgctgcggggacagcagtgggagataggtgcgaacgaaacgagtttcagtgccaggacggtaagtgcatttcctataaatgggtttgtgatggatctgcagagtgccaggatggcagcgatgagagtcaagagacatgtctttccgtgacatgcaagagtggggacttctcctgcggagggagggttaatcggtgcattccccagttttggcgctgtgatggccaggtggactgtgacaatggatcggacgaacaagggtgcccacccaagacatgctcccaggacgaatttcggtgccacgatgggaaatgcattagtcgacagtttgtttgtgacagtgatcgtgattgcctggacgggtccgacgaagcctcttgccccgtattgacttgcgggccagcctctttccaatgcaacagctccacctgcatcccccagctttgggcttgtgataacgaccccgactgtgaagacggttcggatgaatggcctcaacgatgtcgagggctgtacgtcttccaaggggattcgtccccctgtagcgccttcgaattccattgtctctctggagaatgcattcatagttcctggaggtgcgatggggggcctgattgtaaggataaatcagacgaggagaactgtgccgtcgctacctgcaggccagacgaattccagtgttccgatggcaactgtatccacggaagtaggcaatgtgacagagagtatgattgcaaggatatgagcgacgaagtcgggtgtgtgaatgtgacactgtgtgaaggcccgaataagttcaaatgtcactccggcgagtgtattaccttggacaaggtctgtaacatggccagggactgtcgcgattggagtgacgagcccatcaaagagtgcggcacaaacgaatgcttagacaataatggcggctgctcccatgtctgtaatgacctgaaaatcggctatgagtgcgactgtccggatgggttccagctggtcgcacagcggagatgtgaggacatcgacgagtgccaggacccggacacatgttcccaattgtgcgtgaacctcgagggggggtacaagtgccagtgcgaagaaggttttcaattggacccacacactaaagcctgcaaagcggtggggagcattgcttacctcttttttaccaacaggcatgaagtgagaaaaatgaccctcgacagatcagaatacacctcactgatccccaacctcaggaacgtcgtggcactagacaccgaggtcgcctcaaatagaatttattggagtgacctgtcccagcgcatgatctgctcaacacagctcgaccgagcgcatggcgtcagctcttacgatactgtcatttcccgtgatatccaggcacccgacgggctcgccgtggattggattcactctaatatttactggacagactcagttctggggaccgtaagcgtggccgataccaaaggggtcaagaggaagaccttattccgagaaaacgggtccaagccccgcgctattgtggtagaccctgtgcatggttttatgtattggaccgattgggggacccctgccaagatcaagaaggggggcctgaatggggtggatatttacagtctggtgaccgagaacattcaatggccaaatggtataaccctagatctgttgtccggccgtttatattgggtggactctaaactgcattccatcagcagcattgacgtaaacggagggaaccgcaagacaatattggaggacgagaagaggttggcgcaccccttctcgctggccgtattcgaggataaggtcttctggacagacattataaacgaagctattttctccgccaatcggctgacgggctccgacgtgaatctactcgcagaaaaccttttaagtcctgaagacatggtgctatttcacaaccttacacaacccaggggggtcaattggtgtgagagaaccactttatccaacgggggctgtcagtatctgtgtctgcctgccccccaaattaacccccacagccctaagttcacctgtgcttgccccgacggtatgcttctggcaagggatatgcgatcctgcctgaccgaagccgaggccgccgtcgcaactcaagaaacttctactgtccggttaaaagtttcatctacagcggtcagaacacagcatacaactacccgccctgtccccgacaccagcaggctgcccggcgccaccccaggattgacaacagtggagattgttacgatgagtcaccaagccttgggggacgttgccggaagggggaatgaaaaaaaaccctcatccgttagagcgctgtcaattgtactccctatcgtattgttagtgttcctctgcctcggcgtctttttactttggaagaattggagactgaaaaatatcaactccatcaactttgataacccagtatatcagaaaaccacagaggacgaggtccatatttgtcataatcaagatgggtactcttacccgtccagacaaatggtctccctagaagacgatgttgca

SEQ ID NO: 358 - DNA, 2580 bp, Artificial Sequence
  Description of Artificial Sequence: Synthetic Transcript Sequence
atgggaccgtggggctggaagttgcggtggaccgtggcactcctgctggctgcggccgggaccgcggtgggcgatagatgcgaacgtaatgagttccaatgccaagacggtaagtgtatttcgtacaaatgggtctgtgatggatcagccgagtgtcaagacggctccgatgagtcgcaagaaacgtgcctttcagtcacttgcaaatcgggagatttctcatgcggaggacgcgtcaaccggtgcatcccgcagttctggcggtgtgatggacaagtggattgcgataatggaagcgatgagcaagggtgtcccccgaaaacttgctcccaggacgaatttaggtgccacgatgggaagtgcatctcgaggcaatttgtgtgcgactccgatagagattgcctggacggttcggacgaggcgagctgtccagtgttgacctgcggaccagcctcttttcaatgcaactccagcacctgcattcctcagctgtgggcgtgtgacaatgatccggactgtgaggacgggtcggatgagtggccacagcggtgtcggggtctttacgtgttccagggagactcttccccgtgctcggcgtttgaatttcactgcctgtccggagagtgtatccattcgagctggcggtgcgacggaggaccggactgtaaggacaagtcagacgaggagaactgtgccgtcgccacttgccggccagacgaattccagtgctcagatggaaactgtatccacggcagccggcagtgcgaccgggagtacgattgcaaggacatgtccgatgaagtgggatgtgtcaatgtgactctgtgcgaaggcccaaacaagtttaagtgccactccggagaatgcattactctggataaagtgtgcaacatggcccgcgattgccgcgactggtccgacgaaccgatcaaagaatgcggcaccaacgagtgtttggacaataacggaggctgtagccatgtctgcaatgacctgaagatcggatacgaatgtgactgcccagacggatttcaactcgtcgcgcaacgccgctgcgaggatatcgatgaatgccaggatcctgacacttgttcacaattgtgtgtcaacctcgagggcggatacaagtgccagtgtgaggaagggttccagctggacccgcatactaaggcatgtaaggccgtgggatcgatcgcgtacctgttcttcacgaatcggcacgaagtgcggaagatgactctggacagatcggaatataccagcctgattccgaacctgcggaacgtggtcgcactggacaccgaagtggcgtccaatagaatatactggtcggacctctcccagcggatgatctgctcaacccaacttgaccgcgcgcatggcgtctcctcatacgacaccgtgatctcacgcgatattcaggccccggacgggctggcagttgattggattcattcgaacatctactggacggacagcgtgctgggtacggtgtcagtggccgatactaagggggtcaagcgcaagaccctgttccgcgaaaatgggtcgaagcccagagccatcgtggtcgacccagtgcacggattcatgtactggaccgactggggcactccagccaagatcaagaaagggggattgaatggagtggacatttacagcctggtgaccgagaatatccaatggccgaacggaatcaccctggatctgctgtcggggcgcctttactgggtcgattcaaagctccattccatcagctcaatcgatgtgaatggggggaaccgcaaaaccattctcgaagatgaaaagcgcctggctcacccgttcagtctggcggtgttcgaagataaagtgttctggaccgacattatcaacgaagccatcttctccgccaaccggctgactggctccgacgtgaacctgctcgccgagaacctcttgtcgccggaagatatggtgctctttcataacttgacccagccacggggcgtgaactggtgtgagcgcaccactctctcaaatggaggatgtcaatacttgtgtctgccagccccccagatcaacccgcactcgccaaagttcacttgcgcatgtcccgacgggatgctgctcgctcgcgacatgcggtcctgcctcaccgaggcagaagctgcagtcgcgacgcaggaaacctcaaccgtgagactcaaggtgtcgtcgaccgccgtacggactcagcacactaccacccggccagtgccggatactagccggctgcctggagcaaccccgggactgaccacggtcgaaatcgtcactatgtcccaccaagccttgggagacgtcgccggccgcggtaatgagaagaagccctcgtccgtccgggccctcagcatcgtgctgccaatagtgctcctggtgttcctgtgcctgggagtgtttctgctgtggaagaactggcgtctcaagaatatcaattcaattaacttcgacaacccggtgtaccaaaaaactaccgaggacgaggtgcatatctgccataaccaggacggttacagctacccgtctcgccaaatggtgagcctggaggacgacgtggct

SEQ ID NO: 359 - DNA, 2580 bp, Artificial Sequence
  Description of Artificial Sequence: Synthetic Transcript Sequence
atgggaccttgggggtggaagctgagatggactgtggcccttcttctggccgcagccggaactgcagtcggtgacaggtgtgagcgcaacgagtttcaatgtcaagacggaaaatgtatatcatacaagtgggtgtgcgacgggtccgcagaatgccaggatggatcagatgagtcacaagaaacttgcctctcggtgacctgtaagagcggagatttttcgtgcggaggacgcgtcaacagatgtattcctcagttttggaggtgtgatggacaagtcgattgtgacaacgggtcggacgagcaaggttgtccacccaagacctgcagccaagatgaattcagatgtcacgacggcaagtgtataagtaggcagttcgtatgcgattcagatagagactgcctggacggaagcgatgaggcttcgtgtccagtgctgacctgtggcccagcctcgtttcagtgcaactcaagcacctgtatccctcagctttgggcatgtgataacgatcctgattgcgaggacggttcagacgaatggccacaaagatgccgaggactgtacgtctttcagggtgatagctcaccttgttccgcattcgagtttcactgcctgtcaggggagtgcatacactcttcgtggaggtgcgatggtggccccgactgcaaggataagtccgacgaggaaaactgcgcagtggcgacctgtaggccggatgagtttcaatgctccgatggtaactgcatccacggtagcagacaatgcgatagggagtacgactgtaaggatatgtcggatgaggtggggtgtgtgaacgtgactctctgtgaaggacctaacaagttcaagtgccattccggtgagtgtattactcttgataaggtgtgtaatatggccagggactgtcgggactggtccgatgaacccattaaggagtgcggcactaacgaatgccttgacaacaacggcggatgttcacacgtctgcaacgatctgaagattggatatgaatgcgattgtcctgacggtttccaacttgtggcccaaagaagatgtgaagatatagatgaatgtcaagaccctgacacttgcagccagctgtgcgtcaacctcgaaggtgggtacaaatgtcagtgtgaagaaggttttcagctggacccgcacaccaaagcatgtaaggctgtggggtcgatagcatacttgtttttcaccaaccgccatgaggtgcgtaagatgaccctcgaccgatcggaatacacctcactgattcccaatcttcgcaacgtggtcgcactggataccgaggtggcttccaatcgcatatactggtcagacctgagccagagaatgatctgcagcacccaactggacagggcacatggggtgtccagctacgacactgtcatttccagggacatacaggcacccgatggcctcgcagttgattggattcattcaaacatttactggaccgattccgtgctgggcacggtttctgtcgcagataccaagggtgtgaagagaaagaccctgtttcgagagaatggatcgaagcctcgcgcaatagtggtagatccagtgcacggattcatgtactggactgattgggggaccccggcaaagatcaagaagggagggcttaatggtgtcgacatttactccctcgtgactgagaacattcaatggcctaatggaattaccctggacctgctctcgggccgcctttactgggttgactcaaaacttcattcgatctcctcgatcgacgtcaatggagggaacaggaaaactattttggaagatgagaagcgacttgcacatccattctcactggcagttttcgaagataaagtgttttggactgacatcataaacgaggctattttctcagcaaacagacttacgggatcggacgtgaatttgctcgcagaaaatctgctgtcccccgaagatatggtgctctttcataaccttacccagccacgcggcgtgaactggtgcgaacgcaccactctttcgaatggagggtgccagtatctttgcctgcctgcgccacagattaacccacactccccaaagttcacttgtgcatgcccggatgggatgctcctcgccagagatatgcgatcctgcttgacggaggcagaagcagctgtcgcgacgcaggaaacttccaccgtgcggcttaaggtgtcaagcactgccgtgagaacccagcatacgactacccggccagtccctgatactagccgacttcctggtgccactcccggacttaccaccgtggaaatcgtgaccatgtcacatcaagcattgggcgatgttgcaggcagaggaaacgagaaaaagccttcgtcggtccgggcactctccatcgtgctgccaattgtgcttctcgtgttcctgtgtcttggagtgtttcttctctggaagaactggcgcctcaaaaacattaactcgatcaactttgataatcctgtttaccagaaaactactgaagatgaagtgcacatttgccacaatcaggatggatactcgtaccctagtagacagatggtgtcgctggaagatgatgtggca

SEQ ID NO: 360 - DNA, 2580 bp, Artificial Sequence
  Description of Artificial Sequence: Synthetic Transcript Sequence
atgggcccttggggttggaaactgcgatggaccgttgcactgttgctcgccgccgctgggactgcagtgggcgaccgttgcgagcggaatgaatttcagtgtcaggacgggaagtgcatatcatacaaatgggtgtgtgacgggtcagccgagtgccaagatgggtctgatgagagccaggagacctgcctcagtgtaacctgcaagtctggagatttttcatgcggtggcagggtgaatagatgtattccacaattttggcgatgtgacggccaggtcgattgcgacaatggatctgacgagcagggctgccctcctaaaacgtgttcacaggatgaattccggtgccatgatggtaaatgtatctctcgccagttcgtctgcgacagcgatagagactgtctggatggttcagatgaagcctcctgtccagtgctaacctgtggtcccgcctcttttcagtgcaactcctctacttgcattccacaactgtgggcatgtgataatgatcccgattgtgaagacggatctgacgagtggcctcagagatgcagggggctgtatgtgtttcagggggatagtagcccctgtagcgcttttgagtttcactgtctctccggcgagtgcattcacagtagctggagatgcgatggaggcccagattgtaaagataaatcggacgaggaaaattgcgccgtcgcaacttgcagacccgacgagtttcagtgctctgatgggaattgtatccacggatcaaggcagtgcgaccgggaatatgattgcaaggacatgagtgacgaggtcgggtgtgtgaacgttactttgtgcgaagggcccaacaaatttaagtgccactccggagaatgcataaccctagacaaagtgtgtaatatggcccgggattgtagagactggagtgacgaacccattaaagagtgtggcaccaacgaatgtttagataataatgggggatgttcacatgtgtgtaacgacctgaagatcggctatgaatgcgattgccctgacggtttccaactggtcgctcagcgcagatgcgaggatatcgacgagtgccaggacccagatacatgtagtcaactgtgcgtaaatctggaaggaggatataagtgccagtgcgaggaaggcttccagttggacccccatactaaggcctgcaaggccgttggatcgatcgcctatctattctttacgaatcggcatgaggtgaggaagatgaccttggacagatcggaatacacctcactcatccccaacctcaggaacgtggtggccttggataccgaggtggccagcaaccgcatctactggagcgacctttctcagcggatgatttgttcaacacagctggatcgggctcacggagtgagctcgtatgatactgtgataagtcgagacatccaggctcccgatggcttggcagtggattggattcatagtaacatatattggaccgattccgtgctgggaaccgtcagcgtggccgataccaagggtgtgaaacgcaagactctttttcgcgagaacgggtcgaagccaagagcgattgtagttgacccagtccatggctttatgtattggactgattgggggaccccagccaagattaagaagggcggacttaatggagtggacatctattcactggtgacagagaatatccagtggcctaatggtattactttggatctgctgtccggccgactatactgggttgattcgaaactacactcaataagtagtatcgacgtcaatgggggtaatcgaaaaacaattctggaggacgaaaaaaggctcgcccatccctttagcttagccgtattcgaagataaggtattctggacagacattatcaatgaggccattttctctgctaatcgtctgaccggcagcgatgtgaatctgctagctgaaaatctcctgtcccccgaagacatggtcctgttccacaacttgacgcagcctcgaggcgtaaactggtgtgaacgtacaaccctgtcaaatggcggctgtcagtacctttgtctgccagctccacagatcaatccccactcccccaagttcacctgcgcctgccctgatggaatgctactcgccagagatatgcggagctgcctcacggaggctgaagcagccgtggcaacacaggaaacttccactgtccggttgaaggtttccagcaccgctgtccggactcaacataccacaacccgtcccgtgcctgacacgtctagacttcctggagccacacctgggttgaccacagtggagattgtcactatgagccaccaagctctgggggacgttgccggtaggggaaacgagaaaaagcccagtagtgtgcgggccttgagtattgtactgcccatagtgttgctggtgttcttgtgcctcggcgtgttccttctctggaaaaactggaggttgaaaaacataaacagcatcaacttcgataatcccgtataccagaagacaactgaggacgaggttcacatttgtcacaaccaagatggctactcttatccatctaggcagatggtgagcctcgaggacgacgtggca

SEQ ID NO: 361 - DNA, 2580 bp, Artificial Sequence
  Description of Artificial Sequence: Synthetic Transcript Sequence
atgggcccatggggctggaagttgaggtggacggttgcgctgctccttgcggctgccggcaccgccgtgggagatcgctgcgagcggaacgaatttcaatgccaggacggcaaatgcataagttataagtgggtgtgcgacgggagtgccgagtgtcaagacggctctgacgagtcccaggaaacttgcttgagcgttacctgcaagtccggagatttcagttgcggaggccgcgtaaataggtgcataccccagttttggaggtgtgatgggcaagtggattgcgacaacggctctgatgagcagggctgtccccctaaaacctgctcacaggatgaattcaggtgccatgatggtaaatgtatcagcaggcagtttgtttgtgattccgatagggactgcctggacggatctgacgaagccagttgcccggtcctgacttgtggtccagcgtccttccaatgcaactcctccacgtgtatcccccagttgtgggcgtgtgataacgaccctgactgcgaagacgggagtgacgagtggccccagagatgtaggggactgtacgtgtttcaaggggactcaagcccatgttccgcctttgagttccactgcctctccggcgagtgtattcactcaagctggagatgtgatgggggcccagattgtaaagacaaaagcgacgaggagaattgtgccgtggctacctgtcgccccgatgagttccagtgttccgacggtaactgtatacacggatcacgccaatgcgaccgagaatatgactgcaaggacatgagcgatgaggtgggatgcgtgaatgtcacgctgtgcgaggggcctaacaagttcaaatgccactccggtgagtgtattactcttgataaggtttgcaatatggctcgagattgcagagattggtccgatgagcccataaaagagtgtggcaccaatgaatgtttggataacaacggcgggtgctctcacgtgtgcaacgatctcaagattggctacgagtgtgattgtccagatgggttccaactcgtggcgcagcgccgctgcgaagacattgatgaatgtcaggatcctgatacgtgctctcagctttgcgtgaaccttgaagggggttataaatgtcaatgtgaggagggttttcagctggatcctcacacaaaagcatgcaaggctgtcggttcaatcgcatatctttttttcacgaatcgacatgaagttcgcaagatgaccttggaccgaagtgagtacacctccctgatcccaaacttgaggaacgtggttgctttggacactgaggtggcctccaataggatttattggtctgatctgagccagcgcatgatctgtagtactcagctcgaccgggctcacggcgtgtctagttatgatacagtcatctcccgggacatccaggctcctgacggccttgcggtagactggatccattctaacatctactggacagactccgttctcggtacggtctccgttgccgataccaaaggtgtgaagagaaaaaccctgtttcgcgaaaatggatccaaacctcgcgcgattgttgttgatccagtgcatggcttcatgtactggaccgactggggcactcccgccaagattaaaaaggggggtctcaatggcgtggacatttacagcctggttaccgagaatattcagtggcccaacggaatcaccctggacctgctgtctggcaggctgtactgggtggactccaaactgcattccatcagttcaattgatgtgaacggtgggaaccgaaaaaccatcctcgaggatgagaagcgcctggcacatccgttcagccttgccgtgttcgaagacaaggttttctggactgacattattaacgaagccattttcagcgctaaccgactcacggggagcgacgtgaatctgctggccgaaaatctgctctcaccagaagacatggtcctgttccataacctgacgcagccccggggagtaaattggtgtgagaggactaccctgtcaaatggggggtgtcagtacctgtgtctgccggcgccccaaatcaatccccacagccccaaatttacctgtgcctgccctgacggaatgctgctggccagagatatgagatcctgtctgacagaagcagaggctgccgtggccactcaggaaacttccacagtgaggcttaaggtgagtagtaccgccgtgcgcacgcagcacaccacaaccaggcctgttccggatacgagtagactgcctggcgccacaccggggctcactacagttgagattgtcacaatgtcacaccaggcgctgggagatgtcgctggtcggggtaatgagaagaagccatcatccgttagagcactgagcattgtgttgccaattgtgctgctggtgtttctctgtcttggtgtgtttcttctgtggaagaattggcgcctcaagaacatcaacagcattaacttcgacaatccagtttaccagaaaacaacagaagacgaagtacacatttgtcataaccaggatggctacagctatccctcacgccagatggtttctcttgaggacgatgtggct

SEQ ID NO: 362 - DNA, 2580 bp, Artificial Sequence
  Description of Artificial Sequence: Synthetic Transcript Sequence
atgggcccctggggttggaagttaagatggacagtagcactccttttggctgctgcaggaacagctgtgggggaccggtgcgagagaaacgagttccagtgtcaagatggtaagtgcatttcgtacaagtgggtttgcgatggtagcgccgaatgccaagatggttccgatgaaagtcaggagacttgcttgtcagtcacctgtaaatctggggatttctcgtgtggaggtcgtgttaacagatgcataccacagttctggcgttgtgacggtcaggttgattgtgacaatggtagcgacgagcagggctgtcccccaaagacttgctcccaagacgaatttcgatgccatgatggaaagtgcatctcaaggcagttcgtttgcgatagcgaccgtgattgtctcgacggttcagacgaggctagctgtcccgttctaacttgcggaccggctagctttcagtgcaactcctcaacttgcattccacaattatgggcctgcgacaacgatcccgattgcgaggatggtagtgacgagtggccgcaacggtgcaggggtctgtacgtatttcagggtgattcctccccatgctcagccttcgaattccattgtttgtcgggggagtgtattcactcatcatggcgatgtgacggaggacccgattgtaaagataaaagcgatgaggagaactgcgcagttgcaacctgtcgtcccgacgagttccaatgttcagacgggaactgtatccatgggtcccgtcagtgtgatagagaatacgactgcaaagatatgagtgatgaggttggttgcgtcaatgtaaccctttgtgagggaccgaacaaatttaagtgccacagcggggaatgcataactttggacaaggtttgtaatatggctagggattgcagggattggtcagatgaaccaatcaaggaatgtggtacaaatgagtgcctcgataataacggaggatgcagccatgtttgtaatgacctcaagatagggtatgagtgtgactgtcctgatgggttccaacttgttgcccaaaggagatgtgaggacatcgatgagtgccaggatcccgacacctgttcacagttgtgcgtgaatcttgaaggaggttataagtgtcagtgcgaagaaggtttccaattagatccacacaccaaggcttgcaaagccgttggttctattgcttacctttttttcactaaccgtcatgaagtcagaaaaatgactttggatagaagcgagtacacttcgctgatacctaatttgcggaatgttgtcgcacttgatacggaagttgcttcaaatagaatttattggtcggacctttcacaacggatgatttgctcgacccaattggacagggctcatggcgtatctagttacgatactgtcatctctagagatattcaagcaccagacggcttggctgttgactggatccattcaaacatctactggacagattcggtccttggtaccgttagcgttgccgacacaaagggggtcaaacggaagacgttgttccgggaaaacggttctaagccccgagccatcgtggtcgacccagtccatggcttcatgtattggactgattggggtactcctgctaagataaaaaagggtggtcttaacggagttgatatttattcccttgtgacagaaaatattcagtggcccaatggtatcacgctggatttgctctcgggtcgtctatactgggttgattctaaactccactcaatttcaagcattgatgtgaatggcggtaataggaaaacaatccttgaggatgagaaaaggttggcacacccattctctcttgctgtgtttgaagataaggtattttggactgatattatcaacgaagctattttctccgctaataggcttactggctccgacgttaatttgttggcagaaaatctactttcccctgaggatatggtccttttccataatttgacgcagccaagaggtgttaattggtgtgaaaggactacgctttcgaatggaggatgtcagtatctgtgtttacctgccccacaaattaatccacactcaccaaagttcacgtgcgcatgtccagatgggatgttgcttgcaagagatatgagatcctgcttgactgaagctgaagctgcagtcgctacacaagagacttccaccgttagacttaaagttagtagtactgccgtgcgtactcagcatactacaaccagacctgtgccagatacctcaaggcttccaggggctactcctggactaaccaccgttgaaatcgttactatgtcgcaccaggcgttgggagatgttgccggaaggggtaatgagaagaaaccttcttcagttagggcattgtcaattgtgctccctattgtcttgcttgtgtttttgtgtcttggcgtctttctcctatggaagaactggcgacttaagaacataaactcgatcaactttgacaatcctgtttatcaaaaaactaccgaagatgaagtgcatatctgccataatcaggacggttacagctatccgtctcgtcaaatggtttctctagaagatgatgttgcg

SEQ ID NO: 363 - DNA, 2580 bp, Artificial Sequence
  Description of Artificial Sequence: Synthetic Transcript Sequence
atgggaccttggggctggaagctgcgctggactgtcgcccttctgctcgccgccgctggcacagccgttggtgaccgctgcgagaggaatgagtttcaatgtcaggatggaaaatgtattagttacaagtgggtgtgtgatggtagcgccgagtgccaggatggttcagatgagtctcaagaaacttgcttgtcagtcacgtgcaaaagtggcgacttttcttgtggaggcagggttaaccgctgtattccccaattctggaggtgcgacggccaggtcgattgcgataacggttctgacgagcaaggttgtcctcccaaaacgtgctctcaggatgaattcaggtgccacgacggtaagtgcatatcaaggcagtttgtgtgtgatagcgaccgcgattgcctggatggatccgatgaagcaagctgccctgtccttacctgcggtcccgcgtccttccagtgtaactcctccacctgcatcccacagctgtgggcttgcgataacgatcccgactgcgaagatggttcagatgaatggccccagagatgccgcggtctctacgtcttccagggcgactccagcccatgtagcgctttcgaattccattgcttgtccggtgagtgtatccattcaagttggaggtgtgacggaggtcccgactgtaaggacaagtcagacgaagaaaactgcgcggtggccacttgccgccctgacgaattccagtgcagtgatggaaactgtatccatggcagcaggcagtgtgatagggaatacgattgtaaagacatgagtgatgaggtgggatgcgtaaacgtgaccttgtgcgagggtcctaacaagtttaaatgtcactccggagagtgtatcacgctcgacaaggtgtgtaatatggccagggactgtcgcgattggagcgacgagcccatcaaagagtgtggcacgaacgagtgccttgacaacaacggcggctgctcacacgtctgcaatgatctcaagattggttacgaatgcgactgcccagacggatttcagctggttgcccagaggcgctgcgaggatatcgatgagtgccaggacccggacacctgctcccaactgtgcgtgaacctggagggaggctataagtgccagtgtgaagagggcttccagttggatccgcataccaaagcatgcaaggctgttggttctatcgcatacttgttttttaccaacagacatgaggtccgcaaaatgactctggacaggagcgagtacaccagcctgatccccaacctccgcaacgtggtggctttggacaccgaagtagcctctaaccgcatatattggtccgacttgagccagaggatgatctgctcaacacagctggacagggcacacggcgtgtctagttacgatacagtgatttctagggatatacaggcgcccgatggtcttgcggtcgactggatccacagtaatatttactggacagactctgtcttgggcactgtcagtgtggccgacacaaaaggagtcaaaaggaagacgttgtttagggagaacggatccaagcctagagccatagttgtggatcctgtgcacggcttcatgtactggaccgactggggcacccctgctaagattaaaaaaggtggacttaacggtgttgatatctattccctggtgactgaaaatatccagtggcccaatggtattaccctcgacttgctctcaggtcgcctctactgggtggattctaagctgcattccatttcaagcatcgatgtgaacggcggaaacagaaagaccatcctcgaggatgagaagcgcctggctcacccttttagcctggcagtcttcgaggacaaggtcttctggactgacattatcaatgaggctatcttctcagcaaacaggttgacaggttctgacgtgaacctgctcgcggaaaatttgctgagcccagaggacatggttcttttccacaacctgacgcagcctcgcggcgtaaattggtgtgagaggacaacactgtctaacggaggttgccaatacctgtgcttgccggcacctcagattaatccccattcacccaaatttacgtgcgcctgcccggacggtatgttgctcgctagagacatgcgctcctgcctcactgaggcagaggccgcagtagcaactcaagagacctctactgtgagactcaaggtatcctctaccgctgtcagaacgcagcacactacaactagaccagtgccggacacctcaaggctgcccggcgcaactccaggcttgacaacggtcgagattgttacaatgtcccaccaggccctgggagatgtggcgggaaggggcaatgaaaagaagccttctagtgtccgcgcgctcagcatcgtgctgccaatagtactgttggtgttcctgtgtctgggtgtgtttttgctgtggaagaactggcgcctcaaaaacattaattcaatcaattttgataatccagtgtatcaaaaaactactgaagacgaggtgcatatatgtcataatcaggacggatatagttacccctcccgccagatggtgagcctcgaagatgatgtcgcc

SEQ ID NO: 364 - DNA, 2580 bp, Artificial Sequence
  Description of Artificial Sequence: Synthetic Transcript Sequence
atgggaccttgggggtggaaactgagatggactgtggccttgctgctggcagcggcgggcactgctgtgggagacagatgcgagagaaacgagttccagtgccaggatggaaagtgcatctcatacaagtgggtctgcgacggctcagcagaatgtcaggacgggagcgacgaatcacaggagacttgtctgtctgtcacctgcaagtcaggcgatttctcatgcggcggacgagtcaacaggtgcatcccgcagttttggcgctgtgacgggcaggtggattgcgacaacggatcagatgaacaggggtgccccccaaagacgtgctcgcaagacgagttccggtgtcatgacggtaaatgtatttcccgtcagttcgtgtgcgactcggaccgcgactgcctggacggatctgacgaagcgtcgtgtccggtgctcacttgtggaccggcctcattccagtgcaatagctccacgtgcattccccagctgtgggcctgcgataacgacccggactgcgaggacgggtcagacgaatggccacagagatgtagaggactgtacgtctttcaaggcgattcgagcccgtgcagcgcctttgagttccactgcctgtccggagagtgcatccactcatcgtggaggtgtgacggtggacctgattgcaaggataaatcagacgaagaaaattgcgcggtggcaacgtgccgaccggatgagtttcaatgcagtgacggaaactgcattcacggctctcgtcaatgcgatcgggagtatgactgcaaagacatgtccgatgaagtcggctgcgtcaacgtgaccctgtgcgagggtcctaacaaattcaagtgccattcaggagaatgtatcactctggacaaggtgtgcaacatggccagagactgtcgcgactggtcggatgaaccaattaaggagtgtggcaccaacgaatgcctcgacaataatggcggatgttcgcacgtgtgcaatgatctcaaaatcggctacgagtgtgattgcccagatggctttcagcttgtggcacaacgccggtgcgaggacatcgatgaatgtcaggatccagacacttgctcccagctctgcgtcaatttggagggaggatacaaatgtcagtgcgaagaaggattccagctggacccgcacactaaagcatgtaaagcagtgggctccatcgcttacctgttcttcaccaaccggcatgaagtgagaaagatgactttggacaggagcgagtacacctcgcttatccctaatctcagaaacgtggttgcactggacaccgaagtcgccagcaatcgcatctactggtcggatctgtcccaacgcatgatttgctcgacccagctggaccgcgcgcacggagtgtcctcatacgacaccgttatctcccgggatatccaggcgcctgacgggctggcggtggattggatccactccaacatctactggaccgactccgtgctgggaaccgtctcggtggctgatactaaaggagtgaagagaaagaccctgttcagagaaaacggatcgaagccccgcgccatcgtggtggacccggttcacggatttatgtactggacggattggggcactcctgccaagatcaaaaagggtgggttgaatggagtggacatctactcactggtgaccgaaaacatccagtggcctaacgggatcacccttgacctcctttcgggtcgtctttactgggtggattctaagctccactcgatctcctccatcgacgtgaacggcggtaaccgcaagactattttggaggacgaaaaaaggcttgcgcatccgttctcccttgccgtctttgaggacaaggtgttctggacggacattatcaatgaggccatcttctcggcgaatcgcctcaccggttcggatgtgaaccttctcgctgaaaacctgctgagcccagaggacatggtgctgttccacaacctcacgcagccacgcggagtgaattggtgcgaaaggaccactctgtcgaacggggggtgccagtacctgtgcctgccggccccccagatcaatccacattcgcctaagtttacttgcgcctgcccagacgggatgctcctcgccagagacatgcggtcctgtctgaccgaagctgaagccgctgtggctacccaagaaacgtctaccgtgcgcctcaaggtgtcgagcaccgctgtgagaacccaacacaccaccacccgcccggtgcccgacaccagcaggctccccggagctactccggggctgactactgttgaaattgtgactatgagccaccaggccttgggcgatgttgccggaagaggcaacgaaaagaaaccttcctctgtgcgggccctctcgatcgtgctgcctatcgtgctccttgtgttcctgtgtctgggggtgttcctgctctggaagaattggaggctgaagaacatcaattcgatcaattttgacaaccctgtctaccagaaaaccaccgaggacgaggtgcacatctgtcacaaccaagatggctactcttacccgtcccgccaaatggtgtcgctggaggacgacgtcgcc

SEQ ID NO: 365 - DNA, 2580 bp, Artificial Sequence
  Description of Artificial Sequence: Synthetic Transcript Sequence
atgggtccatggggttggaagctccgatggactgtcgcacttctgctggccgcagctggtactgcagtaggagatcggtgtgagagaaatgaattccagtgccaggatgggaagtgtattagctataagtgggtctgtgacggatcggcagaatgccaggatggcagcgacgagtctcaggaaacctgtctgagtgtcacgtgcaagtctggtgacttcagctgtggaggtcgcgtgaaccgctgcatccctcagttttggcggtgtgacggccaagtagattgtgacaacggatccgacgagcaaggatgcccgcccaagacctgctcgcaagatgagtttcggtgtcatgacggaaagtgcatctcccgtcagttcgtgtgtgatagcgacagggattgtctggacggctccgatgaggcttcctgtccagtgctcacatgcggcccagcctcattccagtgtaacagcagcacttgtataccccaactgtgggcttgcgacaacgaccctgattgcgaggacggctcggatgagtggccgcaacgatgccgcgggctgtacgtctttcagggcgactcatccccatgttctgcgttcgagttccactgccttagtggggaatgcattcactcaagctggaggtgtgacggcggccccgattgcaaggataaaagtgacgaggagaattgcgctgtggcaacttgccgacccgacgaattccagtgcagcgacgggaattgcatacatggatcacgccagtgtgaccgtgaatatgattgcaaagacatgtccgatgaggtgggctgtgtcaacgtgacgctctgtgaggggccaaataaattcaagtgtcactctggagagtgcatcactttggataaggtctgcaatatggctagggactgcagagactggtccgatgaacctatcaaagagtgcgggacgaacgagtgcctggacaacaacggagggtgtagccatgtgtgtaacgatctgaagattggttatgagtgtgactgcccagacggatttcagttagtcgcacagaggaggtgcgaggacattgacgagtgtcaggatcccgatacctgtagtcagctgtgcgtgaacctggagggtgggtacaagtgccagtgtgaagaaggctttcaacttgatcctcataccaaagcctgcaaggctgtaggtagtatcgcataccttttctttaccaaccgccacgaggttaggaagatgaccctggatcgaagtgagtacacatcccttattccaaacctacggaatgtggtggctcttgacactgaagtcgcgagtaaccgcatctactggtctgacctgtctcagcgcatgatatgctcgacccagttagaccgggctcacggggtatcatcctacgacaccgtcatctctcgggacattcaggcccctgacggtctcgctgtggattggatccactccaatatctattggacagattcagtgctcggaactgtatctgtggccgacactaagggtgtgaagcgtaagacactgttccgagagaacggatccaagccacgagctattgtggtcgatcccgtccacggcttcatgtactggaccgactggggtaccccggcgaaaattaaaaagggggggcttaacggtgtggacatctactccctcgtcaccgagaacatccaatggcccaacggcatcacccttgacctgctgagtggccggctatactgggtggattctaagctacactctatttcctccatagatgtgaatggaggaaaccggaagacaatccttgaggatgaaaagcggctggcgcacccatttagtctggcagttttcgaggacaaggtgttttggactgacattattaacgaggccatttttagcgcaaacaggctgaccggaagtgacgtgaacctcctggcagagaatctgctgagtccagaggacatggtacttttccataatcttacccagcctaggggggttaattggtgcgagcggaccacccttagcaacggcgggtgccagtatctctgcctaccagccccgcagatcaacccccatagtcctaaatttacttgtgcctgccccgacggcatgctactcgcgagggatatgcggagctgcctgactgaagcggaagctgcagtagctacacaggagacctcaaccgtacgactgaaagtgagttcaacggctgtgcggacacagcacactactacgcgccctgtgcctgacacatctcgccttccaggggccactcccggcctgaccaccgttgagattgtgacaatgtctcatcaggcattgggggatgtggctggaagggggaacgaaaagaaaccctcaagcgtgagagccctgtccatcgtcctgcctatcgtcctcctggtgttcctttgtttgggcgtcttcctactatggaagaactggcgcttgaagaatataaactcaattaatttcgacaatcctgtgtaccaaaagactacggaggacgaggtccatatttgccacaatcaggatggctatagctacccttcacgtcaaatggtgtccctggaggacgacgtggct

SEQ ID NO: 366 - DNA, 2580 bp, Artificial Sequence
  Description of Artificial Sequence: Synthetic Transcript Sequence
atgggcccgtggggctggaagttgcggtggaccgtggcactgctactggctgcggccgggactgcagttggggacagatgtgagcgcaatgagttccagtgtcaagacggaaaatgcatatcttataagtgggtgtgtgacgggagcgccgagtgtcaggatggctcagacgagagtcaggagacatgtctctcagtaacatgcaagagcggggacttcagctgcgggggtagagtgaaccgttgtatcccacagttttggcgctgtgacggacaggtggattgcgataatggcagtgatgagcagggctgtccgcccaaaacttgtagtcaagacgagttccgttgtcacgacggtaaatgcatctccaggcagtttgtttgcgacagcgatcgcgactgcctcgacggctcagacgaggcctcttgtcccgtgctcacgtgtggtccagctagctttcagtgtaacagttcaacctgcatcccacaactttgggcttgcgataacgaccctgattgtgaggacgggtccgacgaatggccccagagatgccgcggactgtacgtgttccagggcgacagctctccttgttcagcctttgagtttcattgcctgtctggcgagtgtatacactcctcatggaggtgcgatggggggccggattgcaaagacaaatcagatgaggagaattgcgccgtcgccacatgccggcccgacgagtttcaatgttctgatggcaactgcatccacggctccagacagtgtgatcgggagtacgactgtaaggacatgagtgacgaggtgggctgtgtgaacgtaaccctgtgtgagggcccaaacaaatttaagtgccactctggcgagtgcatcacccttgacaaagtgtgcaatatggcacgagactgtcgggattggtcagacgagcctattaaggaatgtgggaccaacgagtgcctagacaacaatgggggttgttctcacgtgtgcaatgatctgaagattggctacgagtgcgattgccccgatggatttcagctggtggctcagcgcaggtgcgaagatatcgatgagtgtcaggaccctgatacctgctctcagctgtgcgtaaatcttgaaggagggtacaaatgccagtgtgaggagggtttccagttagacccacacaccaaagcttgcaaagcagtaggctccatcgcatacctgttcttcactaatcggcatgaggtgcgcaaaatgactctcgataggtcagaatatacgtccctcataccgaatttaagaaacgttgtggcactggacaccgaagtagcaagtaatcgaatctactggagcgacctctcacagcgaatgatctgttctacacagctcgatcgcgcacatggcgtttcctcatacgatacagtgatcagtagggacatccaagcacccgatgggctggcagtggattggattcactctaatatttactggacggactccgtcctagggacagtgtccgtcgctgacacaaaaggagtgaaacgaaagacactgtttcgagagaacggatccaagccacgggccatcgtggtggatcctgttcacggattcatgtactggaccgactggggaacacccgccaaaatcaaaaaaggaggattaaacggcgtcgacatctactcccttgtcactgagaatatccagtggccgaacggtataacattggacctgctttcaggtagactgtactgggtagatagcaagctccattccatcagctcgattgacgtaaatgggggaaacaggaagaccattcttgaagacgagaagcgactcgcacaccccttttctctggcagtgttcgaagacaaagtgttttggaccgacataatcaacgaggccattttttctgcgaacagactgaccggaagtgatgtaaaccttctggcagagaacttgctgtcgccagaagacatggtcctctttcacaacctgactcaaccccggggtgtaaactggtgcgagaggacaaccttgtcaaatgggggatgtcagtacctctgcctacccgccccgcagatcaacccacattcaccaaagttcacctgcgcttgtccagatgggatgctgctggctagggatatgaggagttgtctgacggaggccgaagctgccgtcgccacgcaggaaactagtaccgttagactgaaagtcagtagcaccgccgtgcggacccaacacaccactacaagacctgtcccggacacttccagactccccggagcaacacctggcctgacaacagtggagatagtcacaatgagtcaccaggccctcggagacgtggccggacggggtaatgaaaaaaagccttctagtgtgcgcgcccttagtattgtgttgccgatcgttcttctagtgttcctgtgcttaggggtcttcctactgtggaagaactggaggcttaaaaatatcaactctattaatttcgataacccggtttatcaaaaaaccacagaagatgaggtgcacatctgccataaccaggatggctacagctaccctagtcggcagatggtcagtttggaggacgatgttgcg

SEQ ID NO: 367 - DNA, 2580 bp, Artificial Sequence
  Description of Artificial Sequence: Synthetic Transcript Sequence
atgggcccctgggggtggaaactacgctggacagtggcgctgttgctggctgcagcaggaaccgccgtcggagacaggtgtgagaggaacgagtttcagtgccaggatggtaaatgtatttcatataagtgggtgtgcgatggctcggccgaatgccaggacggctcagacgagagtcaggagacatgcctctccgtgacatgtaaatcgggtgattttagttgcggaggtcgcgtgaacagatgcattccccagttttggcggtgtgacggccaagtggactgtgacaacggatctgacgagcaggggtgtccccccaagacctgttcccaagacgaattcaggtgccacgacggaaagtgcattagtagacagttcgtgtgtgactccgatagagattgcctggacggatccgatgaagcctcatgccccgtattaacctgtgggccagctagtttccaatgcaacagctctacttgcattccccagctgtgggcctgtgacaacgatcccgactgtgaagacggtagcgacgagtggcctcagcggtgcagaggcctgtatgtgtttcagggcgactcgtccccctgcagcgcttttgaatttcactgcctgtctggggagtgcatccatagctcctggagatgcgatggcggcccagactgcaaggacaagtccgatgaggagaattgtgccgtggcgacctgccgaccagacgagtttcagtgctcagatggaaattgtatccacggctcaaggcaatgtgatcgggaatatgattgcaaggatatgtccgatgaagtaggatgcgttaacgtcacattgtgtgaaggcccaaacaagttcaaatgtcattcaggcgaatgtattacactggataaagtgtgtaatatggcacgcgactgcagagactggagcgacgaacctattaaggagtgcgggactaatgagtgtctcgataacaacggcggatgcagccacgtgtgcaatgacctgaagattggatatgaatgtgactgtcccgacggttttcagcttgttgcacaaaggcgatgcgaggacatcgacgaatgccaggacccagacacgtgttcccagctttgtgtgaaccttgaaggaggttataaatgtcagtgcgaggaaggctttcagctggatcctcataccaaagcgtgcaaagcagtgggcagcattgcctatttattctttaccaacagacacgaagtgcgcaagatgacactcgatcgctccgagtacacgagcctgattcccaacctgcgcaacgtcgttgccctggatactgaagtggctagcaaccgtatatattggtctgacctctctcagaggatgatatgttctacacagctggatagggctcacggggtgtccagctacgacacggtcatctcacgcgacatccaggcccccgacggtctggccgtggactggatacactccaacatatattggacagattctgtgctgggcacagtctccgtggccgatacaaagggcgtgaagagaaaaactctgttcagagagaacggttcaaagccacgtgcaatcgttgtggaccccgtgcacgggttcatgtactggactgattggggaacgcctgcaaagataaaaaaggggggcctcaatggtgttgacatatattcccttgtgaccgagaatattcagtggccaaatgggatcaccctggatcttctgtctggacggctctattgggttgatagcaagctccattcaatcagctctatcgacgtcaacggaggtaatcgcaaaaccattctggaagatgaaaagcgcctggcccacccatttagtctggccgtttttgaagataaagtgttttggaccgatatcatcaatgaggccattttcagtgcgaataggctgacgggcagtgatgtaaacctgctagcagagaacctgctgagtcccgaggatatggtgcttttccacaatcttacgcagcctagaggggtgaattggtgtgaacgtaccaccctatccaacgggggttgccagtacctttgcctacccgctccccagatcaacccacactcgcccaaattcacctgtgcctgtcctgatggaatgttattggctcgcgacatgaggagttgtcttacagaagcagaagctgccgtggccacccaggagacttcgacagtaaggctgaaggtttccagtacagcagtgcgaactcagcatactactacccgtcccgtgcccgacacctcccggcttcctggggcgacgccaggcctgacaactgtcgagatagtaacaatgtcgcaccaagccctgggagatgtggctgggcgcgggaatgagaagaagccctcatctgtgcgtgccttgagtatcgttttgccgattgtgctgctggtcttcctgtgtttgggagtatttctcctttggaagaactggagactaaagaatatcaatagcatcaacttcgacaacccagtctatcagaaaaccactgaagacgaagtgcatatttgtcataatcaggatggctactcttatccctcccgacagatggtctccttggaggacgatgttgct

SEQ ID NO: 368 - DNA, 2580 bp, Artificial Sequence
  Description of Artificial Sequence: Synthetic Transcript Sequence
atgggcccctggggctggaaattgcggtggaccgtggcgctcctactcgcagcagcaggaacggccgtcggtgatcgatgcgagcgcaatgagttccagtgccaagacggaaaatgtataagctacaagtgggtgtgtgacggctccgctgagtgtcaagacggcagtgatgaaagtcaggagacatgtctcagtgtgacttgcaagtccggcgatttcagttgcggcggccgggttaaccggtgcataccccagttttggcgttgcgacggccaagtcgactgtgacaacggttcagatgaacagggatgcccgccaaaaacgtgctctcaagatgagtttcgatgtcacgatgggaagtgcatcagccggcagttcgtatgtgattcagaccgagattgcttggacggatcagatgaggcctcttgtcctgtgctcacttgtggtcccgcctcatttcagtgtaattcttcaacctgtattccccagctctgggcctgcgataatgatccagattgcgaagacggatcagacgaatggccacagagatgccgtggactttacgtgttccagggcgattcgtccccctgcagcgcttttgagttccactgcctgagcggggagtgtatccacagttcctggagatgcgacggcggaccagactgcaaagataagagcgatgaggagaactgcgctgtggccacatgtaggccagatgagttccagtgctctgacggcaattgcattcacgggagtcggcagtgtgacagggagtacgactgtaaagacatgagcgatgaggtcggttgtgttaacgtcactctctgtgaaggcccaaacaaattcaaatgtcactccggggagtgtataactctggacaaggtttgcaatatggcccgggactgtcgcgactggtcagacgaacccatcaaagagtgcggaacaaacgagtgtcttgacaataacggaggttgtagccacgtctgtaacgatcttaaaattgggtacgaatgcgactgccctgacggcttccagctcgtggctcagcgaaggtgcgaagacattgacgaatgccaggacccggatacatgctcccagttgtgtgtgaatctggaggggggttataagtgtcaatgcgaagaaggattccagctggatccgcatactaaggcctgtaaagctgttggttctatagcttacctgttttttacaaaccgtcacgaggtgaggaagatgacactagaccgcagcgagtacactagccttattcctaacctccgtaatgtggtggccctggacacagaagttgcgagcaataggatttactggagcgacttgtctcagcgaatgatttgttctacccagttagaccgcgcacacggcgtttctagctacgacaccgtcatcagtcgcgacattcaggcccccgacggactggccgtcgattggatccatagcaacatctattggactgacagcgttcttggcacagttagcgttgcagacacaaaaggagtgaagaggaagaccctctttcgcgagaacgggtccaaacctcgcgccatagtggtcgaccctgtgcatggattcatgtactggacagactggggcacacctgctaagatcaaaaagggtggactcaacggcgtcgatatttactctttggtgactgaaaatatccaatggcccaatggtatcacactggacctactgagcggacgcctctattgggtagatagtaaactgcattccatcagcagcatagacgtcaatggaggcaacaggaagacaatccttgaagacgagaaaagactggctcacccgttttctctggcggttttcgaagacaaggttttctggacagatattattaacgaagccatattctcagctaataggctgactggttctgatgtgaatctcttggccgaaaatctcctctcgcctgaggacatggtcctcttccataacctgacccagcccagaggcgtcaactggtgcgagcgcaccactctcagtaatggagggtgccagtatctttgtctgcctgcgccgcaaattaaccctcatagccctaaattcacatgtgcgtgtccagacggcatgctgctcgccagggatatgcgtagctgcttgacagaagcggaagcagccgtggccacccaggagacctcaacagtgcgactgaaagtctcatcgactgcggtccgtacgcagcatactactacaagaccagtgcctgacacatcccggctgcctggggcgactcctggactgacaacagtcgaaatcgtcaccatgtcacaccaggcattgggcgatgtcgccggccgtggaaacgaaaaaaaaccatcaagcgttcgtgcactgagcattgtgctccccatcgttctcctagttttcctgtgtctgggtgttttccttctttggaagaattggagactaaagaacatcaacagtattaacttcgataaccccgtgtaccagaaaaccactgaggatgaggtgcatatttgccacaaccaggacggctatagctacccatcacggcagatggtatcactggaagacgacgtcgcg

SEQ ID NO: 369 - DNA, 2580 bp, Artificial Sequence
  Description of Artificial Sequence: Synthetic Transcript Sequence
atgggaccttggggctggaaactccgctggaccgtggcactcctcctcgcggcagcaggaactgcagtgggagatcgttgtgaaaggaacgaattccagtgccaggacggtaaatgtatttcgtacaagtgggtctgtgacggatcagccgaatgccaggacggctccgacgaatcacaagaaacttgtctgtcggtcacttgtaagtcgggtgatttctcatgcggtggacgcgtgaatagatgtattcctcaattctggaggtgcgatggccaagttgattgtgataacggatcggatgaacagggttgcccaccaaaaacgtgttcccaggatgaattccgttgtcatgatggtaaatgcattagccgacaatttgtgtgtgacagcgacagggattgccttgacggatccgacgaagcaagctgtcctgtgcttacctgcggccccgcctcgttccaatgtaatagctccacttgtattccgcagctttgggcatgtgataatgatccggattgcgaggacggatccgatgaatggccacaaagatgtcgcggcctttacgtctttcagggcgattcgtccccgtgctccgcattcgagtttcattgtttgtcgggggaatgtatccattcctcgtggcgttgtgatggtggtccagattgtaaagataaatccgacgaagaaaattgcgcggtggctacttgtaggcccgatgaatttcagtgtagcgatggtaactgcatccatggcagcagacagtgtgatcgggaatacgattgtaaggatatgtccgatgaagtggggtgtgtgaacgtcacgctttgtgaaggaccaaataagtttaagtgtcattctggtgagtgtatcactctcgacaaggtgtgcaatatggcacgagattgtcgggattggtcagacgaacctattaaggaatgcggtaccaacgagtgtctggacaataatgggggatgtagccacgtgtgtaacgacctcaaaattggatacgaatgtgattgccccgacggttttcaactggtcgcacaacggagatgtgaggatattgacgaatgtcaagatcctgacacgtgttcgcaactgtgtgtgaatctcgaaggtggctacaagtgccaatgtgaagagggctttcagctggaccctcatactaaagcgtgtaaggccgttggatcaattgcttaccttttctttactaataggcatgaagtcagaaagatgacgctggaccgctcggaatataccagccttattccaaaccttcggaacgtggtcgctcttgatactgaggtggcctcgaatcgaatttactggtcagacctgtcccaacgaatgatctgtagcacccagcttgatcgcgcacatggtgtgtcgagctacgatactgtgatttcccgcgatattcaggcgccggatggtcttgccgtcgattggattcactccaatatctactggaccgattcagtgcttggaaccgtgtcggtcgcagatactaagggagtgaaaagaaagactctctttagggaaaacggaagcaaacctcgtgcaattgtggtggatcctgtccacggttttatgtactggactgactggggaactcctgcgaagattaagaaaggaggactgaacggtgtcgacatttacagcctcgtgaccgagaatatccaatggcctaatggcatcaccttggatcttctttccggccgactttactgggtggactctaaattgcactcgatctcatcgatcgacgtcaacggaggcaacagaaagactattctcgaggatgaaaagagacttgcacatcctttttcccttgcagtctttgaagataaggtcttttggactgatatcataaacgaggcaattttctcggcaaacagactgactggatccgacgtcaaccttcttgcggaaaatctgctctcaccagaagatatggtgctgtttcataacctcacgcaacccagaggagtgaattggtgtgaacgcacgaccctttcgaacgggggatgtcaatacctttgccttccagcacctcagatcaacccacattccccaaagttcacctgtgcatgtcccgacggcatgctgctggcacgcgatatgcgttcctgcctgaccgaagcagaggccgccgtcgctacccaagaaacctcgacggtgcgacttaaggtgtcgtcgaccgcagtgaggactcaacatactactacgcggcctgtgcccgacactagccggcttccaggagcaacccccggcctcaccactgtggagattgtcaccatgtcccaccaggctcttggagacgtggcaggtcgtggaaacgagaaaaaaccttccagcgtccgagctctgtcgatcgtactgcctatcgtgctgctcgtgtttctgtgccttggggtgttccttctttggaagaattggagactcaagaatatcaactcgattaactttgataatcctgtctaccaaaaaactaccgaagatgaagtccacatctgtcacaaccaggacggttacagctacccatcccgccagatggtatcgctcgaggacgatgtggca

SEQ ID NO: 370 - DNA, 2580 bp, Artificial Sequence
  Description of Artificial Sequence: Synthetic Transcript Sequence
atgggaccttggggatggaaattgcgatggaccgtcgcactccttcttgcggcagcgggtaccgcggtgggagatcgctgtgaacggaacgaatttcagtgccaggatggcaaatgtatctcctacaagtgggtgtgcgacggtagcgcagaatgtcaagatggatccgatgaaagccaggaaacgtgcctgtcggtgacctgtaagtccggtgacttttcctgtggtggtagagtgaataggtgcatacctcaattctggcggtgtgacggccaagtcgattgtgataacggatcggatgagcagggatgcccacctaaaacttgttcgcaagatgagtttaggtgtcatgatggtaagtgtatttcgagacagtttgtgtgtgactcggaccgggactgtcttgacggaagcgatgaagctagctgtccagtgctgacttgtggtcccgcaagttttcaatgtaatagctcaacttgcatccctcaactttgggcctgtgacaacgacccagattgtgaagatggctcggacgagtggccgcaacgttgccgtggactttacgtgttccagggggattcgtcgccatgctcggccttcgagttccattgcctgagcggggagtgtattcactcgtcgtggcggtgcgacgggggccccgattgcaaggacaagtcggatgaagagaactgcgccgtcgccacttgtcgcccagacgagttccaatgttcagatggaaactgtatacacggatctcgacagtgtgatcgggaatacgattgtaaggatatgtccgatgaagtcggttgtgtgaatgtgactctctgtgaaggtcctaacaagttcaagtgtcattcaggagaatgtatcacccttgataaggtgtgtaacatggcccgagactgtagagattggtcggacgaaccaattaaggagtgtgggactaatgaatgccttgacaataatggcgggtgttcccacgtgtgcaacgacctgaagattggatacgaatgcgattgtcctgatggttttcaactcgtggcccaaagaaggtgtgaagatattgatgagtgtcaggacccggacacttgttcccagctttgcgtgaacctggaaggggggtacaagtgccagtgcgaagagggatttcagcttgacccacatactaaggcatgcaaggcagtgggatcgatcgcgtacctgttcttcaccaatcgccatgaagtccgaaagatgacgctcgatcgttccgaatacaccagccttataccaaatcttagaaacgtcgtggcgttggataccgaagtggcctctaaccgcatttactggtcggatttgtcacagcggatgatctgttcgactcaactggatagagcacatggggtcagttcgtacgatactgtcatctcccgagatatccaagcacccgatggattggcagtggattggattcattcaaacatttactggacggatagcgtgcttgggactgtttcggtcgcagatactaaaggagtgaagcgaaaaacgcttttccgcgagaacgggtcgaaaccccgcgctattgtggtggaccccgtgcatggttttatgtactggaccgattggggtactccagcgaagatcaaaaagggaggactcaacggtgtggacatatacagcctggtcactgagaatattcaatggcctaatgggatcactcttgatcttcttagcggcaggctgtactgggtggattccaaactgcattccatctcatcaatcgatgtcaacggcggcaatcgaaagacgatcctcgaggacgagaagagactggcacatccattttcgcttgcggtctttgaagataaggtcttttggaccgacataatcaatgaagctattttcagtgcaaatagacttactggctccgacgtgaatctgctggcagaaaatcttctctcgcccgaggacatggtgctttttcacaaccttacccaacctagaggagtgaactggtgtgaaagaaccaccctgtcaaatggaggatgtcagtacctctgtctgcccgcaccacagattaatcctcattcacccaagtttacctgtgcgtgccccgatggcatgctcctggctcgggacatgcgttcctgcttgactgaagctgaagcagcggtcgccacccaagaaaccagcaccgtgagacttaaagtctccagcaccgcagtgagaacccaacacaccactaccaggccagtccccgacacttcccgcctcccaggcgcgacgcccggtcttactaccgtggaaatcgtgaccatgtcgcatcaagccctgggtgacgtggccggtagggggaatgaaaagaagccatcctctgtgcgtgccttgtcaattgtgctgccaattgtgcttctggtgtttctctgtcttggagtgtttcttctgtggaagaactggagactgaagaatatcaattcgatcaacttcgataaccctgtttaccagaaaactaccgaggatgaagtccacatttgccataatcaagatggctactcctacccatcaaggcaaatggtgtcacttgaagatgatgtggcg

SEQ ID NO: 371 - DNA, 2580 bp, Artificial Sequence
  Description of Artificial Sequence: Synthetic Transcript Sequence
atgggtccttggggctggaaactgcgttggacggtggcactgctccttgccgcggcaggtaccgccgtcggggatcgttgtgagcgaaacgaattccagtgtcaggacggaaaatgcatttcgtataaatgggtgtgcgacggttctgccgagtgtcaggacggttcagatgagagtcaggagacctgtttgtcagtgacttgcaagagtggggatttttcctgtggggggcgtgtgaatagatgtataccccagttttggagatgcgatggtcaagtggattgtgataatgggagtgatgagcaaggatgccctcccaaaacctgctctcaggacgagttcaggtgccacgatggtaagtgcatatccagacaattcgtgtgcgacagcgaccgggactgtctggacgggagtgatgaggcctcttgcccagttctcacctgtggcccagccagctttcagtgcaatagcagtacttgcatcccccagctctgggcttgcgacaatgatcccgactgtgaggacggatctgatgagtggccacagcgttgcagagggctgtatgtgttccaaggagatagtagtccgtgttctgcttttgagtttcactgcctgagtggcgagtgcatccattcctcatggcgttgcgatggggggcctgattgcaaggacaagtccgacgaagaaaattgtgccgtggccacctgccgaccagacgaatttcaatgctccgacggcaattgtatccatgggagccgacagtgtgatcgagagtacgactgtaaggacatgtccgatgaggttggctgtgtgaatgtgacgttatgcgagggccccaataaattcaaatgccacagcggagaatgcatcaccctggataaggtctgtaacatggcccgagattgccgagactggtctgatgagccaataaaggagtgcggcactgcagaatgtctagataacaacggtggctgttcccatgtgtgcaacgacctgaagatcgggtatgaatgtctttgcccagatggttttcagttggttgcccagagaaggtgtgaagacattgacgaatgtcaggatcccgacacctgttctcagttgtgtgttaatctggagggtggatataaatgtcagtgtgaggaaggtttccagctggatccgcataccaaagcttgcaaagcagtaggtagcatagcctacctgtttttcactaatcgacatgaagtacgaaaaatgaccctcgatcggtcggaatacacctccttgatacctaaccttaggaatgtcgtcgcccttgacaccgaggtggcctcaaatcgaatctattggagcgacttgtcacaaagaatgatttgcagcacacagcttgaccgggctcacggtgtaagctcgtacgatacagtcatatcacgcgacattcaggcgccggacgggctggcagtggattggattcactccaacatctactggacggacagtgtgctgggaaccgtgagcgtggccgataccaagggcgtaaagcgaaagactctgttcagggaaaacggatcaaagcctagagccatagtcgtagacccagtccatgggttcatgtactggacagattggggcacccctgcaaagatcaagaagggggggctgaatggggtggacatctactctctggtaactgaaaatatccaatggccgaacggaatcactttagacctgctctctggccgactctactgggttgattctaagcttcattctattagctccattgacgtcaatggcggtaacaggaaaaccatactcgaggatgagaaaagactggctcatcctttctccctggctgtctttgaagataaggtcttctggactgacataataaacgaagccatcttttccgcaaatcggttgaccggatctgacgtgaacttgcttgcagagaatctgctctccccagaagacatggttctattccacaaccttacgcagcctagaggggtcaattggtgcgaaagaactactctctctaacggcgggtgtcagtacctgtgcctgcccgcccctcaaatcaatccccatagccctaagtttacatgcgcatgccccgatggcatgctgctggccagagacatgcgatcttgtcttacagaggcagaggccgcggtcgccacccaagaaacctcgactgtcagactaaaggtgtcgagcaccgcagtgcgaactcagcacacaacaacccgccccgtgcccgatacgagtcgactgcctggagccacccctggtctgacaaccgtggaaatcgtgaccatgtcacatcaggccctcggcgacgttgccgggcgtggtaacgagaagaagccaagctccgtgcgagccctttctatcgtcctgcctattgtgttgctggtgtttctctgcctcggagtgtttctgctgtggaagaactggagactcaaaaatatcaattccattaatttcgacaatcctgtctatcagaaaaccaccgaagatgaagtgcacatttgccacaatcaagatgggtatagctatccttcacgacagatggtcagtttggaggacgatgtagcc

SEQ ID NO: 372 - DNA, 2580 bp, Artificial Sequence
  Description of Artificial Sequence: Synthetic Transcript Sequence
atgggtccttggggctggaagcttcgctggacagttgcactgctcctggcggcagcaggtactgcagtcggtgacaggtgtgaacgcaatgagttccagtgccaggacggaaagtgcatcagttataagtgggtctgtgacggttccgcagaatgccaggacggtagtgacgaaagtcaggagacatgcttgagtgtcacctgtaagagcggcgatttctcatgtggcggtagggtcaacaggtgcatcccacaattctggagatgtgacggccaggtcgactgcgataacggctcagatgagcaaggatgcccccccaagacttgctcccaagatgagtttcgctgccacgatggcaagtgcatttccaggcaatttgtgtgtgattctgatcgcgactgcctcgacggaagtgacgaagcatcctgtcctgtgctgacatgtggccctgccagctttcagtgcaattcttctacatgtattccccaattgtgggcatgtgataacgaccctgactgcgaggatggcagtgatgaatggccacagagatgtaggggtctgtatgtattccagggagatagctccccctgttcagcgtttgagtttcactgcttgtctggtgaatgcatccacagttcctggagatgcgacggtggacccgactgtaaagacaaaagtgacgaggaaaattgcgcagttgctacatgtagacctgacgaatttcagtgttcagacggaaactgtatccacggtagtaggcaatgtgaccgcgaatacgactgcaaagacatgtccgatgaggtcggctgcgttaacgtgaccctgtgtgagggtccaaacaagttcaagtgccactcaggcgagtgcatcactctggataaggtctgtaatatggcaagggactgtagggactggtccgacgagccgatcaaggagtgcggcaccgctgaatgcttggataacaacggcggttgctctcacgtgtgtaacgacctgaaaatcggctacgaatgcctgtgtcccgatggctttcaactcgtcgctcagaggagatgtgaggacatcgacgagtgccaggaccctgatacatgctctcaactctgtgtgaacctcgaaggtggttataagtgtcaatgcgaggagggcttccagctggacccccacaccaaggcttgcaaagccgtaggctccatcgcatacttgttttttacaaacaggcatgaagtgagaaaaatgactctggataggagtgaatacacatccctgatccctaacctccgcaacgttgttgcactggacaccgaggtggcctccaacagaatctactggtcagacctgtcacaacgcatgatttgctctacacagctggaccgcgcgcacggcgtgagttcctatgatactgtaatctctagagacatccaggctccagacggtcttgcggtcgattggatccactctaatatatactggacagattctgtcctgggaaccgtgagcgtcgctgataccaagggcgtaaagaggaaaacactgttcagggaaaacggatctaagccccgcgcaatagtagttgaccctgttcacggcttcatgtactggaccgattggggaacaccagccaaaattaagaagggaggactgaatggtgtcgatatatactctttggttacagaaaatattcagtggccgaacggtatcacccttgatctgctgtctggaaggctctactgggtggattcaaaactgcactctatcagctccatagatgttaatggtggaaatcgcaagaccatccttgaagatgagaagcgcctggcccatcctttctccttggccgtgttcgaggataaggttttctggaccgatattatcaacgaggctatcttctctgctaatcgcctgacaggctccgacgttaacctgcttgctgaaaatctgctttcacctgaggacatggtactgtttcacaatctgacacagccaagaggagtaaactggtgtgaaaggactacactttctaatggtggttgtcaatacctttgcctcccggcgcctcaaattaatcctcactctcctaagttcacatgcgcttgccccgacggaatgcttctggcacgcgatatgcgcagttgccttaccgaagcggaggctgctgttgctacccaggaaacttcaacagttcgcctgaaggtctcaagtaccgcggtgaggactcagcataccaccaccaggcccgtgccagatacgagtagattgccaggcgcgactcctggacttaccactgttgagattgtaacgatgtcacaccaagctcttggtgacgtggccggtcgcggaaacgagaagaagcctagctctgtcagagccctcagtatagttctgcctatcgtgctgctggtgttcctgtgtcttggagtctttttgctgtggaagaactggaggctgaagaacataaattccatcaattttgacaacccagtataccagaagactacggaggacgaagtgcatatttgtcacaaccaggacggttactcatacccttcccgccagatggtctctttggaggatgatgttgcg

SEQ ID NO: 373 - DNA, 2580 bp, Artificial Sequence
  Description of Artificial Sequence: Synthetic Transcript Sequence
atggggccttggggatggaagctgcgctggactgtggcactgctgctggctgcagcgggaacggccgtgggcgacaggtgtgagcgtaatgaattccagtgccaagacggcaagtgtatttcatacaagtgggtgtgtgatggatcagccgaatgtcaggatggctcggacgaaagccaagagacgtgcctgtccgttacttgtaagtcgggcgacttctcgtgcggcggacgcgtgaatcgctgcatcccgcagttctggcggtgcgacgggcaagtcgactgcgacaacggcagtgacgaacaaggatgcccgccaaagacttgctcgcaggacgaatttcgttgccacgacggtaaatgtatctcacgccaatttgtctgcgactcagatcgggattgcctggacggctctgatgaggcgtcgtgcccggtcctgacctgtggaccagcgagtttccagtgcaactcctccacttgcatcccgcaactgtgggcatgcgacaatgacccagattgcgaggacggttcggacgaatggccgcagcgctgcagagggctgtatgtgttccagggtgactcaagcccatgctcagcctttgagttccactgtttgagcggagagtgtatccactcctcatggcgctgcgatggaggtcctgattgcaaagacaagtccgacgaagaaaattgtgcagtagccacctgccggcccgatgagttccagtgttccgacggcaactgcatccatgggagccggcagtgcgacagagagtacgactgcaaagatatgtcagacgaagtcggctgcgtgaacgtgaccctctgcgagggaccaaataagttcaaatgccactcaggagaatgcataactctcgacaaagtgtgcaatatggccagggactgcagggactggtcagatgagccgattaaggaatgcggtactgcggaatgcctggacaataacggcgggtgtagccatgtgtgtaacgatctgaagattggatacgagtgcctctgtccagatggattccagctggtggctcagcggagatgtgaagatattgatgaatgccaggaccctgatacctgttcgcagttgtgtgtgaatctggagggaggctacaagtgccaatgcgaggagggattccaactggatccacacactaaagcctgcaaggccgtcggatctatcgcgtacctgttcttcacgaacaggcatgaagtccgcaagatgactctggatagaagtgaatacacctctctcatcccgaacctgcgcaacgtggtggccctggataccgaagtggcttccaaccggatctactggtccgacctgtcccagcggatgatctgctcgacccagctggatcgggcccacggagtgagctcgtacgacaccgtgatctccagagatattcaagccccggacgggttggctgttgattggatccattcgaacatctactggacggactccgtgctgggaacggtgtccgtggctgatacgaaaggagttaagcggaaaaccctgttcagggagaacggatcgaagccacgtgcaatcgtggtcgacccggtccacggtttcatgtactggaccgactggggaaccccggctaagatcaagaaaggcgggctcaacggcgtcgacatctacagcctggtgacggagaacatccagtggcctaacggaattactctggatttgctgtcaggtcgactctactgggtggactccaaactgcactccatcagcagcattgacgtgaacggaggaaatcgcaagactatcctggaggacgaaaagagactggcacacccgtttagccttgcagtgtttgaagataaggtgttctggaccgatatcatcaacgaagccattttctcggccaaccggctgactggatctgacgttaacctcctcgccgagaatctgctttcgccggaggacatggtgttgttccataacctgacgcaaccacggggagtcaactggtgcgaacggaccactctcagcaatggcggttgccagtacctctgtttgccggcgccccaaatcaaccctcattcacccaaattcacctgcgcttgtccggatggaatgctcctggccagggacatgcgctcgtgcctgacggaagccgaagccgctgtcgcgacccaagaaaccagcaccgtcagactgaaggtgtcctccaccgcagtgcgcactcaacacaccacgacgaggcccgtgcctgatacctcgaggctgcctggcgcgacccctggacttactaccgtcgagatcgtgactatgtcgcatcaggcactgggcgacgtggctggcaggggaaatgaaaagaagccgtcgtcagtgcgggccctgtctatcgtgctcccgatcgttctcctcgtctttctgtgcctcggggtctttctgctctggaagaattggcgactcaagaatatcaactcgatcaactttgataaccctgtgtaccaaaaaacgactgaagatgaggtgcacatctgccacaaccaggatggttattcctacccgtcccggcagatggtgagtctggaggatgacgttgcc

SEQ ID NO: 374 - DNA, 2580 bp, Artificial Sequence
  Description of Artificial Sequence: Synthetic Transcript Sequence
atgggaccatggggatggaaactcagatggacggtcgcgctgctgctggcagccgctgggacggccgtgggagacagatgcgaaaggaatgaattccagtgtcaagatggcaagtgcatctcttacaaatgggtctgcgatggctctgcggaatgtcaggatggctccgacgaatcacaggaaacctgtctaagcgtgacctgcaaatcaggcgacttcagctgcggcggacgggtcaaccgatgtatccctcagttttggaggtgcgatggccaggtcgattgcgataacggttcagatgagcagggctgtccgcctaaaacctgttctcaggacgaatttaggtgtcacgacggcaaatgtatatctagacagtttgtgtgcgactctgaccgcgactgccttgacggctcggacgaggcatcttgtccagtgttgacgtgcggccccgcctcttttcagtgcaacagttctacctgcatccctcaactgtgggcgtgtgacaacgaccctgattgcgaagatggatccgatgagtggccccagcgctgtagggggctgtatgttttccagggtgacagctccccttgttcagcatttgagttccactgcctaagcggcgaatgcatccatagctcatggcgctgtgacggaggacccgattgcaaggacaaaagcgacgaagaaaattgcgcggtggctacgtgccggcctgatgaatttcagtgttctgacggtaattgtattcacggtagccgtcagtgcgacagagaatatgattgcaaagacatgagcgacgaagtgggctgtgttaacgtgacgctgtgcgagggcccgaataaattcaagtgtcattcgggggagtgcataacgctggataaagtctgtaacatggctcgagattgtcgtgactggtctgacgagcctattaaagaatgtggaacagctgagtgtctggataataacggaggatgttctcacgtgtgcaatgatctgaagattggatacgagtgtttatgtccggatggctttcagttggtggcgcagcggcgctgtgaagacatcgacgaatgccaagatcccgacacttgttctcaattatgtgtcaatctggaggggggatacaagtgccaatgcgaggaaggcttccaactcgacccccataccaaggcgtgcaaagccgtgggctctatagcatatcttttctttaccaaccgccatgaagtgcgtaagatgaccttggacaggtccgagtacaccagtcttatccctaacctgcggaacgttgtcgctcttgatacagaggtagcctcgaatagaatctactggagcgacttgagtcagcgtatgatttgtagtacccagctcgatcgggcccacggcgtctctagttatgacacagtaatctcgcgggacattcaggccccggacggcctggctgttgactggattcactcaaacatatactggactgattccgtcctcggtactgtaagcgtggcagacacaaaaggcgtgaaacgcaagactctattcagggagaatgggtccaagcctcgggcaattgtcgtggacccagtgcatggcttcatgtactggaccgattggggaactcccgccaaaattaaaaagggcggactgaatggtgtggacatttatagcttggtgacggaaaatattcagtggcctaacggaattactctcgatctgctgtctgggcggctgtactgggtggattccaaacttcattccatctccagtatcgacgtgaatggggggaacaggaaaacgatcctcgaagatgagaagcgccttgcgcaccctttctcgctcgcggtctttgaggacaaagtcttttggactgatatcatcaatgaggcgattttctccgcaaatcgcctgaccggatctgatgtcaatcttctcgcagaaaatctcttatcaccagaggatatggtattatttcacaacttgacccaaccaagaggcgttaactggtgcgaacggaccaccctctccaacggcgggtgtcagtatttgtgtctgccagcccctcagataaacccacacagtccgaaattcacctgcgcctgccccgacggcatgctgttggcacgagacatgaggtcctgtctcaccgaggccgaggccgccgtggctactcaggaaacaagcaccgtaaggttgaaggtgagctctacagccgtgcgtactcagcacacaacgacaaggccagttccggatacgtcccgcctgccgggtgcgacgccgggattaacgaccgtcgagatcgtaactatgtcacatcaggcattgggagatgtcgccggacgggggaatgagaaaaaaccttcttccgtccgagctctgagcatcgtgttgcccattgtgctcctggtgtttctgtgcctcggggttttcttgttgtggaaaaattggcgactaaaaaacatcaattccatcaacttcgataatccggtgtatcagaagactaccgaggacgaagtccacatctgccataaccaggacggctacagctacccatcccgacagatggtatccctagaggatgatgtggcg

SEQ ID NO: 375 - DNA, 2580 bp, Artificial Sequence
  Description of Artificial Sequence: Synthetic Transcript Sequence
atgggtccttggggatggaagctccgctggactgtggcgctgctccttgctgccgccggaactgcggtgggagacaggtgcgaacgcaatgaattccaatgtcaggatggaaagtgtattagctacaagtgggtgtgtgatggctcggcggagtgccaggacggcagtgacgagtcgcaggaaacctgcctgtccgtcacttgtaagtccggagacttttcctgtggaggacgtgtgaacaggtgtatcccgcagttttggcgttgtgacggccaggtggactgcgacaacggatccgatgagcaaggatgcccgccgaagacttgtagccaagatgagttccggtgccacgacggcaagtgcatctcacggcaattcgtgtgcgattccgaccgcgactgtctggatggatcagatgaggcatcgtgccctgtgttgacctgcggcccagcatccttccagtgtaactcctccacctgcatccctcagctgtgggcctgcgataatgatccagattgcgaagatggtagcgacgaatggccgcaaagatgccgcggtttgtacgtgtttcagggcgactcatccccatgcagcgccttcgaatttcactgcctctcgggagagtgtatccactcctcctggcgctgcgatgggggaccagattgcaaggacaaatcggatgaggaaaactgtgctgtcgctacttgcaggccggacgagttccaatgctcggatggaaactgcattcatggatcgcgccagtgtgatcgggaatacgattgtaaggacatgtcagacgaggttgggtgcgtcaatgtgaccctgtgcgagggaccgaacaagtttaagtgccattcgggagaatgcatcacgctggataaagtgtgtaatatggcccgcgactgtcgggactggtccgacgaacctatcaaagagtgtggaactgcagagtgcctcgacaacaacggcggatgctcgcacgtgtgcaacgacttgaagattggatacgaatgcctgtgcccagacgggtttcagctggtcgcgcagcgccggtgcgaagacatcgatgagtgccaggatccagatacgtgcagccaactgtgcgtgaatctcgaaggaggctacaaatgccagtgcgaagagggctttcagctcgatccgcataccaaagcgtgcaaggccgttggaagcatcgcatatctcttcttcactaacagacacgaggtgaggaaaatgacccttgaccggtcagagtacacctccctgatcccgaatctgagaaacgtggtggcactggacaccgaggtcgcctcgaacagaatctactggtcggatctgtcgcaacgcatgatctgctcgactcagctggaccgcgcacatggagtgtcttcctacgacactgtgatctcccgcgacatccaagccccggatggactggcggtggactggatccacagcaacatctactggacggattcggtgctcgggactgtatcggtggctgacaccaagggtgtgaaacggaagaccctgttccgcgaaaacgggagcaaaccgcgcgccatcgtcgtggaccctgtgcatggattcatgtactggactgattgggggacgccagcgaaaatcaaaaaggggggtcttaacggagtcgatatctacagcctcgtgaccgagaacatccaatggcctaatggaatcaccctcgacctgctctccggaagactttactgggtggactcgaagctgcattccattagttcaattgacgtgaacggcggcaataggaaaactatactcgaggacgagaaacggctggcacacccattcagtctcgccgtgttcgaagataaagtcttctggactgatatcatcaacgaagctatcttcagcgcgaatcggctgacgggatccgacgtcaacttgctggccgaaaacctgctgtcgccggaggacatggtgctgtttcacaaccttactcagccgcgcggcgtcaactggtgcgagcgcaccacgctttccaatggcggctgccaatacttgtgcctgcccgccccgcaaattaacccgcattcgcctaagttcacttgcgcgtgccccgacggaatgctgctggctcgagacatgcggtcctgcctcaccgaggcagaggcagcggtggctacccaggagacttccactgtgagactgaaggtgtccagcaccgcagtgcgcactcagcatactactactcgccccgtgccggacacctccaggctgccgggtgcaacgccgggcctgaccaccgtcgaaatagtgactatgtcgcatcaggccttgggtgatgtcgcaggccgggggaatgagaagaagccgtcctcggtccgagccctgtcaatagtgctcccaatcgtcctcctcgtgttcctctgtctgggagtgttcctcctgtggaagaattggagactcaagaatatcaactcaatcaactttgataatcccgtgtaccagaagactacggaagacgaagtgcacatctgccacaatcaggatggctactcctacccttcccggcagatggtgtccctggaagacgatgtggcc

SEQ ID NO: 376 - DNA, 2580 bp, Artificial Sequence
  Description of Artificial Sequence: Synthetic Transcript Sequence
atgggcccatgggggtggaaacttaggtggaccgttgcgctgctgctcgcagccgctggcactgctgttggtgatcgatgcgaacggaatgagtttcagtgtcaggatggtaagtgcatctcatacaagtgggtgtgtgacggttcagccgagtgccaggacggaagcgacgagtcccaggagacttgcttgtcggtgacttgcaaatcgggagacttcagctgcggaggacgagtcaaccgctgtatcccacagttttggagatgtgacggtcaagtcgattgcgacaatggatcggacgaacagggatgtccaccgaaaacctgttcccaggacgagttccggtgtcatgacggaaaatgcattagccggcagttcgtctgcgattccgatcgggactgtctcgacggatcggacgaggcctcatgtccagtgcttacctgcggacccgcgagcttccagtgcaactcgtcgacctgcatcccccagttgtgggcctgtgataacgacccggattgcgaagatggttcagacgaatggccgcaacgctgccgcggtctgtacgtgtttcagggagattcgtccccgtgctcggcgttcgaattccactgcctgtcgggagaatgtatccacagctcttggaggtgcgatggaggtccagattgcaaagacaagtccgacgaagaaaactgcgccgtcgcaacctgccgcccggacgaatttcagtgttccgacggcaactgcatccatggaagcaggcagtgcgaccgcgaatacgattgcaaggatatgtctgatgaggtcggctgtgtgaacgtgactctgtgcgaagggcccaataagttcaaatgtcactccggagagtgtattacgctggacaaggtgtgtaatatggctcgcgactgcagagattggtcggacgaaccaatcaaagaatgcggcaccgccgagtgccttgacaacaacggtggatgctcgcacgtgtgcaatgatctgaaaatcggctacgaatgcctttgccctgacggttttcaactggtcgcccagcgcaggtgtgaagatatcgacgaatgccaagatccggacacttgctcgcaactctgcgtgaacctggaggggggatacaagtgccagtgcgaagagggattccaacttgacccgcacaccaaggcttgtaaggccgtgggatccatcgcgtacctcttctttacgaataggcatgaggtcagaaaaatgaccttggatcggtccgagtacacctcgctgatcccgaaccttcgcaacgtcgtggccttggacaccgaagtcgcatcgaaccggatctactggtccgatctgagccagaggatgatctgctcgactcaactcgaccgcgcccacggagtgtcgagctacgacaccgtgatttcacgcgacatccaggcccctgacggactcgccgtcgactggatccactctaacatttactggaccgattcggtgctggggactgtgtcagtggctgacactaaaggtgtgaagagaaagacgctgttcagagaaaacggaagcaagcctagagccattgtggtggaccctgttcatggattcatgtactggactgactggggcactccggccaagattaagaaaggaggcttgaacggagtggatatctactcgctggtcaccgagaacattcaatggcctaatggaatcaccctggacctcctttccggccgcctgtactgggtcgactccaagctgcactccatctctagcatcgacgtgaacggaggcaacagaaagaccatcctggaagatgagaaacgcctcgcccatcccttttcgctggcggtgttcgaagataaagtcttttggaccgacatcatcaacgaagcgatcttttccgcgaacagacttaccggcagcgacgtgaatctgctcgccgagaatctgctgtctccggaagatatggtcctgttccacaatctgactcagccacgcggagtgaactggtgcgaaagaactaccctctcaaacggaggctgccaatacctctgtttgccagccccacaaatcaatccgcactcgccgaagttcacctgcgcctgtcctgacggcatgctcttggcccgcgacatgcggtcttgcctgaccgaagctgaggcagccgtcgcgactcaagaaacgtccactgtgaggttgaaggtgtcctccaccgctgtcagaactcagcataccaccactcggcctgtcccggacactagccgcctgccgggcgctaccccgggcttgaccaccgtggagatcgtgacgatgtcacatcaggccctgggagatgtggccggccggggaaatgagaagaagccatcatcggtccgcgccctgtcgatcgtgctgccgattgtcctgctggttttcttgtgcctcggagtgttcctcctctggaaaaactggaggctgaagaacattaactcgatcaatttcgataatcctgtgtaccagaaaacgaccgaagatgaagtgcatatctgccataaccaggatgggtacagctacccgtcgcgccaaatggtgtcgcttgaagatgacgtggct

SEQ ID NO: 377 - DNA, 2580 bp, Artificial Sequence
  Description of Artificial Sequence: Synthetic Transcript Sequence
atgggtccgtggggttggaaactacgatggacggtagcgctattattagcggcggcgggtacggcggtaggtgatcgatgtgaacgaaatgaatttcaatgtcaagatggtaaatgtatatcgtataaatgggtatgtgatggttcggcggaatgtcaagatggttcggatgaatcgcaagaaacgtgtttatcggttacgtgtaaatcgggtgatttttcgtgtggtggtcgtgttaatcgatgtataccgcaattttggcgatgtgatggtcaagttgattgtgataatggttcggatgaacaaggttgtccgccgaaaacgtgttcgcaagatgaatttcgatgtcatgatggtaaatgtatatcgcgacaatttgtatgtgattcggatcgtgattgtctagatggttcggatgaagcgtcgtgtccggttctaacgtgtggtccggcgtcgtttcaatgtaattcgtcgacgtgtataccgcaactatgggcgtgtgataatgatccggattgtgaagatggttcggatgaatggccgcaacgatgtcgtggtttatatgtttttcaaggtgattcgtcgccgtgttcggcgtttgaatttcattgtttatcgggtgaatgtatacattcgtcgtggcgttgtgatggtggtccggattgtaaagataaatcggatgaagaaaattgtgcggtagcgacgtgtcgtccggatgaatttcaatgttcggatggtaattgtatacatggttcgcgacaatgtgatcgtgaatatgattgtaaagatatgtcggatgaagtaggttgtgtaaatgttacgctatgtgaaggtccgaataaatttaaatgtcattcgggtgaatgtataacgctagataaagtatgtaatatggcgcgagattgtcgagattggtcggatgaaccgataaaagaatgtggtacggcggaatgtctagataataatggtggttgttcgcatgtttgtaatgatttaaaaataggttatgaatgtctatgtccggatggttttcaactagttgcgcaacgacgttgtgaagatatagatgaatgtcaagatccggatacgtgttcgcaattatgtgtaaatttagaaggtggttataaatgtcaatgtgaagaaggttttcaattagatccgcatacgaaagcgtgtaaagcggtaggttcgatagcgtatttattttttacgaatcgtcatgaagttcgaaaaatgacgctagatcgatcggaatatacgtcgttaataccgaatttacgtaatgtagttgcgttagatacggaagtagcgtcgaatcgtatatattggtcggatttatcgcaacgtatgatatgttcgacgcaactagatcgagcgcatggtgtatcgtcgtatgatacggttatatcgcgagatatacaagcgccggatggtctagcggttgattggatacattcgaatatatattggacggattcggttttaggtacggtttcggtagcggatacgaaaggtgtaaaacgaaaaacgttatttcgagaaaatggttcgaaaccgcgagcgatagtagttgatccggttcatggttttatgtattggacggattggggtacgccggcgaaaataaaaaaaggtggtttaaatggtgttgatatatattcgctagtaacggaaaatatacaatggccgaatggtataacgttagatctactatcgggtcgtctatattgggtagattcgaaattacattcgatatcgtcgatagatgtaaatggtggtaatcgtaaaacgatattagaagatgaaaaacgtttagcgcatccgttttcgttagcggtttttgaagataaagttttttggacggatataataaatgaagcgatattttcggcgaatcgtctaacgggttcggatgtaaatctactagcggaaaatctattatcgccggaagatatggttctatttcataatctaacgcaaccgcgtggtgtaaattggtgtgaacgaacgacgttatcgaatggtggttgtcaatatttatgtttaccggcgccgcaaataaatccgcattcgccgaaatttacgtgtgcgtgtccggatggtatgttattagcgcgagatatgcgatcgtgtttaacggaagcggaagcggcggttgcgacgcaagaaacgtcgacggttcgactaaaagtttcgtcgacggcggtacgaacgcaacatacgacgacgcgtccggtaccggatacgtcgcgtctaccgggtgcgacgccgggtttaacgacggtagaaatagtaacgatgtcgcatcaagcgttaggtgatgtagcgggtcgtggtaatgaaaaaaaaccgtcgtcggttcgagcgttatcgatagttttaccgatagttctactagtttttttatgtctaggtgtatttctattatggaaaaattggcgtttaaaaaatataaattcgataaattttgataatccggtatatcaaaaaacgacggaagatgaagtacatatatgtcataatcaagatggttattcgtatccgtcgcgtcaaatggtatcgttagaagatgatgtagcg

SEQ ID NO: 378 - DNA, 2580 bp, Artificial Sequence
  Description of Artificial Sequence: Synthetic Transcript Sequence
atgggaccatggggctggaaactgaggtggacagtggctttgctgcttgccgccgctggtactgctgtgggagaccgctgtgagcgtaacgagtttcagtgccaagacggaaagtgtatttcatacaagtgggtgtgtgacggctcagcagagtgtcaggatggaagtgacgaaagccaagaaacctgtcttagcgtaacatgtaaatccggagacttttcctgcggtggtcgcgtgaatcgctgtattcctcaattttggcgctgtgatggacaggtggattgcgacaacggatccgatgagcaaggttgtccccctaaaacctgttcacaagacgagtttaggtgtcacgatggaaagtgtatctcacgtcagttcgtgtgcgacagtgatcgtgattgtttggacggatcagatgaggcctcatgtccagtcctgacctgcggaccagcctcatttcagtgtaattcatccacttgtatcccccagctctgggcatgcgacaatgaccctgactgcgaggatggctccgacgagtggccacagagatgtaggggactctatgtttttcagggagattcctccccttgctctgctttcgaattccactgtctcagtggtgagtgtattcatagttcctggagatgcgacggcggccccgattgcaaggacaagagcgatgaggagaactgtgctgttgctacatgccgccctgacgagttccagtgctctgatggtaactgcattcacggcagccgtcaatgtgaccgtgaatatgactgcaaggatatgtccgacgaagtgggctgcgttaatgtgaccctgtgcgaaggaccaaataagtttaagtgccactcaggcgagtgtattactctggacaaggtgtgtaatatggctcgcgactgtagggattggagcgacgagcccattaaggaatgcggaactgctgagtgcctggataacaatggtggctgtagtcatgtgtgcaacgacctcaagataggctacgagtgcctttgccctgatggtttccagctggtagcccagagacgttgcgaagacattgacgagtgccaggatcccgacacatgctcacagctctgcgtgaacctcgaaggcggctacaagtgccaatgcgaagaaggttttcagctggacccacacaccaaagcatgcaaagcagtaggatctattgcatacttgttcttcacaaatagacacgaagttcgcaagatgaccctggataggtccgagtacacttcacttatacctaatctgcgcaatgttgttgcactcgacactgaggtagcctcaaacagaatttactggtccgatctttctcagcgcatgatttgctctacacaactcgaccgcgcccacggtgtaagtagttacgatactgttatctcccgcgatatccaagcccctgacggactggccgtagactggattcactccaacatctattggaccgatagtgtgctcggtaccgtaagcgttgctgacacaaaaggagtgaaacgcaaaaccctcttccgcgagaacggttccaagcccagggctatagtcgtcgacccagtacatggattcatgtattggacagactggggaacaccagctaagatcaagaagggcggcttgaacggcgtagatatttactcacttgtgaccgagaatatccaatggcccaacggtataactctcgacctcctgagcggacgtttgtactgggttgatagcaagcttcactctatctcctcaatcgacgttaacggtggtaacagaaagactatcctggaggatgagaagcgtcttgcccacccattctctctggccgtattcgaggacaaggtcttttggactgatattatcaacgaagcaattttttctgctaatagactcactggatcagacgtgaaccttctggccgaaaacctgctctcacctgaagacatggtgctgtttcacaacctgacccagcctcgtggcgtcaactggtgcgagcgcactactctgagtaacggaggatgccagtacctgtgtttgcccgccccacagataaaccctcatagccctaaattcacatgtgcatgcccagatggtatgctcctggcccgcgatatgcgttcttgtctgaccgaagccgaagctgccgttgccacccaagagaccagcactgttagactcaaggtgtcttccactgctgtgcgtactcagcacactacaaccaggccagtacccgacaccagccgtctgcccggagccacacctggactgactactgtagagatcgtgacaatgtctcaccaagccctgggtgacgtggccggccgtggcaacgagaaaaagccttctagcgttcgcgctctgtctattgttcttccaatcgtactgctggttttcctttgtctcggagtattcctcctctggaagaactggagactcaagaacatcaactcaattaattttgacaatcctgtttaccagaaaacaacagaggatgaagtgcacatctgtcacaatcaggacggctattcatacccctcacgtcagatggtgtcccttgaggatgacgtggcc

SEQ ID NO: 379 - DNA, 2580 bp, Artificial Sequence
  Description of Artificial Sequence: Synthetic Transcript Sequence
atgggtccttggggttggaaacttagatggactgtggcactccttctggcagcagcaggtacggccgtgggcgaccgctgcgagagaaacgagtttcaatgtcaggacgggaagtgcatcagctacaaatgggtgtgcgacggatcggcagagtgtcaggacggaagcgatgaatcccaagaaacctgtctttcggtcacctgcaagtccggtgacttttcctgtggaggacgcgtgaataggtgcatccctcagttttggcgctgtgatgggcaggtggactgtgataacggatcagacgagcaaggttgcccacctaaaacctgttcgcaggatgagttccgctgtcatgatggaaagtgtattagccgacagtttgtctgcgattcggacagagattgcctggatggctccgatgaagcctcctgccctgtgcttacctgtggaccggccagctttcagtgtaacagctccacgtgcattccacaactttgggcctgcgacaacgacccagattgtgaagatggtagcgatgaatggcctcaacgttgtagaggactctacgtgtttcaaggtgactcttcaccctgtagcgcattcgaatttcattgtctttccggagaatgcatacactcatcgtggcgttgtgatggcggtccggattgtaaagacaagtccgatgaggagaactgtgcagtggccacttgtcgccctgatgagtttcagtgctcggatgggaattgtattcacggatcccgacaatgtgatcgcgagtacgactgtaaagacatgtcggacgaggtgggatgtgtgaatgtgaccctgtgcgaaggtcccaacaagttcaaatgccacagcggggaatgtatcactctggacaaggtctgcaacatggccagagactgtagggattggtccgacgaaccaattaaggaatgcggaactgcagaatgtcttgataacaacggcggatgttcccacgtgtgcaacgatctcaaaattggatatgagtgtctgtgccctgatggctttcagcttgttgcacagagacggtgtgaagatattgacgaatgccaagatccagatacttgttcacaactctgtgttaatctggaggggggctacaaatgtcagtgcgaggaagggtttcaactggaccctcataccaaggcctgtaaggcggtcggttcaatcgcataccttttcttcactaaccggcacgaagttaggaagatgactctcgataggtcagaatacacctccctcattcccaatcttcgtaacgtggtggcactggatactgaagtggccagcaatagaatctactggtcagatctctcgcaacggatgatttgctcgacccaactggatagagcacatggagtgagcagctatgataccgtcatctcgcgggacatccaagcaccggacggtctggcggtggattggatacattcgaacatctactggacggactcggtccttggcaccgtgtccgtggcagatactaagggcgtgaagagaaagacgctgtttcgggaaaacggatcgaagccacgggctattgtcgttgaccctgtgcacggttttatgtactggaccgattggggaacccctgcgaagattaagaagggtggccttaacggtgtggacatatactctctggtgaccgaaaacattcagtggccaaacggaattaccctggacctcctttccggacggctgtactgggtcgattccaagctccatagcattagctcaattgatgtaaacggaggaaatcgcaagaccatcctcgaagatgaaaagcggctcgcccatcctttttcgctcgcagtgtttgaggataaagtattctggaccgacataatcaacgaggccatattctctgctaaccgtcttacgggttccgacgtgaacctccttgcggagaatcttctgtcccccgaggacatggtccttttccacaacctgacccagccgaggggcgtgaactggtgtgaaagaaccaccctctccaacggaggatgccaatacctgtgtttgcctgcacctcagataaacccacatagccctaaattcacttgcgcgtgccccgatggcatgctgctcgcacgggatatgagatcgtgcctcaccgaagccgaagcggctgtggcgacccaggagacttcaactgttcgcctcaaggtcagctccaccgcagtgcgcacccaacataccactacgcgccctgtgccagacactagtaggttgcctggggccactccaggcctgactactgtcgaaatcgtcaccatgagtcatcaagcacttggtgacgtcgccggtcggggtaacgagaagaagccctccagcgtgcgggcactttctattgtgttgcccattgtgctgcttgtctttctttgtcttggagtgtttctgctgtggaaaaactggagactcaagaacatcaactcaataaacttcgacaatccagtgtatcaaaaaaccaccgaggacgaggtgcatatttgccataatcaagatggttacagctacccttcgcgccagatggtttccctggaggacgatgtggca

SEQ ID NO: 380 - DNA, 2580 bp, Artificial Sequence
  Description of Artificial Sequence: Synthetic Transcript Sequence
atgggtccttggggttggaagctgcgctggacggtggcactgctgttagcggccgcaggcactgccgtcggcgaccggtgcgaacgcaatgagtttcagtgccaggacggcaaatgcatctcttacaaatgggtgtgcgatggttccgctgaatgccaagatggcagcgatgagagccaggaaacctgcctcagcgtcacctgtaagtctggtgacttttcttgtggcggcagggtcaaccgctgcatccctcagttctggcggtgcgacgggcaagtggattgcgataacggatcggacgaacaaggttgcccgccaaaaacctgcagccaggacgagttccgttgtcacgacggtaagtgcatcagccgtcaatttgtgtgcgattcggaccgagactgtctggacgggagcgacgaagcgagctgccctgtcctgacttgtggtcctgcttcgttccagtgtaactcatccacttgcattccacagctttgggcttgcgacaacgacccagactgtgaggatggaagcgacgagtggccccagcggtgtcgcggcctttacgtgttccagggagattccagcccttgcagcgcattcgaatttcattgcctgagcggcgagtgtatccacagcagctggcgttgcgatggtggcccggattgcaaggataaaagcgatgaagaaaactgcgcagtggccacgtgtcgccccgacgagttccagtgctccgacggcaactgtatccacgggtcccgccagtgcgatcgcgaatacgattgcaaggacatgtccgatgaggtgggttgtgtcaacgtcactctgtgtgaaggtcctaacaaatttaaatgtcatagcggcgaatgcatcaccctggacaaggtatgcaatatggcgcgtgattgtcgtgactggtctgatgagcctatcaaggaatgtggtacggcagagtgcctggataataatggagggtgtagccatgtgtgtaacgacctgaagatcggttatgagtgtttgtgtccagatggcttccagttggtggcccagcgcagatgcgaggatatcgatgagtgtcaggatcctgatacttgcagccaactgtgtgtcaacctggaaggcggttacaagtgccagtgcgaggaaggattccagctggaccctcataccaaggcctgcaaggctgtcggtagcattgcctatctgttctttaccaatcgtcatgaggttcgcaaaatgacgctggatcgaagcgagtacacgagcttgattccgaatttgcgcaacgtggtggcgctggacaccgaagtggccagcaaccgaatttactggagcgacttgtcccagcgcatgatttgctcaacgcagctggaccgcgcacatggcgtttcatcttacgacacagttatttcacgcgacattcaagcaccggacggattggcagtggactggatccactctaatatctattggacggatagtgttctgggcactgttagcgtcgcggatactaaaggtgtaaaacgaaagaccctattccgcgaaaacgggtctaaaccgcgcgcgattgtggtggaccctgtacatggctttatgtattggaccgattggggtaccccggccaagatcaagaaggggggtctgaatggcgttgatatctacagcttggtgactgagaatatccagtggcctaacggcataacgctggatttgctgagcggacgactgtattgggtggattccaagctacactcgatctcttcaattgacgttaatggtggcaatcggaagactattttggaagacgaaaagcgcctggcccatccatttagcctagccgtttttgaggataaggttttttggacggatatcatcaatgaggccattttctccgctaaccgcttgacaggttcggatgtgaacctgctggccgagaatctgttgagcccagaagatatggtcctgttccacaacctgactcagcctcgcggtgtcaattggtgtgaacgtaccactctgtcaaatggtggctgccagtatctctgcctaccggccccgcagatcaacccgcatagccccaagttcacctgtgcatgcccagacggtatgcttctcgcgcgtgacatgcgcagctgcttgacggaggccgaggcagccgtggccacccaagaaacttctactgtgcgcctgaaggtctcctcaactgccgtaaggacgcagcatacgacgacccgtcctgttccggatacgtcacgcctgcctggggccacgccgggtcttaccaccgtggaaattgtgactatgtcgcatcaagcccttggtgacgtggctggtcggggcaacgagaaaaagccttcttcagttcgagccctgagcattgtactgccaatcgtcctgctggtgtttctgtgcctgggtgtctttttactgtggaagaactggcgtttaaaaaacataaactctattaactttgacaaccctgtttaccaaaaaacaacggaagatgaggtgcacatatgtcacaatcaggacggttattcctacccaagccgccagatggtttctttagaagacgatgtggcg

SEQ ID NO: 381 - DNA, 2580 bp, Artificial Sequence
  Description of Artificial Sequence: Synthetic Transcript Sequence
atgggtccttggggctggaaactgaggtggactgtggcattgctactagctgcggctggaactgcagtaggagatcgttgcgaacgaaatgaattccaatgtcaagatggaaaatgtatctcgtataaatgggtatgtgatggatccgcagagtgccaagatggatccgatgaaagtcaagagacttgtttatctgttacatgtaagtcaggagatttctcatgtgggggtcgtgttaatcgatgtattcctcagttttggcgctgtgacggtcaagtagattgcgacaatggttcagacgagcagggatgtccaccaaagacatgttctcaagatgagttcagatgccatgatggaaagtgcatatcccgacagtttgtctgtgatagtgaccgtgactgcctcgatggatccgatgaagcttcatgcccggtgctcacatgcggcccagcctcattccaatgtaacagtagcacttgtatccctcaactttgggcttgcgataatgatccagattgcgaagatggatccgatgagtggccacaacgttgcagaggattgtatgttttccagggagatagttctccttgttcagcatttgagtttcactgcttgagcggagagtgcatccattctagttggagatgtgatggcggaccagactgcaaagataaaagcgacgaagaaaactgtgctgtagctacatgtcgtcctgacgaattccagtgctccgatggaaactgtattcacggtagtcgacagtgtgatagagagtacgattgtaaagacatgtcagatgaagttggatgtgtgaacgtaacactttgtgagggacctaacaagttcaagtgtcattcaggagaatgtatcacgttggataaggtctgcaatatggcaagagactgcagggactggtctgatgaaccaattaaggagtgtggaactgcagaatgccttgacaataatggaggatgttcacatgtttgtaatgatctgaaaattggttacgaatgcttgtgcccagatggattccaacttgttgcacaacgaagatgcgaggacatcgatgaatgtcaggatccggacacatgttctcaactttgtgtgaatttagagggaggctacaaatgtcaatgtgaagagggatttcaactcgatccacatacaaaagcatgcaaggcagttggatcaattgcatatctcttctttacaaaccgccacgaggttcgcaagatgactcttgatcgatctgaatatacctcacttataccgaacctgcgtaacgtagtagcattggacacggaggttgcttcgaatcgaatttactggtctgatttgtctcaacggatgatctgcagcactcagcttgacagggcacatggtgttagctcctacgataccgtcatttctcgggatatccaagctccagacgggttagctgtggattggatacattctaacatttattggacagattccgttctcggtaccgttagcgttgctgatacaaagggagtgaagcgaaaaactttgttcagagaaaatggctcaaagccacgagctatcgttgttgatccagtccatggattcatgtactggactgactggggaaccccggcaaagatcaagaaaggaggacttaacggagtcgacatatatagtttggtaactgagaatattcagtggccgaacggcataacacttgatcttctgtcaggtcggctgtattgggtcgactctaaactccactctatctcttccattgacgtgaacggaggaaaccgtaaaactatattggaggatgaaaaaagactggcccatccgttctcgctcgctgttttcgaggacaaggtgttttggacagatattatcaacgaagctattttttcagcaaaccggttaactggaagtgatgtgaatctcctcgcagagaatctgttaagtccggaagatatggttcttttccacaacttgacacaaccaagaggcgttaattggtgtgaacgaaccacattatcaaatggaggatgccagtacttgtgcttaccagcaccacagatcaatcctcacagccccaaattcacatgcgcttgcccagatgggatgcttttagcaagggatatgcgttcatgcttaaccgaagctgaggctgcggtggctacacaagaaacgtcgacagtccgtctcaaagtttcatctacagctgttcgtacccaacatacgacgacacgaccagtcccggatacttcgagacttccgggtgctacacccggtcttacgaccgtagagatcgttaccatgtctcaccaggcattgggtgatgttgctggacgaggaaatgagaagaaaccaagttcggtgcgagcattgtcaattgttctacctattgtgttattagttttcctctgccttggcgtgttcttactgtggaagaactggcggctcaaaaacatcaattccatcaatttcgataatccagtgtatcagaaaacaacagaagacgaagtgcatatctgccacaatcaagacggatactcatacccatcacggcagatggtttcgctggaagacgacgtggct

SEQ ID NO: 382 - DNA, 2580 bp, Artificial Sequence
  Description of Artificial Sequence: Synthetic Transcript Sequence
atgggtccttgggggtggaagctgcggtggactgtcgctttgttactagccgccgcggggaccgccgtgggagaccggtgcgagcgcaatgagtttcagtgtcaggacggcaaatgcatatcatataagtgggtgtgcgacgggtcggcggaatgccaggacggaagtgacgagtctcaggagacatgtctgagcgtaacttgcaagtctggcgacttttcctgtggtggacgtgtgaacaggtgtatcccacagttctggcggtgtgacgggcaggtagactgtgataacgggagtgacgaacagggatgcccacctaaaacctgctcacaggacgagttccgatgtcacgacgggaaatgcatcagccggcagtttgtctgtgactccgaccgagactgtctggacgggagcgacgaggcctcttgccccgtgttgacatgcggccccgcaagctttcagtgtaactccagcacctgtataccacagctgtgggcttgtgacaacgacccggactgtgaggacgggagtgatgaatggccccaaaggtgccggggcctgtacgttttccagggagacagtagcccctgtagcgcgtttgaatttcattgcctgagtggggagtgcatccatagctcttggcgctgtgacgggggacctgattgcaaggataagagtgatgaagaaaattgcgccgttgcaacttgccgtccggatgagtttcagtgcagtgacggaaattgcattcatgggagtcgccaatgcgaccgggaatatgattgcaaagatatgtctgacgaggtcggatgtgttaacgtgacgctttgtgaagggcctaataagttcaagtgccactcaggcgagtgtatcactctggacaaggtctgcaatatggcaagagactgtcgcgattggagcgacgagccgatcaaggagtgtgggactgccgaatgtcttgataataacgggggttgttctcacgtatgcaatgatctgaagatcggttacgagtgtctgtgtccggatggtttccagctagtggcacagcgcagatgcgaagacattgacgagtgccaggacccagatacatgttcccagttgtgtgtaaacctggaaggcggatataaatgccagtgcgaggagggtttccagctggatccccatacgaaggcgtgtaaggctgttgggagcattgcgtacctgttcttcactaatcggcacgaggtgcgaaagatgaccctcgatcggtccgaatacacgagtctaatcccgaacctgaggaacgtggtggcactcgatactgaggtcgcctcaaaccgaatttattggtcagatctcagtcagagaatgatctgctctacccagctggaccgagcccatggcgtgtccagttatgacacagttatctccagggacatacaggctcctgatggcctggccgtcgattggattcatagtaacatatattggactgattcagtgttaggcacggtaagcgtcgccgatacaaaaggcgtaaaacggaagactctgttccgggagaatggcagcaagccgcgggccattgtggtggaccctgttcacgggtttatgtattggaccgactgggggacacccgcaaaaatcaaaaaggggggactcaacggagttgatatctatagccttgtaactgaaaatatacagtggcccaacgggattacgctagacctcttgtcaggccgtctgtactgggtggactccaagcttcatagtatctcctccatcgacgttaacgggggcaacagaaagacaattttggaagatgaaaaacggctggctcatccgttttccctcgcggttttcgaagataaagtgttttggacagacattattaatgaagccatattctccgcaaacagactaaccggaagcgacgtcaatcttctggccgaaaacttactgtcccctgaagacatggtgctctttcataatctgacgcagccccgaggcgtgaactggtgtgagcgcacaaccctgtctaacggcgggtgccaatacctttgcctccccgccccgcagatcaatccccactcaccaaagtttacgtgtgcttgtcccgatgggatgctgctggcgcgggatatgcgaagctgtcttacagaagctgaagcagccgtggctactcaggagacctccaccgtcaggctgaaggtcagtagtactgccgtgcggacacagcatacaacgacaagacctgttcctgacacatcacgcttgcccggcgcaactccgggcctgacaacggtggaaatcgttacaatgtcacaccaggccctcggggatgtggctgggagggggaatgagaagaaaccctcaagcgtgcgggccttgagtatcgtgctgcccattgtcctgctcgtgtttctctgtttgggggtgttcttgctatggaaaaattggagattgaaaaatatcaacagtattaattttgacaaccctgtctaccaaaagacgacagaagacgaagtccacatctgccataatcaagatggctactcctatccgtccaggcaaatggtgagtctggaggacgacgtggca

SEQ ID NO: 383 - DNA, 2580 bp, Artificial Sequence
  Description of Artificial Sequence: Synthetic Transcript Sequence
atgggcccctggggatggaaactgaggtggacggtcgcactcctcctagccgccgccggaacggccgtaggggacaggtgtgaaagaaatgagttccaatgtcaggacggtaaatgcatatcctataagtgggtgtgtgacgggtctgcagagtgccaagacgggagcgacgagtctcaagagacctgtcttagcgtcacctgtaagtcaggtgacttttcctgcggaggaagggtaaacagatgcatcccacagttctggcgatgcgacggacaagtggactgtgataatggcagtgatgagcagggctgtccaccaaaaacatgcagtcaagatgagtttaggtgccacgacggaaagtgcattagtcgtcagtttgtgtgtgactcagatcgtgactgcttggatggctcggacgaggcttcttgcccagtgctcacctgtggtcccgcctcctttcaatgcaatagctctacgtgtataccccagctctgggcctgtgataatgacccggattgtgaggacgggagcgatgaatggccacagcgttgtaggggtctctacgtttttcagggagatagctctccctgtagtgcattcgaattccattgcctgtccggcgagtgcattcactcctcttggcgatgcgatggaggccccgattgtaaggataaaagcgatgaagaaaattgtgctgtggcaacctgtaggcccgatgagtttcagtgctccgacgggaattgcatccatgggtcaaggcagtgtgaccgagagtacgactgcaaggatatgagtgacgaagtgggatgcgtgaatgttacgctgtgtgaagggcctaacaagtttaagtgtcattccggcgaatgtattactttagacaaggtgtgtaatatggctagagattgtagggattggtctgacgagccaatcaaagagtgtggaaccgcagagtgcctggataataacggcgggtgctctcacgtctgcaacgatctgaagattggttacgaatgtctctgccccgacggcttccagttggttgctcagaggcggtgtgaggacattgatgaatgccaggatccggatacttgctctcaactgtgcgtgaaccttgaggggggctataaatgccagtgcgaggaaggattccagctggatccacatactaaagcgtgtaaagcagtggggtcaatcgcttatctgttcttcaccaatcgtcacgaggtgcggaaaatgacgctcgatcgatcagagtacacctctttgatccctaatctgagaaatgttgtcgcactggatactgaggtggcaagtaatcgaatctactggagcgatctgtcccagaggatgatttgtagtactcagctagatcgagcccacggagtctcctcctatgacaccgtcatttcacgagatattcaggccccagacggccttgctgtggattggattcactcaaatatctattggacggattcggtccttggtacagtttccgttgcagacacaaagggtgtgaagaggaagaccctctttagggaaaacggctcgaagcctagagctatcgttgtggaccctgtgcatggattcatgtactggacagactgggggactcctgcgaaaattaagaaggggggactgaatggcgtggatatttattccttagttacagagaatatccagtggcccaacgggatcactctggaccttctctctggtagattatactgggttgattctaaacttcattcaatcagtagcatcgacgtgaatggtggcaacaggaagacaattttggaagatgagaagagactggcccaccctttttccttggccgtctttgaggacaaggtgttctggacagatataataaacgaggccatcttcagtgccaacagattgaccggatccgacgttaatcttctggccgagaacctgctgagtcctgaagacatggtcctctttcataacctaacccagcctagaggggtcaattggtgcgaaagaactacgctctctaatggcggctgccagtacctttgtctacccgcgccacagatcaacccacattcaccgaagtttacttgcgcatgccctgacgggatgcttcttgctagggacatgagaagctgtctgactgaggccgaagccgccgtggctacccaagaaacaagcacggtgaggttgaaggtaagcagcaccgcggtgcggacccagcatactacaacgagacccgtgcccgacacatccaggcttccaggggctactccaggcctgacgacagtcgaaatagtgaccatgagccaccaggcccttggtgacgtggccggcagaggtaatgagaagaagccgagtagtgtgcgagcgctttccatagtgctgccgattgtgttgcttgtgttcctctgtttgggagtttttctgctgtggaagaactggaggctcaagaatataaacagtattaactttgacaatccagtgtaccagaagaccaccgaagacgaagtccatatttgccacaatcaggacggctattcatatccaagtaggcagatggtaagcctggaagatgatgtggcc

SEQ ID NO: 384 - DNA, 2580 bp, Artificial Sequence
  Description of Artificial Sequence: Synthetic Transcript Sequence
atgggcccttggggatggaaactccgatggaccgttgctctcctgctcgcagcagcaggcaccgctgtcggagataggtgcgaaagaaacgagttccagtgtcaggacgggaagtgcatctcatacaaatgggtctgcgatgggagcgcagaatgccaagacggaagcgatgagtcacaagagacatgtctgtccgtgacctgcaagagcggagacttcagctgtgggggaagggtgaacaggtgtatcccccagttctggcgatgtgacggccaagtggactgcgacaacggaagtgacgaacaaggatgtccacctaaaacttgcagtcaagacgagtttcgctgccacgatggcaaatgtatcagccggcaattcgtgtgcgactcggaccgggactgccttgatggctctgatgaggcttcttgccccgtcctcacatgtggacccgctagcttccagtgtaacagttcaacatgtattccccagctgtgggcatgcgataacgatcccgactgcgaagatgggagcgacgagtggcctcagagatgccgcggactctacgtgtttcaaggcgacagtagcccctgttcagctttcgagttccattgcctctctggcgagtgcatccatagctcttggagatgcgacggggggcctgactgcaaggataagtccgatgaggaaaactgtgcagttgcaacatgcaggcccgatgagttccagtgtagcgatggaaactgcattcatggcagccgccaatgcgaccgcgaatacgattgcaaagacatgagcgacgaagtcgggtgtgtgaacgttactctgtgcgagggcccaaacaagtttaagtgccattccggggagtgcataacgctggacaaagtctgcaatatggccagggattgtcgggactggagcgacgaaccaattaaagaatgtggaacagccgagtgtctggataacaacggaggatgcagccacgtgtgcaatgaccttaaaattggttacgagtgcctgtgccccgacgggtttcagctggtcgcacaaaggagatgtgaagacatagatgaatgccaagatccagacacctgttcccagctctgcgtgaacctggagggcggttataagtgccaatgcgaagagggattccagttagatccccacactaaggcctgtaaggctgttggcagcatcgcttacctgtttttcaccaacaggcatgaagtcaggaaaatgactctggataggagcgagtacacctcactgatccccaatctccgcaacgtggtggcccttgacacagaggttgcttctaataggatctactggagtgacctgagtcagcgtatgatatgctctactcaactggatcgggcacacggcgtgtcaagctatgataccgtgatcagtcgggatatccaagcgccagatggcttggctgttgattggatacatagcaatatttactggaccgacagcgtacttggtacggtgagcgtggctgacaccaagggcgtgaaaaggaaaacattattccgcgaaaacggaagcaagccacgcgcaatcgtggtggaccctgtgcatggatttatgtattggactgattggggaaccccagctaagatcaagaagggtggactgaacggagtggacatctactctcttgtgaccgagaatattcagtggccgaacggcattaccctggatctccttagtggcaggctgtattgggtcgattctaagttgcattccatcagctccatagacgtgaacgggggaaacaggaagaccatccttgaagatgaaaagagactggcccacccatttagtctggctgtatttgaagataaagtgttttggaccgacatcatcaacgaggcgattttttccgctaatcgtctaactggcagtgatgtgaacttgctggccgagaacctgctttcacctgaagacatggtgctgttccacaacttaacccagccgaggggagtcaattggtgtgagcgcaccacactgtcgaacggcggatgccagtacctttgcctgcctgctccacaaatcaacccacattccccgaagtttacgtgcgcctgcccagatggcatgctgttggccagagacatgcgcagctgtcttacagaggcagaagctgccgttgccactcaggagaccagtactgttaggcttaaagtgagtagcaccgctgtaagaacccagcacacaacaacacggcccgtgccagacacctctagattgcctggagccacccccggtcttaccactgtggaaatagttacaatgtcccaccaggcactcggtgatgtggccggaagaggcaacgagaagaagccaagcagcgtgagagctctgtcaatcgtgttgcctatcgtgctcctggtgtttctgtgtctgggcgtctttttgttgtggaagaactggcgcctgaaaaacatcaactcgattaacttcgacaaccccgtttatcagaaaacaacagaagacgaggttcacatatgtcataaccaagacggatatagttatccctcaaggcaaatggtctccctcgaggatgatgtagca

SEQ ID NO: 385 - DNA, 2580 bp, Artificial Sequence
  Description of Artificial Sequence: Synthetic Transcript Sequence
atgggtccttgggggtggaaattgaggtggacagttgcgttgctgctggcggctgccggcactgccgtcggagataggtgtgaacggaatgagttccagtgtcaagacggcaaatgtatctcttataagtgggtgtgcgatggcagcgccgagtgtcaggacggttctgacgagagtcaagaaacttgtctcagtgtgacctgtaagagtggggatttctcttgtggagggcgcgttaatcggtgcatcccccagttctggagatgtgacggccaggttgattgcgacaatggcagtgatgagcaaggctgtccaccaaagacttgctcccaggatgagttccggtgtcacgacggaaaatgtatcagccggcagtttgtgtgcgattccgatagggattgcctggacgggtccgacgaggcttcatgccctgtgttgacttgcggtccagcctcgtttcagtgcaatagttcaacctgcatccctcagctgtgggcatgtgataacgatccggactgcgaggatggatctgacgaatggcctcagagatgccggggattatatgtattccaaggcgattcctccccttgcagcgccttcgaattccattgtctgtccggggagtgtattcactcctcgtggcgctgtgacgggggcccagattgtaaggataagtccgacgaagaaaactgcgcagtggctacttgcagaccggacgaatttcagtgttcagacggtaattgcatccacggcagccgccaatgcgacagagaatacgactgcaaggatatgtctgatgaggtcgggtgcgttaacgtgaccctgtgtgaaggccccaacaagtttaagtgtcattcgggcgagtgtatcacactggataaagtgtgcaacatggccagagattgtcgagactggtcagatgagccaatcaaagagtgtgggaccgcagaatgcctcgataacaacggtgggtgctcacatgtgtgcaacgatttaaagatcggctacgagtgtctgtgcccagacgggttccagttagtcgcccaacggagatgtgaagatattgatgagtgtcaggaccctgatacttgctcacagctctgcgtgaacttggagggaggctataagtgccagtgcgaagaagggtttcagctcgatccccacacgaaggcttgcaaagcagtcggctccatagcatatctgttcttcaccaaccgtcatgaggtcaggaagatgacccttgacagatccgagtacacatctctgattcccaacctgagaaatgtggtcgctcttgatactgaggtggcatctaaccgcatttattggtctgacctgtctcagcgtatgatatgtagtacacagttagatcgcgctcacggggtttccagttacgataccgtcatcagtcgagatattcaggcaccagatgggctggccgtggactggatacattccaatatttactggaccgattcagtactggggaccgtgtcggtcgccgataccaaaggtgtgaaacgtaagacactgtttcgggagaacggcagcaagccacgggctatagtggtggatcccgtgcatgggttcatgtactggactgattggggcacaccggccaagattaagaaaggggggttgaatggagttgacatatactccctggtcaccgaaaacattcaatggccaaacgggataaccctcgacctgctgtctggacgtctgtactgggttgactccaaactgcattccatttctagcatcgacgtcaacggcggcaatcgaaaaaccattctggaagacgaaaaaagacttgctcatccattcagcctagccgttttcgaggataaggtgttctggaccgatattattaacgaggcgattttcagcgcaaaccgcctaacaggatctgacgtcaaccttctcgctgagaacttactatcaccagaggacatggtcctgttccataacttaacccagccaagaggcgtgaactggtgcgaacgaaccactctcagtaacggaggctgccagtacctatgcctcccggcccctcagatcaacccacactcaccaaagttcacgtgtgcctgtcccgatggtatgctccttgccagagatatgcgaagctgtttgactgaggccgaggcggcagtcgcgacacaggagacttccacggtcagactgaaggtgtcgtctaccgcggtgaggacacagcacacaacaactcgcccagtcccggatacatcacggctgcccggcgctaccccgggcctcaccacagtagagattgtgactatgtctcatcaggctctcggggatgtcgccggcagaggaaatgaaaaaaaaccgtctagtgtgcgtgcgcttagcatagtcctgccaattgtactgctcgtctttctttgtcttggggtgtttctgctgtggaaaaattggcggctgaagaacatcaacagtattaatttcgataatcccgtgtaccaaaaaacaaccgaggatgaggttcatatttgtcacaatcaggatggttactcatacccctcgcgccaaatggtctcactggaagacgacgtggct

SEQ ID NO: 386 - DNA, 2580 bp, Artificial Sequence
  Description of Artificial Sequence: Synthetic Transcript Sequence
atgggcccttggggatggaagctgcgctggaccgtggcgctgctgctggcagccgcggggactgccgtcggtgacagatgcgagagaaatgaattccaatgccaggacggtaagtgcatctcctacaagtgggtgtgcgatggaagcgccgagtgccaagacggtagcgacgaaagccaggaaacgtgtctgtcggtgacctgtaaaagcggagacttctcctgcggaggccgggtcaacagatgtatcccgcagttttggaggtgcgacgggcaggtggattgcgataacggatcagatgagcagggatgcccacctaagacttgctctcaggacgagttcagatgccacgacggaaaatgcatctcgagacaattcgtttgcgattctgaccgggactgcctggacggatctgacgaagcgtcctgcccggtgttgacttgtggcccggcgtcgtttcagtgcaactcgagcacctgcatccctcagctgtgggcatgcgacaatgatccggactgcgaagatgggtccgacgaatggccacagcgctgccggggtctgtacgtctttcagggagattcctcgccgtgctcggccttcgaattccactgcttgagcggagagtgtatccacagttcatggcgctgtgatggagggcctgattgcaaggacaagagcgacgaagaaaactgtgctgtggctacctgccgcccggacgaattccagtgttcagacggaaactgcatccacggatcgcggcaatgcgatcgcgaatacgactgtaaggatatgtccgatgaagtgggatgtgtgaacgtgactctgtgcgagggcccaaataagttcaagtgccactcgggcgagtgcatcaccctggacaaggtgtgcaacatggcacgagattgccgggattggtcggatgaacccatcaaggagtgcggaactgctgaatgccttgacaataatggaggatgcagccatgtgtgtaatgacctgaagatcggctacgaatgcctgtgtccagatggtttccagcttgtggcgcagcggcgctgcgaggacatcgacgagtgccaggatcccgacacttgcagccagctgtgcgtgaacctggaaggaggttacaagtgccagtgtgaggaaggattccagttggaccctcataccaaggcctgtaaggccgtcggatcgatcgcctatctcttctttaccaatcggcacgaggtgcgcaagatgactcttgaccgctccgaatacacctcgctgattcctaacctccggaacgttgtcgctctggatacggaggtggcgtccaatcggatctactggtccgacctgagccaacgtatgatctgctcgacgcaactggatcgcgcacatggcgtgtcatcatacgacaccgtgatctcaagagacatccaggccccagatggcctcgctgtcgactggatccactcaaacatttactggaccgacagcgtgctcggaaccgtgtccgtggccgacactaagggagtgaaacgcaagactctcttcagagaaaacggatcgaaaccacgcgcgatcgtggtggatcccgtccacggtttcatgtactggactgactggggcaccccggcaaaaatcaaaaagggtggcctgaacggagtggatatctattccctggtgactgagaacatacaatggccaaatgggatcactctcgacctcctgtccgggcgcctctactgggtcgactcaaaactccattccatctcgtccatcgacgtcaatggaggcaaccgcaaaactattttggaggatgaaaaacggctcgcgcacccattctcattggccgtgttcgaggacaaagtgttctggacggacattatcaatgaggcgatctttagcgccaacagactgaccggcagcgatgtcaatctcctcgctgaaaacctgctctccccagaggatatggtgctctttcataacctgactcagccgcgaggcgtcaattggtgtgaacgcaccaccctgtccaacggagggtgtcaatacctgtgcctgccggcgccgcaaattaacccccattccccgaagttcacctgcgcttgccctgatggaatgcttctcgcccgggacatgcggtcgtgcctgactgaggccgaagcagccgtggccacccaagaaaccagcaccgtccggctgaaggtatcgtcgaccgcagtgaggactcagcatacgaccactaggcctgtgccagatacctcgcgactgccgggagcaactccgggactcaccaccgtggaaattgtcacgatgtcacaccaagcccttggcgacgtggccggtaggggcaacgaaaagaaaccctccagcgtcagggcactttcgatcgtccttccgatcgtgctcttggtctttttgtgtctgggggttttcctcctgtggaagaactggaggctgaagaatatcaactcaatcaacttcgacaatccggtgtaccaaaagactactgaggatgaggtccatatttgtcacaaccaggatgggtactcatacccgtcaagacaaatggtgagtttggaggacgacgttgcg

SEQ ID NO: 387 - DNA, 2580 bp, Artificial Sequence
  Description of Artificial Sequence: Synthetic Transcript Sequence
atgggaccatgggggtggaagttgcgttggactgtggcactgttgctggcagccgccggcaccgcagtgggcgaccgctgtgagaggaatgaatttcaatgtcaggacgggaaatgtatttcttacaaatgggtctgtgatggatctgccgagtgccaagacggatctgatgagtcccaggaaacctgcctgtcagtgacctgcaagtctggcgattttagttgcggtggtagagttaaccgctgcattccccaattttggagatgcgatggccaggtggactgtgataatggctccgacgagcagggttgtcctccaaaaacgtgctcccaagacgagtttcgttgccacgatgggaagtgcatatcacgccagttcgtctgcgactctgatcgcgactgtcttgacggatctgatgaagcatcatgcccagtcctgacctgtggaccagcctcatttcagtgtaacagttccacatgcattccccaactctgggcgtgcgacaatgatcccgactgcgaggacggaagtgacgaatggcctcagcgctgtcgtgggctgtatgtctttcagggggacagttcaccctgctctgcatttgagttccactgtttaagcggagagtgcattcattccagttggcgttgcgacggagggcctgattgcaaagataaatccgacgaagagaactgcgcagtagctacttgcagacccgatgagttccagtgttccgacggaaattgtattcatggaagccgccagtgcgacagggagtacgactgtaaggacatgagcgatgaagtggggtgcgttaacgtgactctttgcgagggcccaaacaagtttaagtgtcacagtggggaatgtattacactggataaagtctgcaatatggcccgcgactgcagagattggtcagacgagcccattaaagagtgcgggacagcagaatgtctggacaataacggaggatgcagtcacgtatgcaatgatctaaagatcggctacgagtgcttgtgccctgatggatttcagcttgtagcacagcgccgctgtgaagacatcgacgagtgccaggaccctgatacatgtagccagctgtgcgtcaacttagagggaggatataaatgccagtgtgaggaaggtttccaactagatccccatactaaggcctgcaaagcggtggggtctattgcctacctcttcttcacaaatcgccatgaggtcagaaaaatgactctcgatagatccgagtacactagccttatccctaatctcagaaatgtggtcgccctcgatacagaagtggcaagtaatcggatttactggtccgaccttagccaaagaatgatttgttccacccagcttgacagagctcacggggtcagcagctacgataccgtaataagccgcgacatacaggcccccgatggtttagcagttgactggatacactcaaacatttactggaccgactccgtgctaggtaccgtgtcagtcgccgacacaaagggtgtgaaacgcaagaccctctttagagaaaacgggagcaaaccacgagccatcgttgtggatccagtgcacggtttcatgtattggacagactggggtactccagctaaaataaagaaagggggtctaaatggtgtggatatttactctttggtgacagaaaacatccagtggcctaatggcatcacactggaccttctgtccggtagattgtactgggtggactccaaactgcattcaattagctctatagatgtgaatggggggaatcgaaagacaattctggaggatgagaaaagactggcccacccttttagtctggccgtctttgaggataaggtcttttggacagatatcatcaacgaggcaatattctcagcgaatcggctgacgggctctgatgtgaacctccttgccgagaatctcctgtctccagaggacatggtgctcttccataatcttacacagcctaggggcgtcaattggtgtgaacgaacgacgctgtcaaatggcggctgccaatacctgtgtctccccgccccacagataaatccgcactcccccaaattcacttgcgcctgcccggacggtatgttactcgcccgggatatgagatcgtgtctgaccgaggcagaggctgccgtggccacacaagaaactagcacagtacggctaaaggtatcctctacggcggtgcgaacgcagcacaccactacccgtccagtaccagacacatcgcggctgcccggggctaccccaggactgacgactgtcgagatagtgactatgtcccatcaggctcttggggacgtagcgggaagggggaatgagaaaaagccctcgtctgtcagagccctgtctattgtcttgcctattgtgttactggtcttcctgtgcctgggcgtgttcttattatggaagaattggcgccttaaaaatatcaactctatcaacttcgataaccccgtctatcagaagacgactgaggacgaggtacatatttgccataatcaagacggatattcatatccgtccaggcagatggtttccctagaagatgatgtagca

SEQ ID NO: 388 - DNA, 2580 bp, Artificial Sequence
  Description of Artificial Sequence: Synthetic Transcript Sequence
atgggaccttggggttggaagttgagatggacagttgctttactattggctgccgccggaacagcagtaggcgatcgctgtgaaaggaacgaatttcaatgccaggatgggaagtgtatcagctataaatgggtctgtgatggaagcgccgagtgtcaggacggaagtgacgagtctcaggagacatgcttgagcgtgacatgcaagtccggggatttttcctgtgggggtcgggtgaatcgctgtattccacagttctggcgctgtgacggtcaggtggactgtgataatgggtcagatgagcagggatgtcctccaaagacgtgttcccaggatgaatttcgctgtcatgatggcaaatgtattagccgccagttcgtttgtgattctgaccgagattgccttgacggatccgacgaggcatcgtgcccggtgctgacttgtggccctgcaagttttcagtgtaacagttccacgtgtatacctcagttgtgggcatgcgacaacgaccccgactgcgaagatggttccgatgagtggccgcaacggtgcagaggactttatgtgttccagggtgacagttcaccttgttccgcctttgaatttcactgtctgtcaggcgagtgcatccactcatcgtggaggtgtgacggcggccccgactgcaaagataagtccgatgaggaaaattgcgcagtcgctacctgtcggcctgatgagttccagtgcagcgacggcaattgcattcatggcagtcgacagtgcgacagagagtatgactgcaaagatatgagtgacgaggtaggatgtgtcaacgttactctgtgcgagggccccaacaagttcaaatgtcactcgggcgaatgtattacactggataaggtctgcaacatggctcgtgactgcagagactggagtgacgagcctatcaaggaatgcggaacggcggaatgtctggacaataatggggggtgctcacacgtgtgcaacgacctaaagatcgggtatgaatgtctgtgccccgacggcttccagttggtggctcagcggcggtgtgaagatattgacgagtgtcaggaccccgatacctgctcacagttatgcgtgaatctggagggcggctacaaatgccagtgcgaggaggggttccagttggacccccatactaaggcttgtaaggctgtgggttcaatcgcctatttgttttttaccaacagacatgaggtacgcaagatgacattggatagatccgagtacacatcactgatccccaatctgagaaacgttgtggcgctggatacagaggtggccagtaatagaatttactggtcagatctctctcaacggatgatatgctccactcagttggaccgagctcatggtgtgtctagctatgacacggtgatatccagggatatccaggctcctgacggtctcgccgtggactggatacattccaatatctactggacagattcagtcctagggacagtaagcgttgcagatactaaaggcgtcaaacggaaaaccttatttcgagaaaatggctctaaacctcgtgctatcgtcgtggaccctgtgcacggatttatgtattggactgactggggcacccctgctaaaatcaagaagggcggattaaatggcgtagatatatacagcttggtaaccgagaacatccagtggcccaatggcattactctagacttactgtctggccggctctactgggtggacagtaagcttcactcaatctccagcatcgatgtaaacggcggcaaccgcaaaacaattttggaggacgagaagcgactggctcatcccttctccttggcagtcttcgaagacaaggtgttctggactgatatcataaacgaagccatattttccgctaaccggctgacaggcagcgacgttaacctccttgccgaaaatctcctgtcccccgaggacatggtcctgtttcacaatttaacccagcctagaggggtgaattggtgtgaacgaactactctgagtaacggtggctgccagtacctgtgtctgccagctccacagatcaatccacactcacctaagtttacttgtgcgtgtccagatggcatgctattggctcgagacatgcgcagctgcctcactgaggctgaagccgccgtcgccactcaagaaacatctaccgtacgccttaaggtgtctagcacagctgtgcgcactcagcacaccaccacccgacccgtaccagacacatcccggctgccgggagcaacgccggggctcaccactgtggagatcgtgacgatgtcccaccaagccctgggtgatgtggccggtcgtggcaacgagaagaaaccctcctccgtgcgggcgctctccattgtcctgcccatcgtactgctcgtatttctatgcctgggtgtctttctgctgtggaaaaactggcggttgaagaacatcaacagcattaattttgataacccagtgtaccaaaaaaccacagaggacgaggtgcatatttgtcacaaccaggacgggtattcttatccctccagacagatggttagtctggaagatgacgttgct

SEQ ID NO: 389 - DNA, 2580 bp, Artificial Sequence
  Description of Artificial Sequence: Synthetic Transcript Sequence
atgggaccttggggatggaaactgcgttggaccgtggccctgcttctggctgcggccgggactgctgtgggggatcggtgtgagcgcaacgagttccaatgtcaggacggaaagtgtatatcgtacaagtgggtctgcgatgggtcggctgaatgtcaagatgggtccgatgaaagccaagaaacttgtctgtcggttacctgtaagagtggggacttttcctgtggaggtagagtaaaccgctgtattccacaattttggcgctgcgacggacaggtcgattgcgacaacggatcagacgagcaaggatgtcccccgaaaacgtgtagccaagatgagtttaggtgccatgatgggaagtgtattagcaggcagttcgtgtgcgacagcgacagggattgtcttgatggatcggatgaagcatcatgtcctgttctgacttgtggtcccgcatcctttcagtgcaactcgagcacttgtatcccccaactttgggcgtgtgataatgaccctgattgcgaggacggatcagatgaatggcctcagcgctgccgtgggctttacgtgtttcaaggcgatagctccccatgctctgcattcgaatttcattgtctctctggcgagtgcattcactcatcctggagatgtgacggtggaccggattgtaaagataagtccgacgaagaaaactgtgcagtcgcaacctgtagacctgatgaatttcagtgtagcgatggtaactgtatacatggatcgagacaatgtgaccgcgagtacgattgtaaggatatgtccgatgaggtgggatgcgtcaatgtgacgctttgcgaaggtcctaataagttcaagtgtcattcaggagaatgtataactctcgacaaagtgtgcaatatggccagagattgtcgggattggtcggacgagccaatcaaggagtgtggcacggcagaatgcctggacaacaacggtgggtgctcccatgtctgcaatgacctgaagataggatacgaatgcctttgcccggatgggttccaactggtggcacagaggcgttgtgaggacattgatgaatgccaggatcccgacacttgctcgcaactttgtgtaaatctggaaggaggttacaagtgtcaatgcgaggaaggatttcagctggacccacacaccaaggcttgcaaggccgttggttcgattgcatacctctttttcacgaacagacacgaagtgcggaagatgacgctggatcggagcgaatacacctcactgatccctaacctccgtaacgttgtggcactcgatactgaagttgcctcgaatcggatctactggtctgacctgtcgcagaggatgatctgttctacccaactggaccgcgcacatggagtgtcgagctacgataccgtgatcagtagagatattcaggcaccagacggtctggccgtggactggatccattcaaatatctactggaccgattcagtgcttggaaccgtcagcgtggcagacactaaaggtgtgaaacgcaaaaccctctttagagagaatggttctaagccaagggcgattgtggtggatcctgtgcacggcttcatgtattggactgactgggggacccctgctaagattaagaaggggggactcaacggcgtggatatctactcgttggttaccgaaaacattcaatggcctaacggtattactcttgatcttctgtccggccgactttattgggtcgattcgaagctccactccatctcttcaattgatgtgaacggagggaatcgaaaaactattttggaggacgagaagagactcgcacacccgttttcactggcagtgttcgaagataaagtgttttggacggacatcattaatgaagccattttcagcgccaaccgcctcactgggtcggatgtcaatcttctggcagaaaacctcctgagcccagaagatatggtgctctttcacaacttgacccaaccgcgcggtgtgaactggtgcgaacgcaccactctgtcaaatggtggctgccaatacctgtgccttccggccccacagataaacccgcatagccctaagttcacgtgtgcatgtcccgatggaatgctcttggccagagacatgaggtcctgtctgaccgaggcagaagcggcagtcgcgactcaggagacttccaccgtcagacttaaggtgtcctccactgcggtccggacccaacataccactacccgcccagtccctgatacctcccggcttccgggtgcaactcccggtcttacgaccgttgagatcgtgaccatgtcacatcaagcgctgggcgatgtcgcgggaagaggaaatgaaaagaagcccagctcggtgcgagcactttcaattgtgttgcccattgtgctgttggtatttctttgccttggcgtgtttctgttgtggaaaaactggcgactgaagaacataaactctatcaattttgataaccccgtctaccaaaagactactgaagatgaggtgcatatttgtcataaccaggatgggtactcgtacccttcgagacagatggtgagcctggaagatgatgtggca

SEQ ID NO: 390 - DNA, 2580 bp, Artificial Sequence
  Description of Artificial Sequence: Synthetic Transcript Sequence
atggggccgtggggatggaagctgagatggaccgtggcactgcttctcgcagctgctggaacggccgtgggagatcgttgtgagcgcaacgagttccaatgtcaggacggaaagtgcatttcgtacaagtgggtttgtgacggaagcgctgaatgtcaagacggatcggacgagagccaagaaacgtgcctttccgttacctgtaagtcaggtgatttctcctgcggtggaagggtgaaccgttgtattcctcagttttggaggtgtgacggacaagtggactgcgataacggctctgatgaacagggttgtccacctaaaacttgttctcaagacgagtttagatgtcatgacggaaagtgtatctcgagacaattcgtgtgcgattcggacagagattgtcttgatggatcggatgaagcctcgtgcccagtgctgacttgtgggcccgcctcgtttcaatgtaattcgtcaacgtgtattcctcaactctgggcatgtgacaacgaccctgactgtgaggatggtagcgatgagtggccgcaacggtgtcgaggcctgtacgtctttcaaggagatagctcaccttgctcagcgtttgagttccactgtctctcgggtgaatgcatacattcgtcgtggagatgcgacggcggaccggactgtaaagataaatcagacgaagagaattgcgccgtggcaacgtgtaggccagatgaatttcagtgttcagatggaaattgtattcatggttcgcgacagtgtgatcgggagtacgactgtaaagacatgagcgatgaggtggggtgtgttaacgtcactctttgtgaaggcccaaacaaattcaaatgccattcgggagagtgtatcaccctcgataaggtttgtaacatggccagagattgtagggattggagcgatgagcctataaaggaatgcggaactgccgagtgtcttgacaacaacggaggctgttcacacgtgtgtaacgacctcaagattggctacgaatgcctgtgtcctgacggattccagctggtcgcacagcgacgctgtgaagatattgatgagtgccaagatcctgacacttgcagccagctgtgtgtgaatctggagggtggatacaaatgtcagtgtgaagaaggatttcagctcgacccacatacgaaggcatgcaaggccgtgggttcaattgcataccttttcttcaccaacagacatgaggtccggaagatgacccttgacaggtccgaatacacttccctgatccctaatctgaggaacgtggtggcactggatactgaagtcgcctccaacagaatttactggtccgatctttcgcaaagaatgatctgcagcactcagttggatcgcgcccatggcgtgagctcctacgataccgtgatttcgagagacatacaagcacccgacggtcttgcagtcgattggattcactccaacatttactggaccgatagcgtcctgggcactgtgtccgtcgccgataccaagggagtgaagcggaaaactttgttccgcgaaaacggttcgaagcctcgagccattgtggtggaccctgtgcacggttttatgtactggaccgactggggaactccagcaaagattaagaaggggggacttaacggggtcgacatttactcacttgtcactgaaaacatccaatggccaaacggtatcactcttgaccttttgagcggtaggctctactgggtggattccaagctccatagtattagcagtatcgacgtgaacggaggaaacagaaagaccatccttgaagatgaaaagcggctggcacatccgttttcactcgccgtgtttgaagataaagtgttttggactgacatcattaatgaagccatattctcagctaaccggctgactggctcggacgtgaacttgcttgctgagaacctgctgtcgcctgaggacatggtgctttttcataaccttacccagcccagaggcgtgaactggtgtgaacgcactactctcagcaatggtgggtgccagtacctctgtctccctgcacctcagatcaaccctcatagccccaagttcacgtgcgcatgtccggatggaatgctcttggcaagggatatgcgctcctgtcttactgaggcagaagcagcagtggccacccaggaaacttcgaccgtacgccttaaagtctcatcaaccgccgtgcggacccaacacactacgaccagacctgtgcccgatacctcccgcctccctggagcaactcccggactgactaccgtcgaaatcgtgaccatgtctcatcaagccctgggagatgtggcgggccgtggtaacgagaaaaaacctagctcggtgagagccctgtcaatcgtccttccaattgttctcctggtgtttctgtgtctcggtgtgttcctgctctggaagaattggcgtctgaagaacatcaactcgattaacttcgacaatcctgtctaccaaaagactactgaggacgaagtccatatctgtcacaatcaggatgggtacagctacccttcgcggcaaatggtgtcactggaggacgatgtcgca

SEQ ID NO: 391 - DNA, 2580 bp, Artificial Sequence
  Description of Artificial Sequence: Synthetic Transcript Sequence
atgggaccatggggatggaagctccggtggacagtggccctgctgctagccgccgccgggacagctgtgggggatcggtgtgaaaggaacgagttccaatgccaggatggcaaatgtatctcgtataagtgggtctgcgatggatctgccgagtgccaggacggctccgatgagagccaggaaacttgcctatccgtgacctgcaagtccggtgacttctcgtgtggcggaagggtcaacagatgtataccccagttttggcgctgtgatggccaggttgattgcgacaatggatcagatgagcaggggtgtccacctaagacatgttcccaggatgaatttcgctgccatgacggtaagtgtatctcacgtcagttcgtctgtgacagcgatagagattgcttagacggaagtgacgaggcaagttgccctgttcttacttgcggcccagctagtttccagtgcaactcctcaacctgcatacctcagctctgggcctgtgataatgacccggactgcgaggatggatccgacgagtggccacagagatgcaggggtctgtatgtgtttcagggggactcctctccttgctccgccttcgagtttcactgcctttctggcgaatgcatccatagtagctggcgctgcgatggcggtccagactgtaaagataagagcgacgaagagaactgcgccgtagcaacttgtcggcctgacgagtttcagtgcagtgacggcaactgcatacatgggtctaggcagtgtgacagggagtacgactgtaaggacatgagcgacgaggtcggatgtgttaatgtgactctgtgcgagggcccaaataagttcaaatgccactcaggcgagtgcatcacgctcgacaaggtgtgcaacatggccagggattgtcgggactggtccgatgagcctatcaaggagtgcggtaccgcggagtgtttggacaacaacggcggctgctcacacgtgtgcaatgacctcaagattgggtacgaatgcttgtgtccagatggctttcaattggtggctcagcggcgttgcgaggacatcgacgagtgtcaggacccggacacgtgtagtcagctttgtgttaaccttgaagggggctataaatgtcagtgtgaggaaggcttccaactggatccacataccaaggcgtgcaaggctgtaggatctatagcctatttgtttttcactaacaggcacgaagtgaggaaaatgaccctggacaggtccgagtatacttcactcattcctaacctgcgtaacgtcgtcgcactcgacactgaggtggcctctaaccgcatttactggtcggatttgagccagagaatgatctgctcaacacagttggacagggcacacggagtttcgtcatatgatacagtcattagccgggacatccaagcccctgacggtctcgcagttgactggatacactctaatatatactggacagattcagtgcttgggaccgtgagcgtagcagacacgaaaggcgtgaagcggaagacgctgtttcgtgagaacggttcaaaaccccgcgcaatcgtcgtggaccccgtccatgggtttatgtactggaccgactggggtacccccgctaagattaaaaagggtggactcaacggggttgacatttattcccttgtgaccgaaaatatccaatggcctaacgggataacacttgatctattgtctggaagactgtactgggtggactcaaagctccactccatcagctccattgatgttaacggcggaaataggaagaccattctcgaggacgaaaaaagactggcccacccgttctctcttgcagtgttcgaagacaaggttttttggacagacattatcaatgaggctatattttcagctaacaggctaacaggcagcgacgtgaacttactcgcggaaaatctgctgtcccccgaggacatggtactgtttcataatctcacacagcccaggggtgtcaactggtgcgaacgcacaacactatcaaacggcgggtgccagtacctgtgcctaccggctccccagatcaatcctcacagccctaaattcacgtgcgcttgcccagacggtatgctgttggctagagacatgcggagttgtttgactgaggccgaagccgcagtggccacccaggagactagtaccgtccgcctaaaagtaagctccactgccgtccggacgcaacatacaacgacacgacctgtacccgatacatcccgtctccccggtgcaaccccgggactgacaaccgtcgagatcgtgaccatgagtcatcaggcactgggagacgtcgcaggtagaggcaacgaaaagaaaccttcctccgttcgtgcgttgtcgattgtgctgccaatcgtcctccttgtgttcctgtgtctgggtgtgttccttctctggaagaattggcgactgaagaacataaactccataaatttcgataatcctgtatatcaaaaaactacagaagatgaagtacacatctgccataaccaggacggctacagctacccatcccgacagatggtgtcgcttgaagacgacgtggca

SEQ ID NO: 392 - DNA, 2580 bp, Artificial Sequence
  Description of Artificial Sequence: Synthetic Transcript Sequence
atgggcccctgggggtggaagctgcgctggacagtggccttgctcctggcggcagccggcactgccgttggtgaccgctgtgaaagaaacgaattccagtgtcaggatggaaagtgtatctcttataaatgggtatgtgacggctctgccgaatgtcaggacgggtcagatgagtcgcaggaaacctgtcttagcgtcacttgtaagagcggtgacttttcttgcggcggcagagtcaaccgatgcatccctcagttctggcgctgtgacggccaggttgactgcgacaatggctcagacgagcagggttgccccccgaagacgtgcagtcaggacgagtttcgatgccacgacggtaagtgtatctcaaggcagttcgtttgcgattcagatcgcgattgtctggacggctcagacgaagccagctgtcccgtgctgacatgtggaccagccagttttcaatgcaatagctctacgtgcatcccccagctgtgggcctgtgacaatgatccagattgtgaggatggttctgacgagtggcctcaacgatgtcgtgggttgtacgtcttccagggggactcgtcaccctgcagcgctttcgagtttcattgcctctctggggagtgcattcactcatcatggcgttgcgacgggggacctgactgtaaagacaagagcgatgaagagaactgtgctgtcgccacatgcaggccggatgaatttcagtgctccgatggcaactgtattcatggctctcggcagtgtgatcgcgaatacgattgcaaggatatgtccgatgaggtcggctgtgtgaacgtcacactgtgcgaaggaccgaataagttcaaatgccattccggggaatgtattacactcgacaaggtgtgcaatatggcaagggattgccgcgattggagcgacgaaccaattaaagagtgcggcacagccgaatgcctcgataacaacggcggctgctctcatgtgtgcaacgatcttaagattggatacgaatgtctatgccctgatggttttcagctggtggctcaacggcgatgtgaggacatcgatgaatgccaggacccggatacatgttcccaactctgcgtgaatctggaaggcggctacaagtgccagtgtgaagagggttttcagctcgatccacacacaaaggcatgtaaggcagtgggaagcattgcttatctcttttttactaatagacacgaggtacggaagatgaccttggaccgaagtgagtatacctcactcatccccaatctcagaaacgtcgtcgctcttgatacggaggttgcaagcaacaggatttattggtctgaccttagtcagcgcatgatatgttctacccagctggatcgcgcgcacggcgtctcttcctacgatacggtgatttctcgggacatccaggctccagacggattggcggtggactggattcactcaaatatttattggaccgactctgtgctgggtactgtctcagtcgccgatacaaagggtgtgaaacgcaagaccctcttccgtgagaatgggtctaagccccgggctatcgtcgtggaccccgtacacgggttcatgtactggaccgactggggaacacccgccaaaatcaagaagggcggcctgaatggcgtagacatctacagcctggtgaccgagaatatccagtggcctaacgggatcaccctggacctgctttcgggccgactctactgggtggattctaaactgcattccattagtagcatcgatgttaatggaggcaataggaaaacgatcctagaggacgagaagagactcgcccacccctttagtctggctgtgttcgaagacaaggtgttctggacagacatcatcaatgaggccattttctctgctaaccggctgacagggagcgacgtgaacctattggccgagaacttgctgtcccctgaagacatggttctgtttcacaatctgacccagccgagaggcgtgaattggtgcgagagaacaacactatctaacggcgggtgccagtatctatgtctgccagcccctcaaataaacccccactctccaaagttcacgtgcgcctgccccgacgggatgttgttggctagggacatgaggagttgcctcactgaggctgaggctgccgtcgccacccaggaaacttccaccgttcggttaaaggtcagcagtaccgccgtccgcacccagcacaccactacgagacccgtcccagacaccagtcgactccccggcgccactcccggcctgactaccgtggaaatcgttacgatgagtcaccaagccctgggcgacgtggccggaagagggaatgagaagaaaccctccagcgtgcgggctttgtccattgtcttgcctatagttctgctagtgttcctgtgtctcggtgttttccttctgtggaagaactggagactcaagaacattaacagtatcaattttgataaccccgtctatcagaagaccactgaggacgaagtgcacatttgtcacaatcaagatgggtatagttatccgtcgagacagatggtgtcgctggaagacgacgtcgca

SEQ ID NO: 393 - DNA, 2580 bp, Artificial Sequence
  Description of Artificial Sequence: Synthetic Transcript Sequence
atgggaccgtggggttggaaactgcgctggaccgtggcgcttctcttggccgccgctggtaccgctgtgggcgatcgatgcgagcgcaacgaattccagtgtcaggacggcaagtgtataagctacaagtgggtgtgcgacggaagcgctgagtgccaagatggctccgatgagtcgcaggagacctgtctctccgtcacgtgcaagtcaggagacttcagttgtggaggtagagtaaataggtgtatcccgcagttctggcgttgcgatgggcaggtggactgtgataacggcagcgatgaacagggctgccccccaaagacatgctcgcaagacgagtttaggtgtcatgatgggaagtgcatctcccggcagtttgtctgcgactccgatcgagactgtctggacggctccgacgaagccagttgtcctgtgttgacatgcggtcccgcttctttccagtgtaatagttcgacatgcattccacagctgtgggcatgcgataatgaccctgactgcgaggatgggagtgacgaatggccccagcgatgtcgaggcctgtatgtgttccagggcgactcatctccgtgctcagcttttgagttccattgcctgtccggtgagtgtattcattcctcttggcgctgcgatggcggccctgactgcaaggataagagcgatgaggaaaactgtgctgtggctacttgcagacctgacgaatttcagtgttcagatggtaactgtatccacgggtctagacaatgtgatagggaatacgactgcaaggatatgagcgacgaggtgggatgtgtcaacgtgactttgtgtgaagggcctaacaaatttaaatgtcactcaggtgaatgtatcactctagacaaggtctgcaatatggcacgtgactgcagggactggtcagatgaacccatcaaagaatgtggtactgcggagtgcctggataacaatggcggatgttcacacgtctgtaacgacctaaagatagggtatgagtgcttatgtcccgatggcttccaactggtggcccaacgtcgttgcgaggacatcgatgaatgtcaagatccagacacctgctcacagctctgcgtgaatttggagggcggctataagtgtcaatgcgaagagggtttccagctggacccacatactaaggcctgtaaggccgtgggttccatagcgtacctcttttttacaaatagacacgaggttaggaaaatgactctggacaggagtgagtacacgtctctgattccaaatctgcggaacgtcgtagccttggataccgaggttgcatccaaccgcatctattggtctgaccttagtcagaggatgatctgctctacccagctcgacagagcgcacggtgtgagcagctatgatacagtgatttcccgggacatccaagccccagacgggctggccgtagactggattcactctaacatctactggacagattcagtgctcgggaccgtttccgtggcagacactaagggcgtcaagagaaagaccctcttccgagagaatggatctaagccccgagctatcgtcgtcgatcccgtgcacggattcatgtactggacggactggggcacacctgcaaagatcaagaagggcggactgaacggcgtggacatctactcactcgtgacagaaaatatccagtggccgaacggcataactctcgaccttctgtccggccggttatactgggtcgactctaaactgcacagtatctcatccatcgatgttaacggtggcaaccgtaaaaccattttagaggacgaaaaacggctggcacaccccttcagtctcgcagtttttgaagataaggtgttttggaccgacatcatcaatgaggccattttctctgcaaataggctgacaggatctgacgtgaacctgctggccgagaatctgctgtcacctgaggacatggtgttgtttcacaacctgactcaacccaggggcgtcaactggtgtgaacgcaccaccttatctaacggcggctgtcaatacctgtgcttgccagccccacaaataaacccccactcaccgaaatttacatgcgcctgccccgatggaatgctgcttgcccgtgacatgcgaagctgcttgacagaagcagaagcggccgtggcgacacaagaaaccagcaccgtgaggctcaaggtgagctcaacagccgttcgaacacagcacacgacaacccgccctgtgccagacacttctagactgcccggcgccactcctggactaacaaccgtggaaatagtgaccatgtcacaccaggcccttggagacgtggccggacggggaaacgagaagaagccctcctccgtgcgagcactctccattgtgctcccaattgtgctgcttgtttttctgtgtctgggtgtgttcttgctctggaagaattggcggctcaaaaacataaactccataaacttcgataacccagtctatcagaagactacagaggacgaagtacacatctgccataaccaagatggatactcttacccaagcagacaaatggtcagtttagaggacgacgtagcc

SEQ ID NO: 394 - DNA, 2580 bp, Artificial Sequence
  Description of Artificial Sequence: Synthetic Transcript Sequence
atgggcccatggggctggaagctaagatggacagtagccctcctcctggcggcagccggtacagcagtaggagacagatgcgaaaggaacgagttccagtgccaggacggaaaatgtatctcatacaagtgggtttgtgacggcagtgccgagtgccaggacggctccgatgaatcccaggaaacctgcttgtctgtgacctgtaaatctggggatttttcatgcggtggacgtgtgaatagatgcattccccagttttggaggtgtgacggccaggtcgactgtgataatggatccgatgaacagggctgccccccaaagacgtgctcccaggatgagtttagatgtcatgatgggaagtgcatctctcggcagttcgtttgcgacagcgaccgggactgtcttgacggttcagatgaggcctcctgtcctgtgcttacgtgcggcccagccagtttccagtgtaatagttccacctgtatcccccagctgtgggcttgcgataatgacccggattgtgaagatggctctgatgaatggccccagagatgtcgcggattatatgtattccagggagattcctctccctgctccgcatttgaatttcactgtctgtccggtgaatgtattcattcaagctggaggtgtgacggaggcccagattgcaaggacaaatctgacgaggagaattgcgcagtagctacgtgccgacccgacgaattccagtgctccgatggaaattgtattcacggctctcggcaatgcgatcgggaatatgattgtaaggacatgtctgatgaggtgggttgcgtgaatgtaaccctgtgcgaaggccctaacaaatttaaatgccatagcggggagtgtatcacactggataaagtatgtaacatggcccgggactgtagggattggtcggacgagccaattaaagagtgcggtacagccgagtgtttagacaataacggcggctgttctcacgtatgcaacgatctgaagataggctatgaatgcctatgcccagacgggtttcagttggtggctcagaggcggtgcgaggacatcgacgaatgtcaggaccctgacacctgttcgcagttatgtgtgaacctggaaggtgggtataagtgccagtgcgaggaaggattccagctggaccctcataccaaggcctgtaaggccgtaggcagcatagcatacctcttcttcacaaatcggcacgaagtgcggaaaatgaccctcgataggagcgaatacactagcttgatccccaacctccgtaatgtcgtcgcactggacactgaagttgcctcgaaccgaatttactggtccgatctttcacagagaatgatatgcagtacccagcttgacagagcccacggggtctcctcctacgacacagtcatcagtcgcgatattcaagctccagacgggctggccgtggactggatccacagcaacatatattggacagactcggtcctcggtactgtatctgtggctgacaccaaaggtgtgaagcgcaagacactgttccgtgaaaacggctctaagcctcgcgctatagtggttgaccctgtacacggcttcatgtactggaccgattgggggacccccgcaaagattaagaagggcggactaaacggcgttgacatctattcactggttaccgagaatatccaatggcctaatgggattactcttgacctgttgtcaggtcggctgtactgggtggattccaagctgcattctatttcctccatcgacgtcaacggtggaaacagaaaaacgatcctagaagatgagaaacggctagcgcaccctttctctctggcagtgttcgaggataaggttttctggactgatattattaatgaagcgattttcagcgccaatcggcttacgggctccgacgtaaaccttctggccgaaaatctcctctctccggaagatatggtgctgttccacaacttaactcagcctcggggtgttaattggtgtgaaagaaccacgctgagcaatggagggtgtcagtacttgtgcctgccagcgccacaaatcaatcctcacagcccaaaatttacatgtgcttgccccgacgggatgctcctggccagagacatgcgctcatgtctgacagaggcggaagctgctgtggctacacaagaaacctctaccgtccggctgaaagtgtctagcacggccgtgaggacccagcatacaacaacccgcccagtacccgacactagcagattgccaggggccacaccaggactcactaccgtcgagatcgttacgatgtcacatcaagcgttgggagatgtcgctgggaggggcaacgaaaaaaagccaagctctgtaagggccttaagtattgtgctcccaatcgtccttctagtgttcctgtgcctgggcgtgtttctgctgtggaaaaattggaggttgaaaaacatcaattctatcaacttcgacaatccagtctaccagaaaacgaccgaagacgaggtgcacatttgccacaaccaggatggctattcttatccttccagacagatggtgtcccttgaagacgacgtggca

SEQ ID NO: 395 - DNA, 2580 bp, Artificial Sequence
  Description of Artificial Sequence: Synthetic Transcript Sequence
atgggaccctggggctggaagttgcgctggaccgtggcgctcctcttggctgccgcggggaccgcggtgggagatcgttgcgagaggaacgagttccagtgccaggacggcaagtgcatcagctacaagtgggtgtgcgacggctccgccgaatgccaagacggctcagatgaatcccaggaaacttgtctctcagttacttgcaagagcggagactttagctgtggaggtcgagtgaaccggtgcattccgcagttctggagatgcgacggacaggtggactgcgataacgggtcggacgagcaggggtgtccaccgaaaacttgttcacaagacgaattccggtgtcatgacggaaagtgtatcagcagacaattcgtctgcgattcggaccgcgattgcctcgacgggtcggatgaggcatcgtgccccgtgctcacttgcggaccagcctccttccagtgcaattcaagcacctgtataccccagctgtgggcctgcgacaacgacccggactgcgaggatggttccgacgaatggccgcagcgctgccggggactttacgtgttccagggagactcctcaccttgtagcgctttcgagttccactgtctgagcggagaatgcattcactcaagctggcgctgcgacggcgggcctgactgcaaagacaagtcagacgaggaaaattgtgccgtggcgacctgccgcccggatgaattccagtgctctgacggcaactgtatccacggctcgcgccagtgcgaccgggagtacgactgcaaggatatgagcgacgaagtgggatgcgtgaacgtcaccctctgcgagggacctaacaagttcaagtgccactccggagagtgcatcaccctcgacaaagtgtgcaacatggcgcgggattgccgcgactggagcgacgagccgatcaaagagtgcggaacggcggaatgtctggataacaatggaggatgttcacacgtctgcaatgacctcaagatcgggtatgagtgcctctgcccggacgggttccaacttgtcgcgcagcggcgctgcgaggatattgatgagtgccaagaccccgacacctgctcgcaactgtgtgtcaaccttgaggggggatacaagtgtcaatgcgaggaaggattccagctggacccgcatactaaggcgtgtaaagcagtcggatcgatcgcctacctgttcttcaccaaccggcacgaagtccgcaagatgaccttggatcgctcggaatatacctcactcatcccaaacttgagaaatgtggtggccttggataccgaggtggcctccaaccggatctactggtcggacctgtcccaaagaatgatctgctcgacccaactggatcgggcgcatggcgtctcgagctacgacactgtcatctcccgggacatccaggcgccggacggcctcgcagtggattggatccactcgaatatctactggactgattcagttctgggaactgtgtccgtggccgacactaagggagtcaaaagaaagactctctttcgggaaaatggatccaagccacgggccatcgtggtcgatccggtgcatggattcatgtattggaccgactggggtacccctgctaagatcaagaagggaggcctgaacggcgtcgacatctactctctggtgacggagaacatccaatggcccaacggtatcaccctggacctgctgtcaggccgactgtattgggtggacagcaagctgcacagcatctcctcgatcgatgtgaacggtggaaaccgcaagaccattctggaagatgaaaagcgcctggctcacccgttcagcctcgctgtgttcgaggacaaggtgttctggaccgatatcatcaacgaagccatcttttcggcaaaccggctgaccggctccgatgtgaatctgctcgctgagaacttgctgtcaccggaagatatggtcctgttccataacttgactcagcctcgcggcgtcaactggtgcgagcgcaccactctgtcgaacggcggctgccagtacctctgcctccctgcaccacagatcaatccacactcgcccaagttcacctgcgcttgcccggatgggatgttgttggcacgcgatatgcggtcctgtctcaccgaagccgaagccgcagtggcaacccaggagacttccactgtcaggctgaaggtgagctcgacggcagtgagaacccagcacactactacgcgccctgtgccggacacttctaggctgcccggcgcgactcccggactgaccaccgtggaaattgtgaccatgtcacaccaggcccttggtgatgtggcgggtagaggtaacgaaaagaaaccatccagcgtcagggccctgtcaatcgttctcccgatcgtcctgctggtctttctctgcctcggggtgttcctgctgtggaagaattggagactgaagaacatcaattcgatcaatttcgataatcccgtgtaccagaaaactactgaagatgaggtgcatatctgtcacaatcaggacggatactcgtacccatcaagacagatggtttcgttggaggatgacgtggcc

SEQ ID NO: 396 - DNA, 2580 bp, Artificial Sequence
  Description of Artificial Sequence: Synthetic Transcript Sequence
atgggtccgtggggttggaaactgcggtggaccgtcgccctcctgctggctgcggcaggaaccgccgtgggggacagatgcgaacggaatgaatttcagtgtcaggatggcaaatgtatcagctacaagtgggtgtgcgatggttcagcggaatgtcaggacggcagcgacgaatcacaggaaacttgcctcagcgtgacttgcaaatcgggagacttctcgtgcggaggaagggtgaatcgctgtatcccccaattttggcgctgtgacggccaggtggactgtgataacgggtcggacgaacaaggctgtccgcccaagacctgctcacaggatgagtttcggtgccacgacggaaaatgtatcagtcgccaatttgtctgcgactcggacagagactgcctggacggatccgatgaagcctcctgcccggtgttgacctgcggcccagcctcgtttcaatgtaactcaagcacctgtataccgcagctttgggcgtgcgataatgacccggactgcgaggacgggtcagatgagtggccgcaacggtgccggggtctgtacgtgttccaaggagattcctctccttgttcagcattcgaattccattgcctttccggtgaatgcatccattcttcgtggaggtgcgatggaggcccggactgcaaagacaagagcgacgaagaaaactgtgccgtggctacttgccggccggatgagttccaatgcagcgatggtaattgcatccacgggtcccgccagtgcgacagagagtacgattgtaaggatatgagcgatgaagtgggttgtgttaacgtgactctgtgcgaaggaccgaacaagttcaagtgccattccggggaatgtatcactcttgacaaggtctgcaatatggcacgggattgccgcgattggtcagatgagccgatcaaggaatgcggcaccgccgagtgcttggacaataatggcgggtgttcccatgtgtgcaacgacctgaagatcgggtacgaatgcttgtgtccagatggatttcagctcgtggcccagagacggtgcgaggacatcgatgaatgccaggacccggacacgtgttctcagctctgtgtcaatctcgagggaggatacaaatgccagtgtgaggagggcttccagttggacccccataccaaggcgtgtaaggccgtcgggtcaatcgcatatctgttcttcaccaaccggcatgaagtgagaaagatgactctggaccgctcggagtacacttcgctcatcccaaacctccggaacgtggtcgccttggacactgaagtcgcatccaatcgcatctactggtcagacctttcccagcgcatgatctgctcaactcaactggatcgcgctcacggcgtcagctcgtacgacaccgtgatctcacgggacatccaggcaccagacgggctcgcggtggattggatccactcgaatatctactggaccgactcggtgctgggaactgtttcggtcgcagacactaagggggtgaaacgaaagacccttttccgggagaatggttctaagccgcgcgccattgttgtggacccggtgcatggtttcatgtactggactgattggggtactccagccaagatcaagaagggagggctcaacggcgtggacatctactcacttgtgaccgagaacatccaatggccgaatggaatcaccctggacctgttgtcgggtagactgtactgggtcgactcgaaattgcattcgatctcgtcaatcgatgtcaatgggggaaatcggaaaacgatcctggaggacgaaaaacggttggcccacccctttagcttggccgtgttcgaggacaaggtgttttggactgacatcataaatgaggccatcttctccgccaatcgcctgactggcagcgacgtgaacctgctcgcagaaaacctcctgagcccggaagatatggtccttttccacaatcttacgcagcctagaggtgtgaactggtgcgagcgcactaccctgtccaacggaggatgccagtatctgtgcctcccagcgccacaaatcaacccccattcgcccaaattcacctgcgcgtgccctgacggtatgctcctggctagagacatgcggtcatgcctcactgaagcagaggcggccgtggccactcaggagacttccacggtgaggctcaaggtgagctcgactgcagtgaggactcaacacaccactacgaggccagtgcccgatacttcccgcctgccgggcgctactccgggactgactaccgtggagatcgtcaccatgtcgcatcaggctctgggggatgtggcgggtcggggcaacgaaaagaagccgtcatccgttcgcgccctctccattgtgctgccaatcgtgctgctggtgttcctctgtctgggagtctttctgctgtggaagaactggcgactgaaaaacatcaactcgatcaacttcgacaaccctgtgtaccagaaaacgaccgaggacgaagtccacatctgtcataatcaagacggctactcgtatcccagcaggcagatggtgtcgctggaggatgatgtggct

SEQ ID NO: 397 - DNA, 2580 bp, Artificial Sequence
  Description of Artificial Sequence: Synthetic Transcript Sequence
atgggaccatggggctggaagcttcgatggaccgtggcgctactcctcgctgcagcagggactgcagtcggggatagatgtgaacgtaacgaatttcagtgtcaagacgggaaatgcatttcatacaagtgggtgtgtgatgggtcagcagagtgccaggacggatccgatgagagccaggagacgtgcctcagcgttacctgcaagtcaggtgacttctcttgcggaggacgggtgaacaggtgcatcccccaattttggagatgcgatggtcaagtggattgcgacaatggcagtgatgagcagggatgcccgcccaagacctgttcacaagatgaattcagatgccacgatggtaagtgcatatcccgccagttcgtgtgtgattctgatagggactgcttagacggttctgatgaggcgagctgtcctgtactgacttgtgggcccgcctctttccaatgtaacagctccacgtgtatcccccagttgtgggcatgtgataacgacccagattgtgaggatggtagtgacgaatggccccagaggtgcagaggcttatatgtgttccagggagactcatcaccctgttctgccttcgaattccactgtctgagcggcgagtgtatccactctagctggcggtgcgacggcggtccagactgcaaggataagtcagacgaggagaactgcgcagtcgccacctgtagacctgatgagttccagtgctcggatggcaactgtatacacgggagccgccagtgcgatcgagaatacgactgtaaagatatgtcggatgaagtaggatgtgtcaatgtgacactttgcgagggacctaataagtttaagtgtcactccggtgagtgcataacattggacaaggtgtgtaatatggccagagactgtagagactggagcgatgagccgatcaaggagtgcggaaccgctgaatgtctagacaacaatggcgggtgtagccacgtgtgcaacgatctgaaaattgggtacgagtgtctctgcccagatggctttcagctcgtcgcccaaaggcgctgtgaggatatagatgaatgtcaggaccccgatacatgctcgcagttatgtgtgaatctggagggcggctacaagtgtcagtgtgaggaggggttccagctcgatccgcatacaaaagcttgtaaggccgtgggctccattgcctacctcttctttaccaacagacatgaggttcggaagatgaccttggaccggtctgagtacacctctctgatcccaaacttgaggaatgtagtggcactggataccgaggtggcttccaataggatctactggtcggacctctcacagcgcatgatttgctcaacccagctggatcgcgcccacggcgtctctagctacgacactgtgatctccagagatattcaggctcctgacggacttgccgtcgattggatccactctaacatatactggaccgattccgttctcgggaccgtcagcgtggctgataccaagggagtgaaacggaaaaccttattccgcgagaacggatccaaacctcgggccatcgtggtggacccggtgcatggattcatgtactggaccgattgggggactccagccaagattaaaaagggtgggctcaacggggtcgacatttactccctcgttaccgagaacatccagtggccgaacggaattacacttgatcttctgtcaggaaggttatattgggtggactctaaactccatagcattagcagtattgacgtcaatggcgggaaccgaaagaccatcctagaggatgaaaagagactcgcacatccattttctctggccgtgtttgaggataaggtcttttggacagacattataaatgaagcaatatttagtgcaaatcgcctgactggcagcgacgtgaacctgctagcggaaaatctgctgtcaccagaagatatggtcctcttccataatctgacccagccccgtggagtgaattggtgcgagcgcacgactctctcaaatggcgggtgtcaatacttgtgcctgcctgccccacaaattaacccccactctccaaaattcacatgcgcctgtccagatggaatgctcctcgcgagggacatgcgttcttgtttaactgaagccgaagctgcagtagccacccaggaaactagcaccgtccgattaaaagtaagttccactgctgttcgcactcagcatactacaacgaggccagtccctgatacgagcaggcttccaggtgctactccaggccttactacagtcgaaatcgtgactatgtcccaccaggccctcggcgacgtggctgggaggggaaacgaaaagaagcctagtagtgtgagagccttaagcatagtcctgcctattgttcttttggtgtttctatgcttgggggttttcttgctgtggaagaactggagactgaagaatatcaactccatcaacttcgataatcccgtgtaccagaagaccacggaagacgaggtgcacatctgccacaatcaggacgggtattcttatccgagccgtcagatggtgtctcttgaagacgatgtggcc

SEQ ID NO: 398 - DNA, 2580 bp, Artificial Sequence
  Description of Artificial Sequence: Synthetic Transcript Sequence
atgggcccttgggggtggaagctgcggtggacagtggctctcctcctggctgctgccggaactgccgtgggcgatcgatgcgagcgcaacgagtttcagtgccaggatggtaaatgtatctcttacaaatgggtctgtgacgggagcgctgaatgccaggacggatccgatgagtcacaagaaacatgcctctccgtgacctgtaaatctggagactttagttgcggggggcgcgtgaatagatgcatcccacagttttggcggtgtgacggtcaggtggactgcgataatggcagcgatgagcagggttgcccccccaaaacatgcagtcaggatgagttcaggtgccacgatgggaagtgcatatctagacagttcgtgtgcgatagcgatcgcgattgcctggacggttctgacgaagcctcatgccccgtgctgacatgcggccctgcgtccttccagtgtaactcaagtacgtgcatcccacaactgtgggcctgcgacaacgatccagactgcgaggacggaagcgatgaatggccacagagatgtcgcggcctctacgtgttccagggggactcttccccttgtagtgcattcgagttccattgtctcagcggcgagtgtatccactccagctggcgctgcgacgggggacccgattgtaaagacaaatccgacgaggagaactgtgccgttgcaacatgtagaccagacgagttccagtgttccgacggtaactgcatccacggttcccgccagtgtgacagagaatacgactgcaaagacatgtcagatgaggtgggatgtgtcaacgtgacactgtgtgaaggccctaataaattcaaatgccacagcggcgagtgcataactctggataaggtatgtaatatggcccgcgactgtagggactggtctgacgagcctattaaggagtgcggcacagctgagtgcctcgataacaacggcggctgctctcacgtttgtaacgaccttaaaatcggctatgagtgcctttgccccgacggtttccaactggttgcacagcgccgctgtgaagacattgatgaatgtcaggatccagatacgtgcagtcagctgtgtgttaacctcgagggagggtacaaatgtcaatgtgaagaaggattccagctggatccacataccaaggcttgcaaggcagttggctccatagcctatctcttcttcaccaataggcacgaggtacgcaaaatgacgctcgatcggagtgaatatacgtctctgattcccaatctgcgcaatgttgtcgcactggatacagaagtggcttcaaaccggatttattggtctgaccttagccagcgcatgatctgctccactcagcttgacagggcccatggcgtatcatcatatgacactgtgatttcacgggacatccaggcgcccgatggcctggccgttgactggatccacagcaatatctattggacagatagcgtactgggtaccgtgtctgtagccgatacaaagggagtgaagaggaagaccctgtttcgagaaaacgggtctaagcctagggctatcgtagtcgaccctgtccacggttttatgtactggactgactggggcactcccgcaaagatcaaaaagggcgggttgaatggcgttgacatatatagcctggtgaccgagaacatccaatggcctaatggaataacacttgacttgctgagcggcagactgtactgggttgactctaagctgcacagtatttcttctatcgatgttaacggcgggaaccggaagacaatactggaggacgagaaaagattggcccatcctttctctcttgctgtgtttgaggataaagttttttggaccgatattattaacgaagccattttctcagcaaatagactgactggttccgacgtcaacctgctggccgagaacctgttgtctccagaagatatggtcctgtttcacaacctgacacaaccaagaggagtcaactggtgtgagaggacgactctctccaacggcggctgtcagtacctgtgcctgcctgcaccacagatcaaccctcattcccccaagttcacttgtgcctgccccgacggaatgcttttggctcgggatatgcgaagttgccttacagaggcagaggccgcggtcgcaacgcaagaaacatcaacagttcgactgaaggtatctagcaccgccgtccggacacagcacactacaaccagacccgtcccagacaccagtagacttccaggcgctacacccggcttgactacggtggagattgtcaccatgtctcatcaggcccttggagatgttgcgggacgaggcaacgaaaaaaaaccctcttccgtgcgagccctcagcattgtacttccaatcgtgcttctggtgtttctgtgcctgggcgttttcctcctgtggaagaattggcgcctgaaaaatattaactcaattaatttcgacaaccccgtgtaccagaaaacaacagaggacgaggtccatatatgtcacaaccaagatggctattcatacccaagtcgacaaatggtctccttggaggacgatgtggcg

SEQ ID NO: 399 - DNA, 2580 bp, Artificial Sequence
  Description of Artificial Sequence: Synthetic Transcript Sequence
atgggtccgtggggttggaagctgcggtggacggtggccctgctactggcagcagccggcaccgccgtgggtgaccgctgcgagcgcaatgagttccaatgccaggatggcaaatgcatcagctacaagtgggtgtgcgacggctcggcggaatgccaagatggctccgacgagagccaggagacgtgtctgtcggtgacctgcaaaagcggagatttcagctgcggcggccgagttaatcgctgcattccccagttttggaggtgcgatggacaggtggactgcgataatggctccgacgagcaggggtgcccgccaaagacctgttctcaggatgaattccgttgtcatgatggcaagtgtatctctcgccagtttgtctgtgatagcgatagagactgcttggatggcagcgacgaggcaagttgcccagtgctgacgtgtggaccagcttccttccagtgtaattcgagtacgtgcatcccccagctatgggcgtgtgataacgatccagattgcgaggacggcagcgatgaatggcctcagcggtgccgcggactgtatgtctttcaaggcgacagctcgccatgctcggcgtttgagttccattgcctgtccggcgagtgcatacacagctcctggcgttgtgacggcggacccgactgcaaggataagtcggacgaggagaattgtgctgtggcaacgtgccgcccagacgagttccagtgctcagatggcaattgcatccatggctcccggcaatgcgatagagagtacgattgcaaagacatgagtgatgaggtcggctgcgtgaacgttaccctatgtgagggccccaataagtttaagtgccacagcggcgagtgcattaccctcgataaggtctgcaacatggctcgtgactgtagggattggtcggatgagcccatcaaagagtgcggcactgccgagtgcctggataataacggcggctgttcccacgtgtgtaatgatctgaaaataggctatgagtgcctctgcccagacggctttcagttggtggcacagcggcgctgcgaggacatcgatgagtgccaggaccctgacacttgctcccagctctgcgtgaatcttgagggtggctacaagtgccaatgcgaggagggcttccagttggacccccacaccaaagcctgcaaggctgtcggctcgatagcctacctgttcttcacaaaccgacatgaggtccgcaagatgaccctggacagaagcgaatacacatcgctaatccccaacctacgaaacgtggtggcacttgacacagaggttgcatcgaatcgtatatactggagcgacctgagccaaaggatgatttgctccacccagcttgaccgcgcgcatggcgtcagtagctatgacacagtgatcagccgtgacattcaagcccccgacggactggctgtcgattggatccattcgaatatctattggactgattctgtgttgggaactgtaagcgtcgctgataccaagggagtcaagcgcaagacgctatttcgagagaacggcagtaagccacgcgccatcgtggtggacccggtgcacggcttcatgtattggacagactggggaacgcccgccaagattaaaaaaggcggactgaatggcgtcgatatctactctctagttaccgaaaatatccagtggccaaatggtattaccctagatctgctgagtggacgcctgtattgggtggatagtaagctgcactctatctcatctatagatgtgaacggtggcaatcggaaaacaatcttggaggacgagaagcgcttggcccaccccttttccttggcggtattcgaggataaagttttctggaccgatatcataaatgaggcaattttcagtgccaaccgtctgacaggttccgatgttaatctattggctgaaaacctgctgtctccggaagatatggtcctattccacaatttgactcaaccacgtggcgtcaactggtgtgagcgaactactttaagtaacggcggctgccaatacctttgcttaccggcacctcaaatcaacccacatagtccgaagttcacgtgcgcttgccccgacggtatgctgctcgcacgtgatatgcgcagctgtctaactgaagccgaggcggccgtagcgacgcaggagacctccaccgtgcgcttaaaggtctcctctacggcggttcgcacacagcatactaccaccaggccagtacccgacacgtcgaggctgcctggagccaccccgggcttgacgactgtggagattgttacgatgagccaccaggctcttggtgacgtcgcaggtcggggcaacgagaagaagccaagctcggtgcgcgctctgtccatcgttttgcctattgtcctactggtattcttgtgccttggggtatttctcctctggaaaaattggcgcctaaagaacataaattcgatcaatttcgataatcctgtgtatcagaagaccacagaggatgaggtgcacatatgccataaccaggatggctacagctacccctcgcgacagatggtatcactggaggacgatgtggcg

SEQ ID NO: 400 - DNA, 2580 bp, Artificial Sequence
  Description of Artificial Sequence: Synthetic Transcript Sequence
atgggcccttggggttggaaactgcgctggacggtcgccctcttgctggccgctgctgggactgcggtgggcgatcgctgcgagagaaacgaattccagtgtcaggatggaaagtgtatttcctacaagtgggtctgtgatggctcggccgaatgccaggatggctccgatgagagccaggaaacctgcctgagtgtgacctgtaagtctggagacttctcctgcggcgggcgtgtgaatcgctgtattcctcagttctggcggtgtgatggccaagtcgactgtgataatggcagtgacgagcagggttgcccaccaaaaacatgttcccaggatgagttccgatgccacgatggcaaatgtataagccgccaatttgtttgtgattctgacagagattgtctggatggatctgacgaagcaagctgccccgttctgacctgcggcccagcttcttttcagtgcaacagctcaacatgtatcccacaactgtgggcctgcgataatgatcctgactgtgaagatggctccgacgaatggcctcagcgctgccgtggcctgtacgttttccaaggtgattcctcaccgtgctccgcattcgagttccattgtctcagtggtgagtgcatccactcctcttggcgatgcgacggggggccagattgtaaggacaaatctgacgaagagaactgtgcagtggccacatgtcgcccggatgagttccagtgcagtgatggcaattgtatacacgggagccggcaatgtgacagagagtacgactgcaaagacatgagtgatgaggtcggctgtgttaatgtgactctgtgcgagggtcctaataaattcaagtgccactccggcgagtgcattactctcgataaggtttgcaatatggctagagactgccgcgactggagcgatgaaccgataaaggagtgtgggacagcagaatgtctggacaacaatggggggtgttcacatgtgtgtaatgatctaaaaatcgggtatgagtgtctgtgcccggatgggtttcaactggtggcccagaggcgctgcgaggatatagatgaatgccaggaccccgacacatgttcccagctgtgtgttaatctggagggcggttataagtgccagtgcgaagagggttttcaacttgatcctcacaccaaggcctgcaaagccgtgggttcaattgcatacctattttttactaaccggcacgaggtgcgtaaaatgacattggatcgcagtgagtacacatctctaattccaaacctccggaacgtcgtggcacttgacacagaagtagcgtcgaaccggatttattggagtgacctctctcagagaatgatatgctccacacaactggaccgggctcatggcgtgtcatcttatgacactgttatctcacgagatattcaggcccccgacggactagccgtggactggatccattccaatatttactggacagattccgtgctcgggaccgtttcggtggccgatacaaagggcgtgaagcgcaaaacccttttcagagagaatggatcaaagcctagggcaattgtcgtggatcccgtgcacggatttatgtattggacagattggggcactcctgctaagattaagaagggtggcctgaatggcgtggacatttatagccttgtcacagagaacatccagtggcctaacgggatcaccctggacctgctttcagggaggctatattgggtcgactcaaagctgcactccataagctcgatagacgtgaatggggggaaccgtaagacaatattggaagacgagaaacggttggcacacccctttagtctcgccgtgttcgaggataaagtgttctggactgacattataaacgaggcaattttttctgctaaccggctgaccggtagtgatgtgaacttgctggccgaaaacctcttaagtcctgaagacatggttctgttccataacctgacacagcccagaggagtgaattggtgcgagcggaccactctctctaacgggggctgccagtacctgtgtctgccagcaccgcagatcaatccccatagtcctaaatttacgtgcgcttgtcccgatgggatgcttctcgcccgagacatgaggagttgcctcactgaggcagaggctgcagtggccacccaggaaacatccaccgtgcggctgaaagtgtctagcaccgcggttaggacccagcacaccactacacgacctgtgccagatactagccgattaccaggggcgacccccggtctgaccactgtggaaatcgtaactatgagtcaccaggccttgggagacgtggctggccgaggaaacgagaaaaagccctcgagcgttagagccctgtcgatagtcctgccaattgtgctcctggtctttttgtgcctgggtgtttttctcctctggaagaattggcgactaaagaatattaattcgattaacttcgacaatccggtgtatcaaaagactacggaggacgaagtacacatttgtcataatcaggacgggtactcttatccttcccggcagatggttagcctggaagatgatgtggcc

SEQ ID NO: 401 - DNA, 2580 bp, Artificial Sequence
  Description of Artificial Sequence: Synthetic Transcript Sequence
atggggccctggggctggaaacttcggtggaccgtcgcgcttttgctggctgccgcaggtactgcagtgggagatcggtgtgaacgaaatgaattccaatgtcaagacggcaagtgtatttcctacaaatgggtgtgcgatggatcggcagaatgccaggatggttccgatgagtcgcaagagacttgtttgagcgttacgtgtaaatccggcgatttttcatgtggaggacgtgtgaaccgctgtattccgcagttttggaggtgcgacggtcaggtggattgtgacaacggatccgatgagcaagggtgtcctccaaagacctgctcgcaagatgagttccgatgccacgatgggaagtgcatctcacgtcagtttgtgtgtgattcagatcgcgactgtctcgatggaagcgacgaagccagctgtccggttcttacttgcgggccagcatcctttcaatgtaactcttcgacttgtattccccagctgtgggcatgtgataatgatccggattgtgaggatggatcagatgaatggcctcagcgctgtcggggactgtacgtgttccagggtgattcctccccgtgttcagcctttgaatttcactgtcttagcggagagtgcattcacagctcgtggagatgtgatggaggtcctgactgcaaggacaagagcgatgaagagaattgtgcagtggcaacttgccgcccagatgaatttcaatgttcagatggaaactgcattcacggatccagacagtgtgacagagagtacgattgtaaggatatgtcagatgaagttggatgtgtgaacgtgactctttgcgaaggaccgaacaaattcaagtgtcattcaggagaatgtattacgctggataaggtgtgcaatatggcgcgggattgtagagattggtccgatgagcccatcaaggaatgtggtaccgccgaatgtcttgacaacaatggtggttgttcgcacgtctgtaatgacctgaaaattggttacgaatgtctgtgtccagacggctttcaacttgtggcacagcgccgctgtgaagatattgatgagtgtcaagatcccgacacttgtagccagctttgtgtgaatctcgaaggcgggtacaagtgccagtgcgaggagggattccagctggatcctcatacgaaggcatgcaaggcggtgggatcaattgcatatctctttttcaccaaccgccacgaagtccgaaagatgaccctggaccgctcggagtacacttcccttattccaaacctgagaaatgtggtcgcactggacaccgaggtggcatcgaacagaatttactggagcgatctgtcccagaggatgatttgttcgactcagctcgatcgcgctcatggtgtgtcgtcctacgataccgtcatctcgcgcgatattcaagcacctgatggcctggcagtggattggattcactccaacatttactggactgactccgtccttggaactgtctcagtggcagatacgaaaggagtgaagcgcaaaacgctgtttcgtgaaaacggcagcaaaccacgggcaatcgtggtcgaccccgtgcatggatttatgtattggaccgactggggaacccctgcgaaaatcaaaaaggggggactcaatggggttgacatttactcattggtgactgagaacatccaatggcccaacggaattactcttgacctgctgtcgggccggctttactgggtcgattcaaagctccattccatatcgtcgattgacgtgaatggaggtaacaggaaaactattttggaggatgaaaagagacttgcacatcccttttcgctggcagtgttcgaggataaagtgttctggactgatatcatcaatgaagccatcttctcggcaaacagacttaccgggtccgatgtgaaccttctcgccgaaaatctgcttagccccgaggatatggtgctctttcataaccttacgcagcctcggggagtgaactggtgcgaacgtactaccctttcgaatgggggctgtcagtacctttgtctgccagcccctcagatcaacccacattcgcccaagtttacctgcgcctgtcctgacggtatgttgctggccagagacatgcgaagctgtctcaccgaggcagaagcagcagtggctacgcaggaaaccagcactgtccgtcttaaagtgtcgtctactgctgtgagaacccaacacaccactacccggccagtccctgacacttcacgactgcccggagccactccgggacttactactgtcgaaatcgtcacgatgtcccatcaggcactgggggacgttgccggtcgcggaaatgaaaagaagccttcaagcgttagagcactgtcgatcgtgttgccaattgtgctgctcgtattcctgtgcctgggcgtgtttctcctttggaagaattggcgtcttaagaacatcaatagcataaactttgataaccccgtctatcagaaaaccactgaagatgaagtgcacatatgccataatcaagatggttactcgtacccgtccagacagatggtgtccctcgaagatgatgtggca

SEQ ID NO: 402 - DNA, 2580 bp, Artificial Sequence
  Description of Artificial Sequence: Synthetic Transcript Sequence
atgggcccttggggatggaaactgcggtggacagtggcattgttactcgctgccgcagggacagccgttggtgatcgctgtgagcgcaatgaattccagtgccaggatgggaaatgtatttcttacaagtgggtctgcgacgggtcagcagaatgccaagacggttcagatgaaagtcaggagacctgcctgagtgttacatgtaagtctggtgatttctcgtgtggcggtcgggttaatcggtgtatcccacagttctggaggtgcgatggacaggtggactgcgataatgggtccgacgaacagggatgtcctcccaagacttgctctcaggatgagttcagatgtcacgatgggaaatgcatttctaggcagttcgtgtgtgactcagaccgagattgccttgacggctctgacgaagcttcctgccctgtgttgacttgcgggcccgcgtcttttcaatgtaactcaagcacttgtatcccccagctgtgggcctgcgacaatgacccggactgcgaagacggcagtgacgagtggcctcagcggtgtagagggctgtatgtgtttcagggggactcatctccttgctctgcttttgaattccactgcctgagtggggagtgcatccacagttcttggaggtgtgacgggggccctgattgtaaggacaagtctgacgaagagaactgtgctgtggccacgtgcaggccggacgaatttcagtgtagtgacggaaattgcatccacggaagtcgtcagtgcgatcgagaatacgactgcaaagacatgtccgatgaagtgggctgtgttaatgtcaccctctgtgagggtcctaataaattcaagtgccattccggcgagtgcatcacgctcgataaagtgtgtaatatggccagagattgtcgcgattggtccgacgagccgattaaggagtgcggaacagctgagtgcctcgataacaacgggggctgttctcacgtgtgcaatgacttgaagattggatatgagtgtctgtgtcccgatggttttcaattggtggcacagaggcggtgcgaggacatcgatgaatgccaagatcccgatacatgtagtcagctctgtgtgaacctggagggcggttataagtgccagtgcgaagaggggttccaattagaccctcacacaaaggcttgtaaggcggtgggttctatcgcctacctatttttcactaacagacatgaagtgcggaagatgacgctagatcggtccgaatacacctctctcatcccaaatttgcgtaatgtggtggctctcgatactgaagtagccagcaacagaatttattggtctgacctctcccaacgcatgatctgctctacacagttggacagggcacacggtgtgagctcttatgataccgtcatctcacgcgacatccaggcacctgatggtctcgcagtggactggattcattcaaacatctactggacggactccgtgttgggaaccgtgtctgtagctgatacgaagggggtgaaacgaaagacactgtttagagagaacggctccaaaccgcgggctatcgtcgttgatccagtgcatgggtttatgtactggacagactggggaacacctgccaaaattaaaaaaggcggactgaatggcgttgatatctattccttggttactgagaatatccagtggcccaatggcatcaccctggatttattgagcgggagactctactgggtggactctaaattgcattctatctcttccatcgacgtgaatggcggcaaccgcaagactatcctggaagacgagaagcgccttgctcatccgttctcactggcagtattcgaggataaagtgttctggacagacatcatcaacgaggcaatcttctccgctaacaggctcacgggcagcgatgttaatcttctcgctgagaacctgctctctcctgaggatatggtgcttttccacaacctgacccagccccgtggagtgaactggtgcgagcgtacgacgctgtctaacggcggatgtcagtacctttgcctgcccgcccctcagattaacccacactcccccaagtttacgtgtgcgtgtccagatggaatgctcctggctcgtgacatgcgcagttgccttaccgaggcagaggccgccgtggctactcaggagacatcgactgtccgtctgaaagtgtcatcaacggcagtgcggacgcagcacaccactactaggccagtccctgacacaagtcgcctacccggggcgaccccaggactgacaacggttgagattgtcaccatgtcacatcaggccttaggagacgtcgcaggtcgaggcaacgagaaaaaaccgagctcagttagggccctaagcatcgtcctacctatagtcttgcttgtcttcctttgtcttggggtgtttcttctctggaaaaactggagactcaaaaacattaactccataaatttcgacaacccagtgtaccaaaagactaccgaggacgaagtgcacatttgtcataatcaggatggttactcctacccttctaggcagatggtgagcctggaggatgatgtcgcc

SEQ ID NO: 403 - DNA, 2580 bp, Artificial Sequence; identical to SEQ ID NO: 397
  Description of Artificial Sequence: Synthetic Transcript Sequence

SEQ ID NO: 404 - DNA, 2580 bp, Artificial Sequence
  Description of Artificial Sequence: Synthetic Transcript Sequence
atgggtccatggggatggaagttgagatggaccgtggcactgctcctggccgccgctggtactgccgtcggggatcgctgcgaacgcaatgagttccagtgccaggatggaaagtgcatctcgtacaaatgggtgtgtgacggatcggctgagtgccaggacgggagcgatgaatcgcaagagacttgcctgtcagtcacttgcaaatcgggggacttctcgtgcggaggccgtgtgaacagatgcatcccgcaattctggcggtgcgacgggcaggtggactgcgataacggtagcgacgagcaaggatgcccgccaaagacttgctcacaagatgaattccggtgccacgacgggaaatgcatctcccggcaattcgtgtgcgattcggaccgagactgcctggacggttccgacgaggcatcctgtcccgtgcttacttgtggccccgcctcctttcaatgtaactcatcgacttgcatcccgcagctgtgggcttgcgacaacgaccctgactgtgaggacggatccgacgagtggcctcagcgttgtcgcggactctacgtgtttcagggcgactcaagcccatgcagcgccttcgagtttcactgcctgtctggagaatgcattcattcatcatggcgctgcgacgggggacccgattgtaaggacaagtcagatgaagagaactgcgccgtcgcaacctgccgcccagacgaattccaatgctccgacggcaactgcatccatgggagccgccagtgcgacagggaatacgattgcaaagatatgagcgatgaagtggggtgcgtgaacgtgactctgtgcgaaggacctaacaagttcaaatgccactccggagagtgcatcactctggataaagtatgcaacatggctcgagattgccgcgactggtccgatgagccgatcaaagaatgtgggactgcagagtgcctggacaacaacgggggatgttcccatgtctgcaacgacctcaagatcgggtacgagtgcctctgccctgacggcttccagctcgtggcgcagaggagatgtgaggacattgatgaatgccaagatccagacacctgttcgcagctgtgcgtgaacctggaaggaggttacaagtgccagtgcgaagaaggtttccagctcgacccgcacaccaaggcatgcaaggcggtgggaagcattgcataccttttctttactaatcggcacgaagtccggaagatgacgctggaccgctcggaatacacgtcgttgattcctaatctcagaaatgtggtcgccctggatactgaagtggcgtccaacagaatctactggtcagatctgtcacaacggatgatctgcagcacgcagcttgatagagctcacggagtgagctcctacgacaccgtgatcagcagagacatccaagcaccggacgggttggccgtcgattggatccacagtaacatttactggaccgacagcgtgctcggaactgtgagcgtggcggacactaagggagtgaaacgcaagactttgttccgggagaacgggagcaagccacgggccatcgtggtggacccagtccacggattcatgtactggactgattggggaacgccggcgaagatcaagaagggaggccttaacggtgtggacatctacagccttgtcaccgaaaacatccagtggccaaacggaatcacgctggatctgctgtcgggtagactgtactgggtcgactcgaagttgcatagcatatcctcgatcgatgtcaatgggggtaatcgcaagactatcttggaggatgaaaagcggctcgcgcatcctttttcattggcggtgttcgaagataaggtgttctggaccgacatcatcaacgaagcaatctttagcgcaaaccgcctgacggggtcagacgtgaacttgctggcggaaaatcttctttcacctgaagatatggtcctgttccacaacctgacccagccgcggggcgtgaactggtgtgaacgcaccactctgtccaacggaggctgtcagtacctctgcctgccggccccacaaatcaacccgcactcgccaaaattcacttgcgcatgtccggacggaatgctgcttgcccgcgacatgagatcgtgcctcaccgaggcggaagccgctgtcgccacccaggaaacctccactgtcagacttaaggtgagctcgactgccgtgcgcacccagcacaccactacccgcccggtccctgataccagccgcctcccgggtgccactccgggccttaccaccgtggaaatcgtgaccatgtcgcaccaagccctcggagacgtggccggacggggaaacgagaagaagccaagctccgtgagggcactctccattgtcctgccgatcgtcctgctggtgttcctgtgcctcggggtgtttctcctgtggaaaaactggcggctcaagaacatcaattcaatcaacttcgacaatccagtgtaccaaaagactactgaggatgaagtccatatctgccataaccaggacggatactcctatcccagcagacagatggtgagcctcgaggacgacgtggcg

SEQ ID NO: 405 - DNA, 2580 bp, Artificial Sequence
  Description of Artificial Sequence: Synthetic Transcript Sequence
atggggccatgggggtggaagctcaggtggaccgttgcgttgctcttggccgccgccgggacagccgttggggatcggtgtgagcgcaacgagtttcagtgccaggatgggaagtgcattagctataaatgggtatgtgacggcagcgccgaatgtcaggatggatccgatgagtcacaggagacttgcctgtctgtcacatgcaagtcgggagatttcagttgcgggggccgcgtgaataggtgtatccctcagttttggcggtgcgacgggcaggtcgattgtgacaatggctccgatgagcaggggtgccctcctaagacctgctcccaggacgaatttcgatgccacgacgggaaatgcattagccggcagtttgtgtgcgacagcgatcgggactgccttgatggtagcgatgaagcctcgtgccccgtgctgacctgtggccccgcctcttttcagtgcaattccagcacctgcatcccacagctttgggcatgcgacaacgatccagactgtgaggatggatcggacgaatggcctcaaaggtgtcggggcctctatgtgttccagggagattcttcaccctgtagtgcgttcgaattccattgcctgtctggcgagtgtatccactcatcgtggcggtgcgatggaggtcccgattgtaaggacaaatccgatgaagaaaattgtgctgtggccacttgtaggcccgatgagtttcagtgcagtgatggaaattgcatacacggttcacgtcagtgtgatcgcgagtacgattgcaaagacatgagcgacgaagtgggatgtgtgaacgtcacattgtgcgaaggaccgaataagtttaaatgtcattccggagagtgcataaccctggataaagtgtgtaacatggcaagggactgccgcgactggagcgacgagcctataaaggagtgtggcactgccgagtgcctggataataatggcggttgctcgcatgtgtgtaacgatctgaaaatcggatatgaatgtttatgccctgacgggtttcaactcgtagcccagcggaggtgcgaagacatcgatgagtgtcaggatcccgatacatgttctcagctatgtgttaatcttgagggtggatataagtgtcaatgcgaggagggctttcagctggacccccatacaaaagcatgcaaggctgttggcagtattgcttacctgttcttcacaaacaggcacgaggtccgtaagatgaccctcgaccggtcagaatacacttcacttattccaaatctgagaaatgtggttgccctggatacggaagttgcgtcaaataggatttattggtccgatttatctcagagaatgatttgttcaacacaactagacagggcccatggcgtgtcttcatatgataccgtgatcagccgcgacatccaggcacccgatggccttgctgttgactggattcactctaatatttactggacagactccgtgctcggaacagtaagtgtggccgatactaagggagtaaagcgcaaaactctgttccgggaaaacggctccaaaccccgggctatagtcgtagacccagttcatggtttcatgtattggacagactggggtacacctgcgaagatcaaaaaggggggcctaaatggagttgatatctactctctggtgacggagaacatacaatggcccaatgggattactctggatctactgtccggcaggctgtactgggtagactcaaagctccattctatcagctctatcgatgtcaatggcgggaatcggaagaccatcctggaagacgaaaaacgtcttgcacatcctttttcattggcagtgtttgaggacaaagtattttggacagacattatcaatgaggctatcttttcagctaatagactgaccggttctgatgtgaacctcctcgccgagaacctccttagtccggaagatatggtgctcttccacaatctcactcagccccggggggtcaattggtgtgaacgcaccacgctttccaacgggggctgccagtacctttgccttcctgcccctcagattaatcctcactctccaaagttcacgtgtgcctgcccagacgggatgttgctggcccgcgacatgcgatcgtgccttaccgaagcggaggccgctgtggctacacaggaaacctctactgttagattgaaggtgtcgtccacagccgttaggacacagcatacgaccacccgccccgtcccggacacaagccggctgccaggagcaactccagggctgaccaccgtagagattgtaaccatgagtcaccaggccctcggggacgtggccggaagggggaacgaaaaaaaaccatcgtccgtgcgcgctctgtcgatcgtactacccattgtactgctggttttcctctgcctgggcgtattcctattgtggaagaactggcgactgaagaatataaactccatcaacttcgataatccagtttatcagaaaacaacagaagacgaagtgcacatctgtcacaatcaagatggatatagttaccctagtagacaaatggtaagcctggaggacgatgtagcc

SEQ ID NO: 406 - DNA, 2580 bp, Artificial Sequence
  Description of Artificial Sequence: Synthetic Transcript Sequence
atgggaccatggggctggaaacttcgttggaccgtcgcacttctgcttgccgcagcgggaactgccgtgggtgatcggtgcgaacgaaacgaattccaatgtcaagatggcaagtgcattagctacaaatgggtgtgcgatggttcagcggaatgccaagatggatcggatgagtcgcaagagacttgtcttagcgtgacttgcaagagcggagatttttcctgcggtggaagagtgaataggtgcatcccacagttctggcgttgcgacggacaagtcgattgtgataacggatccgacgaacagggttgccctccaaagacctgctctcaagatgagttcagatgtcatgatggaaagtgtatttcaagacagtttgtgtgtgattccgatcgggactgtcttgatggttccgacgaagcctcttgtcctgtgcttacctgtggtcctgcatcctttcaatgtaacagctcaacttgtattccccagctttgggcatgtgataacgatccagattgcgaagatggaagcgatgagtggccgcaacgctgtcgaggtctgtacgtgtttcaaggagactcctccccatgctcggcatttgaatttcattgtctttccggcgagtgtatccacagctcgtggcgctgtgatggaggccctgattgcaaggacaagagcgacgaagaaaattgtgcagtggccacgtgtagaccggatgagtttcagtgtagcgatggaaactgtattcacggatcgagacaatgtgatcgcgaatacgattgtaaagacatgtcggacgaagtgggttgtgtcaacgtgactctgtgtgaaggccccaataagtttaagtgtcattcgggtgaatgcattacccttgacaaggtctgtaacatggcacgagactgccgagattggtctgacgaaccgatcaaggaatgcggtaccgcggaatgtttggataacaacgggggatgttcgcatgtgtgtaatgatcttaagattggatacgaatgtctctgtcccgatggttttcaactcgtggcccaacgaagatgtgaagatatcgatgaatgtcaagatcctgatacctgttcgcaactgtgcgtgaacctggaaggtggctacaaatgccaatgcgaagaaggatttcagcttgatccgcataccaaggcctgtaaggccgtcggaagcatcgcatacctgttcttcaccaaccggcatgaggtgagaaagatgacccttgatcggagtgaatacacttcactcatacctaaccttagaaacgtggttgcccttgatacggaagtggcaagcaaccgcatctactggagcgatctttcccagagaatgatttgctcgactcaactcgaccgagcgcacggggtttcatcctacgataccgtcatttccagggacattcaggcaccagacggactggcggtcgactggattcattccaatatctactggactgactcggtgctcggtactgtgtcagtggcggacactaagggtgtgaagcgcaagacgttgtttcgagagaatggttcgaagccacgggctatagtcgtcgatcctgtccatgggtttatgtactggactgattggggtactccggcaaagattaagaaggggggactgaatggagtggacatttactcccttgtgaccgaaaacattcagtggcctaacgggattaccctggatctgctgtcaggaaggctgtactgggtggatagcaaacttcattccattagcagcattgatgtgaatggtggaaacagaaagaccatcctggaagatgaaaagaggttggcacatcccttttcgctggccgtgttcgaagataaagtcttttggacggacattatcaatgaagcaatcttttccgcaaacagactgacgggttcggacgtcaacctgcttgccgaaaatctgctctccccggaggacatggtgctctttcacaatctcacccaaccacgcggagtgaattggtgtgagagaactactctctcgaatggagggtgccagtatctctgtctgcccgccccgcagataaacccccattcaccaaagtttacttgtgcatgtcctgatggcatgctcctggctagagatatgcgctcctgccttaccgaagcagaagctgccgtggctacccaagaaacctctaccgtgcggctgaaggtgtcctcaactgcagtgcggacccagcatactaccacccgccctgtgccagatacctcgagactgccgggcgccacgccaggacttaccaccgtggagatcgttaccatgtcgcatcaagcacttggtgacgtcgcaggacgcggaaacgaaaagaagccctcgagcgtgagagcactgtcgattgttctgccaattgtcctgttggtattcttgtgtctcggagtgtttctgctgtggaaaaactggagactcaagaacataaacagcatcaattttgacaatcctgtgtaccaaaagactactgaagatgaagtgcacatttgtcacaatcaagacggttacagctacccgagccggcaaatggtcagcctggaggacgacgtggcc

SEQ ID NO: 407 - DNA, 2580 bp, Artificial Sequence
  Description of Artificial Sequence: Synthetic Transcript Sequence
atgggtccgtggggatggaagctgcgttggactgtcgcgctgctgcttgcagcagcaggcaccgcagttggtgatagatgcgagcgtaacgaatttcagtgtcaagatggaaaatgtatcagctacaagtgggtctgtgatggaagcgcggaatgtcaagacggatcagatgaatcccaggaaacctgtctgtcggtgacttgcaaatcgggtgacttctcgtgtggtgggagagtgaatcgatgcatcccccagttttggcggtgcgacggacaggtggactgcgataatgggtccgatgaacaaggttgtccgcctaaaacctgtagccaggacgagttccgctgtcatgatggcaagtgtattagccgtcaattcgtctgtgactcagacagagactgtcttgacggctcggatgaagcatcctgcccagtgcttacctgcggtccggcatcatttcagtgtaattcctcaacctgcatcccacagctttgggcctgtgataacgatcccgattgcgaagatggaagcgatgagtggccccaaagatgccggggactctacgtgttccaaggagactcgtcaccttgttcagcattcgaatttcactgcctttccggcgagtgtattcactcgtcgtggcgctgcgatggagggccagattgcaaggacaagtccgacgaagagaattgtgcagtcgcgacgtgtagacctgatgagtttcaatgctctgatggaaactgcatacacggttcccggcaatgtgatagagaatacgactgtaaagatatgtccgacgaagttggctgcgtgaacgtgactctttgtgagggcccaaacaagttcaagtgtcattcaggtgaatgtataaccctggacaaggtctgtaatatggcccgtgattgcagagactggtcggacgagcctattaaggagtgtggaaccgcagagtgcctggataacaacgggggatgtagccatgtgtgtaatgacttgaaaatcggctacgaatgtttgtgccctgatgggttccagcttgtggcacagcgacgttgcgaagatattgatgaatgccaggaccccgacacttgtagccaactttgtgtcaatctggaaggtggctacaaatgccaatgtgaggaaggctttcaactcgatcctcatactaaagcgtgtaaagccgtcggcagcatcgcttacttgtttttcaccaacagacatgaggttagaaagatgactttggatagatcggagtacacctcgcttattcctaacctccgcaacgtggtggctcttgacaccgaagtggcctcgaacagaatctactggtccgacctctcacagcgtatgatttgctccacccagctcgatcgggcgcatggagtgtcaagctacgatactgtgatttcgagagatatacaagcacctgacggactggcggtggattggatccattcgaatatctattggacggatagcgtgctcgggactgtgtccgtggcagacactaagggtgtcaagcggaaaacgctgttcagggaaaacgggtcgaagccccgggccattgtggtcgatcctgtgcatggctttatgtactggactgattgggggactccagcaaagataaagaagggagggctgaacggagtcgacatctatagcctggtgaccgagaatatccaatggcctaatggaattacgctcgacctcctgtccggccgactttactgggtcgattctaaacttcactctatctcgtccatagacgtcaacggtggtaatcgtaagaccatcttggaggatgagaagaggcttgcccatcccttttcactggctgtgttcgaagataaggtgttttggactgacattatcaatgaggcaattttctccgccaacagactgaccggttctgacgtgaaccttcttgcagaaaacctcctttcgcccgaagatatggtgctgtttcataatctgactcagccaagaggcgttaactggtgtgaaagaacgaccctgtcgaatggcggctgtcagtacctctgtctcccagcaccgcaaatcaatccgcactcgcctaagttcacctgcgcatgcccagacggaatgctccttgcacgggatatgcggtcgtgtctgactgaagcagaagccgcggtggccacgcaggaaacctcgaccgtgcgccttaaggtcagctccaccgctgtgcgtactcaacacaccactacgcggcccgtcccggacacgagccgtctccccggagccaccccaggcttgaccactgtggagattgtgaccatgtcacaccaagcccttggtgacgtcgcgggaaggggaaacgaaaagaagccatcatccgtgagagctctgtccatcgtcctccctattgtgctgctggtgttcttgtgtcttggggtgttcctgctgtggaaaaactggaggcttaagaacataaacagcattaactttgataaccccgtgtaccaaaaaaccaccgaggatgaagtgcatatatgtcataaccaagacggttacagctacccttcacgccaaatggtttctctggaagatgacgtcgca

SEQ ID NO: 408 - DNA, 2580 bp, Artificial Sequence
  Description of Artificial Sequence: Synthetic Transcript Sequence
atgggaccttggggttggaagctgcggtggaccgtggcactgttactcgccgcagctggcaccgctgtgggtgatcgctgtgagcggaacgagtttcagtgtcaggatggtaaatgcatttcctacaagtgggtatgcgatgggagcgcagaatgccaggatggatctgacgaatctcaggagacctgcctctctgttacctgcaagagtggtgactttagctgtgggggtcgtgtgaatagatgcatcccacagttttggcgctgcgatggccaggttgattgtgacaacgggagcgacgagcagggctgcccaccgaagacctgctcccaggatgaattcagatgtcatgacgggaagtgtatttctcgtcagttcgtgtgtgactcagacagagattgtttagacggatcagacgaagcctcatgcccggtattgacctgcggccccgcctctttccaatgtaactcctccacctgcattccgcagctttgggcatgcgataatgacccggactgcgaagacgggtctgacgagtggccacagcgttgtcgcggcctctacgtgttccagggagactccagtccctgtagcgcctttgagtttcattgtttgtccggagagtgcatccatagctcctggcggtgcgatggaggcccggactgtaaggataagagtgacgaagagaattgtgcagtagcaacatgcagaccggatgagttccagtgctcagatggcaattgtatccacggttccagacaatgcgatagggaatacgactgtaaggatatgtccgatgaggtcggttgcgtcaatgtcaccctgtgcgaaggtccaaacaaatttaaatgtcatagtggagagtgcataaccttagataaggtatgcaacatggccagggactgtagagattggagcgatgagcccattaaggagtgtggcacggcagagtgtttggacaataatggcggctgctcccacgtatgcaatgatctgaaaataggttacgaatgtctttgtcctgatggcttccagctggtcgcccagaggcgttgtgaggacatagacgagtgtcaggaccccgatacttgcagtcaactctgcgtcaatctggagggtgggtacaagtgccagtgtgaggaaggatttcaactcgatccgcacacgaaggcatgcaaggcagtgggaagtattgcctatttgttcttcaccaataggcacgaggtgcggaagatgacgctcgatcggagcgagtatacaagtcttattccaaatttgaggaatgtggtcgcactcgataccgaagtagcctccaatcggatttattggagcgacctctcgcagcggatgatttgctcgacacagttggatcgggcccatggtgtgtcttcttacgacaccgtgatttcccgcgacatccaggctccagatggattggccgtcgattggattcattcgaacatttattggacagattccgttctcggcacagtttcagtcgccgataccaagggtgtaaaacgtaaaactctgtttcgcgagaacgggtccaagcctcgggccatcgtggtggaccccgtgcacggtttcatgtattggactgattgggggacaccagccaaaatcaagaaaggggggctgaatggcgtggatatttactctttagtgacggagaatattcaatggcctaacggcatcaccctggacctgctcagcggacggctgtattgggttgatagtaagctgcacagcatctcatcaattgatgtcaatggtgggaaccgcaagacgatactggaagacgagaagagactggctcaccccttttcattggcagtattcgaggataaggtattctggactgatatcattaatgaggcaatcttttctgccaacaggctcacagggagcgacgtcaatttattagctgagaacctgctgtcacccgaggatatggtccttttccataatctcacccagccccgtggtgtgaattggtgcgagagaaccaccctgtcaaatgggggctgtcagtacttatgtttacccgccccccagattaacccccacagtcccaagtttacttgtgcatgccctgacggcatgctgttggccagagacatgcgcagctgcttgacagaggcagaagcagcggttgctacacaagagactagcacagttcggctgaaggtatctagcactgccgtgcgaacccagcacacaacaacccggcccgtccccgacacctcgaggctgcccggcgctacgcctgggctgacaaccgttgagatcgtcacaatgtcccatcaggctctcggtgatgttgctggccgaggaaatgaaaaaaagccttccagtgtacgggcactgagtatcgtgctaccaatcgtgctcttagtgtttctgtgcctcggggtgttccttttgtggaaaaactggaggctaaagaacattaattctatcaatttcgacaatcccgtgtatcaaaaaacaacagaggacgaagtacacatttgccataatcaagacgggtacagttatcccagtcgccagatggtctctttggaggacgacgtggca

SEQ ID NO: 409 - DNA, 2580 bp, Artificial Sequence
  Description of Artificial Sequence: Synthetic Transcript Sequence
atgggaccatggggatggaaattacgatggacagttgctcttttattagcagcagctggtacagctgttggtgacaggtgtgagcgtaatgaatttcaatgtcaagatggaaagtgtataagttataaatgggtttgtgatggttcagcagaatgtcaagatggatcagatgaaagtcaagaaacttgtcttagcgtgacttgtaaaagtggagacttctcttgtggaggtagagttaatagatgtattccacaattttggagatgtgatgggcaagtagattgtgacaatgggtcagatgagcaaggatgtccacctaaaacatgttctcaagatgaatttagatgtcatgatggaaaatgtattagtagacaatttgtatgtgatagtgatagagattgtttagatggaagtgatgaagctagttgtccagttttaacttgtgggccagcaagtttccaatgtaattcaagtacttgtataccacaactttgggcttgtgataatgatccagattgtgaagatggaagtgacgaatggccacaacgatgtagaggtctttatgtttttcaaggagattcatctccatgttcagcatttgaattccattgtttgtctggagaatgtattcattccagttggagatgtgatggaggtcctgattgtaaggataaatctgatgaagaaaattgtgcagtcgcaacttgtagaccagatgaattccaatgttccgatggaaactgtattcatggaagtagacaatgtgatagagaatatgattgtaaggatatgtcagacgaagtaggatgtgtcaatgttacattatgtgaaggacctaataaatttaaatgtcactcaggagaatgtataacattagataaggtttgtaatatggctagggattgtcgagattggtcagatgaaccaattaaagaatgcggaacagctgaatgtcttgataataacggaggatgtagtcatgtgtgtaacgacttaaaaattggatatgaatgtttatgtccagatggatttcaattagttgcacaaagaagatgtgaagatattgacgaatgtcaagatcctgatacttgttcacaactatgtgttaacttggaaggaggatacaaatgtcaatgtgaagaaggtttccaacttgatccacatactaaagcatgtaaagctgtaggatcaatcgcatatttatttttcacaaacagacatgaagtaagaaaaatgacacttgatagatctgaatatacgagtttaataccaaacttacgaaatgtagttgcacttgataccgaagttgcatcgaacagaatatattggtctgatttatcacaaagaatgatttgttcaactcaattggatagagctcatggagtttcatcttatgatactgttatttcaagagacatacaagctccagatggacttgctgttgattggattcattcaaatatctattggacagactctgtcttaggaacagtatctgttgctgatacgaaaggtgtaaaaaggaaaacattatttagagaaaacggaagtaaaccaagagctattgttgttgatcctgttcatggatttatgtattggaccgattggggaacaccagctaaaataaaaaaaggtggacttaatggagttgatatttattcattagttactgaaaatattcaatggccaaatggaattacattagatttattatcaggaagattatattgggttgattcaaaattacattcaatcagttcaattgatgtaaatggaggtaacagaaagactatattagaagatgaaaaacgattagctcatccatttagtttggcagtttttgaagacaaagtattttggacagatattattaatgaagctatctttagtgcaaatcgtctcactggatcagatgttaatcttttagcagaaaatttattgtcaccagaagatatggtactttttcataatcttactcaacctagaggtgttaattggtgtgaaagaactactttatcaaatggaggttgtcaatatttgtgtcttccagctccacaaataaacccacattcaccaaaattcacatgtgcttgtccagatggaatgttattagctagagatatgagatcatgccttactgaagcagaagcagctgttgctactcaagaaacttcaacagtccgattaaaagtaagttcaacagcagttagaacacaacacacaaccacaagaccagttccagacacatcaagattacctggagcaacacctggattaacaaccgttgaaatagttacaatgtctcatcaagcattaggagatgtagctggtagaggaaatgagaaaaaaccatcttctgttagagctttatcaattgtcttaccaattgttcttttagtttttctttgtcttggagttttcttactttggaaaaattggcgtttaaaaaatattaactcaattaattttgataatcctgtttatcaaaaaacaactgaagatgaggttcatatttgtcataatcaagatggatattcatatccatctcgacaaatggtttcattagaagacgatgtagct

SEQ ID NO: 410 - DNA, 2580 bp, Artificial Sequence
  Description of Artificial Sequence: Synthetic Transcript Sequence
atgggaccttgggggtggaagttgcggtggaccgttgcactgttattggcggctgccggaaccgccgtcggagatcgctgcgaacggaacgagttccagtgccaggacgggaagtgcattagctataagtgggtttgtgacgggagtgcagagtgccaggatgggtccgatgagtcacaggagacatgtctctctgtcacgtgtaaatctggtgacttttcttgcgggggcagggtgaatagatgtatccctcagttttggaggtgcgacggacaggtagactgcgataacggatccgatgagcagggctgcccgcccaaaacttgttcccaagatgaattcaggtgtcacgacggcaaatgcattagtcggcagtttgtgtgcgactctgatcgtgactgcttggacggcagtgacgaggcatcatgcccagtactaacttgtggccctgcatcattccagtgcaattcaagcacatgcatccctcagctatgggcttgtgacaatgaccctgactgcgaggatggctcggatgagtggcctcagcggtgtagagggctctatgtgtttcagggggattcatcgccctgtagcgcattcgagtttcactgcctatcaggcgagtgtatccactctagttggcgctgtgacggcggaccggattgcaaagacaagtctgacgaggagaactgcgccgttgcaacgtgcaggccagatgagtttcagtgctctgacgggaactgcattcatgggtcccgacagtgcgatcgagaatacgactgcaaagatatgagcgacgaggttgggtgtgtgaacgtcaccctctgcgaaggtccaaataagtttaaatgccattccggcgaatgtattactttggacaaggtatgcaacatggcacgcgactgtcgcgactggagcgacgaaccaatcaaggagtgtggaactgccgagtgtttggataataacgggggctgctctcatgtgtgtaacgaccttaaaatcgggtatgagtgtttgtgcccagacggattccagctcgtggctcagcgcagatgcgaggacattgatgagtgtcaagaccccgacacttgctcacagttatgtgtcaaccttgagggaggatacaaatgccaatgtgaggaagggttccagctcgatccacataccaaggcttgcaaggctgtgggttcaattgcttatttgttcttcacaaatcgacacgaagtacggaaaatgaccctggataggagtgagtataccagtctgatcccgaacttaagaaacgtggtggcactcgacacagaagtcgcctcaaaccgcatctactggtccgacttatcccaaagaatgatttgttccacacagttggaccgggcccacggagtttcctcatacgataccgttatcagtcgagatatccaggcccccgacggactggcggttgactggatccatagtaatatttattggactgatagcgtacttggaactgtctcagtcgcagacacaaaaggagttaaacggaaaacactcttcagagagaacgggtctaagccacgggctatcgtcgttgatcccgtacacgggtttatgtattggaccgattggggcaccccagcaaagatcaagaagggtggcctcaatggcgtggatatttacagtctggtcactgaaaatatccagtggcctaacgggattaccctcgacttgttgtcagggaggctctattgggtggatagcaagctgcacagcatcagctcaatcgacgtgaacggcggcaaccggaaaactattttagaggatgagaaacggttggcccacccttttagccttgccgtgttcgaggataaggttttctggacggatatcattaatgaggccattttcagtgctaaccgactgacgggatccgacgtgaacctgctggctgaaaacctgctgtcccccgaggacatggtactgtttcacaatctcacgcagcccagaggtgtgaattggtgcgagcgaactacactctctaatggcggctgtcaatatttgtgcctacctgcaccacagatcaatcctcactcgccaaagtttacgtgcgcctgcccagatggcatgcttctggccagggacatgcgatcctgtttgactgaagccgaagcagctgtagccacacaggagacctccactgtgcgtttgaaggtctcgagtaccgccgtgcgtactcagcatactacgactaggccagtgcctgacacgtcacgtctgcccggcgccacgcctggtctgaccacagtagagatagtgacaatgtcgcaccaggccctcggagacgttgcaggccggggcaatgagaagaaaccgagctctgtcagggctcttagtattgtattgcccatcgtcttacttgtattcctatgcttgggagtctttctcctttggaagaattggaggctgaagaacataaatagcatcaattttgataatccagtataccagaaaacgaccgaggacgaagtgcacatatgccacaatcaggacgggtacagctacccatctcgacagatggtatctctcgaagatgacgtggcc

SEQ ID NO: 411 - DNA, 2580 bp, Artificial Sequence
  Description of Artificial Sequence: Synthetic Transcript Sequence
atgggaccttgggggtggaaattaaggtggacagtggcccttcttcttgccgccgccggaactgcagtgggggatcgctgtgagcgaaatgaatttcaatgtcaggatggaaaatgcattagttacaaatgggtatgcgacggatccgccgaatgccaggatggaagtgatgagagtcaagagacatgcctatctgtcacatgtaaatctggggatttctcctgcggagggcgcgtgaataggtgcatcccacagttctggagatgcgatggacaggtcgattgtgacaatgggtcagacgaacagggatgtccacctaaaacttgctcgcaggacgaatttcggtgtcacgatggaaagtgtatcagtaggcaattcgtgtgtgattcagatagggactgccttgatgggtccgatgaagcttcctgtccagtactcacatgtgggcctgcctctttccagtgtaattcatctacttgcatccctcagttatgggcctgtgataatgatccagattgcgaggatggatccgatgaatggccccagcgttgtaggggactgtatgtctttcagggagattcctcaccatgctctgccttcgaatttcattgcctttcaggagaatgcattcactcttcctggcggtgtgatgggggacctgattgtaaagacaaatctgatgaagaaaactgcgcagtagcaacttgccgcccagatgaatttcagtgctctgacgggaactgtattcatgggtcccgacagtgtgatcgtgaatatgattgcaaggatatgtcagatgaagtagggtgcgtcaatgtgacactatgtgagggaccaaataaatttaaatgccactctggagagtgtatcactctagataaagtgtgtaatatggctcgcgactgccgggattggtccgatgagcccataaaagaatgtggaacagctgagtgtctagataacaacgggggatgcagtcatgtatgtaacgatcttaaaataggatacgagtgtctctgtcctgatgggttccagctcgtagcacagcggcggtgcgaggatatagatgaatgtcaggaccctgatacatgctcccagctgtgtgtcaatctcgaagggggatataaatgtcagtgtgaagaaggattccagttagacccacacacgaaggcttgcaaagcggtggggtctatcgcgtatttattctttacaaatcgccatgaggtgagaaaaatgacgcttgatcgctctgagtatacatctctgatccccaatcttagaaatgttgttgctcttgacacagaagtagcctctaatagaatttactggagtgatttatcgcagagaatgatctgcagtacacagctcgatcgggcacatggagtgagttcctatgatacagtgatatctcgcgatatacaggcccctgatggactcgctgtggattggatacattcaaatatctactggacagattctgtgctcggaactgtgtcggtggctgacactaaaggggtgaaaagaaaaacactcttcagggaaaatggatcaaaaccccgggctatcgtcgttgatcccgttcacggatttatgtattggactgattgggggacacctgctaaaatcaagaaaggaggactcaacggggtggatatttactcactcgtcacagaaaacatccagtggcccaatgggataacactagatcttctttcagggaggctctattgggtggattcaaaacttcattctatctcctctattgatgtgaatggaggaaatcggaaaactattctcgaagatgaaaaaagactagcacaccctttctccctggccgtatttgaggataaggtcttctggacagatataattaatgaggccatctttagtgccaaccgcctgacagggtccgacgtgaatctgctggcagaaaatctgctaagtcctgaagatatggtgctctttcataatctgacacagccaagaggagtgaactggtgtgaaaggacaactctatctaacggagggtgtcagtatctgtgcctgccagccccgcaaatcaacccacattccccaaaatttacttgtgcttgtcctgatgggatgctgctggcccgggacatgcgatcatgtctaactgaggccgaagcagcagtggccactcaggaaacatctacagtcagacttaaagtctcttcgacagctgtcaggactcagcatacaactactcggcccgtccccgacacttcacggcttccaggggcaacaccaggactgacgactgtcgaaatcgttacaatgtctcatcaggccctgggagatgtggccgggagggggaacgaaaaaaaaccttcatctgtgcgagctctttccatcgtcttgccaatcgttctgctggtgttcctgtgcctcggggtgtttctcctgtggaaaaattggcggctcaaaaacataaattctataaattttgacaaccctgtctatcagaaaacaactgaggatgaggtacatatatgtcataatcaggacggatattcttatccttcccgccagatggtatctctggaagatgatgtagca

SEQ ID NO: 412 - DNA, 2580 bp, Artificial Sequence
  Description of Artificial Sequence: Synthetic Transcript Sequence
atgggcccgtgggggtggaaactccgatggacagtcgccttgctgctggcggcggcgggaactgcggtcggggatagatgtgagcgcaacgagtttcaatgtcaggacggcaagtgtatttcatacaaatgggtatgcgatggtagcgcggagtgtcaagacggctcggatgaatctcaggagacatgtctctcggtgacttgtaagagtggtgattttagttgcggtgggcgagtcaatcgttgcattccacagttctggcgctgcgacggacaggttgattgtgataatggcagcgacgagcaaggctgcccgcctaagacgtgctcgcaagatgagtttcggtgtcacgatggtaaatgtatctcacgccagtttgtatgcgattcggaccgggactgtctcgatggttctgacgaagcttcgtgccccgtgctcacctgtggtcccgcttcattccagtgtaattctagcacctgcataccccagttgtgggcatgcgataatgatccagattgtgaagatgggtccgacgaatggccccaacgttgccgaggcttgtacgttttccagggagactcatccccatgctcagcctttgagttccactgcctttcaggcgagtgcatccattcttcttggcgttgcgatggcggacctgattgcaaggacaagagcgatgaggaaaattgcgcagtagccacatgtcgcccagacgaattccagtgttcggatggtaattgtatacatggatctaggcaatgcgatcgagagtatgattgtaaggacatgtcggatgaagtcggctgtgttaacgtcacattgtgtgagggacctaataagttcaagtgtcattcaggagagtgcattactttggataaggtttgcaatatggcccgggattgcagagactggtcggacgagcccatcaaggaatgtggtactgcagagtgcctagataacaacggcggatgctcgcatgtctgtaacgatctcaaaatagggtacgagtgtctctgcccagacggattccagcttgtggctcaacggcgatgcgaggacatagatgaatgccaggatcctgacacctgcagccagctgtgtgtgaacctagagggcggatataagtgtcaatgcgaagagggtttccagctcgatccacacactaaggcctgtaaggcagtcgggtcaatcgcgtacctgttttttacgaaccgtcatgaagtccgtaagatgactttggacaggtcggaatacacctctctgatccctaatttacgcaatgtggtggcgctcgacactgaagtcgcatcgaatagaatctattggtcggacctctcgcagcgcatgatttgctccacgcagctcgatcgtgcacatggcgttagctcatatgatacggttatttctcgagatatccaagcaccagacggacttgccgtggattggatccattccaacatttactggactgattcggttctaggcacagtctccgttgcggatacaaagggggtcaagcggaagaccctgtttcgggagaacgggtccaaaccacgggcaattgttgttgatccagtgcatgggttcatgtactggaccgattggggaacccctgctaagattaaaaagggtggtcttaatggagtcgacatctactctcttgttacggagaacattcaatggccgaatgggattaccttggatctcttatccggtagattgtattgggtagatagtaagctacacagcattagttcgatcgatgttaatggtgggaacaggaaaaccatccttgaggatgagaagagacttgctcatcccttctcgttagccgttttcgaggacaaggtcttctggaccgacatcatcaacgaagcaattttttcagctaataggttgacaggctcagacgttaatctcctcgcggaaaatttgttgtctccagaagatatggtcctattccataacctcacccagccccgaggcgttaactggtgcgagaggaccacactgtcgaacggcggttgtcaatacctctgtctgccagcgccccagattaacccgcatagccccaagttcacgtgcgcttgtcctgatggtatgcttctggctcgtgatatgcgaagctgtctgacagaggctgaggctgcagtcgcgacacaggaaacttcaaccgttaggcttaaggttagttccacagccgtcagaacccagcacacgacaactcgaccggtgcccgacaccagcagacttcctggcgctactcctggattgaccactgttgaaatcgtaacgatgtcacaccaagctctcggcgatgtggcaggacgcggaaatgaaaagaagccaagttcagtgagggcgttgagtattgtgcttcccatcgtcctccttgtttttctatgtttaggcgtcttcctgctgtggaaaaactggcggctaaagaacatcaattccattaacttcgataatcccgtatatcaaaaaaccacggaggacgaggtccacatctgtcacaatcaggacgggtatagctacccttctcgccagatggttagccttgaggacgacgtggcg

SEQ ID NO: 413 - DNA, 2580 bp, Artificial Sequence
  Description of Artificial Sequence: Synthetic Transcript Sequence
atggggccctggggctggaaactgcgttggaccgtcgccctgctcctggccgcggccggcacggccgtgggagaccgttgtgaaagaaacgaattccagtgccaggacggaaaatgtatttcatataaatgggtgtgcgatggtagtgcagaatgccaggacggaagcgatgaaagccaagaaacctgtctgtctgtgacatgtaagagtggtgacttttcctgcggtgggcgagtgaaccggtgcatacctcagttttggcggtgtgatggacaggtcgattgtgacaacggcagcgacgaacagggatgccccccaaagacatgttctcaggatgaatttcgctgtcatgacggaaaatgcatcagccgccaattcgtgtgtgactcggaccgtgactgcttggacggctctgatgaggcatcctgtcctgttctcacttgtgggcccgcctcgttccagtgcaactcctcgacatgcatcccacagttgtgggcctgcgataacgatccagattgcgaggatggatctgacgagtggcctcagcgttgtagaggcctctatgtattccagggcgactcttcgccctgctcagcttttgaattccattgcctctctggcgagtgtatccacagcagttggcgatgtgacggggggccagactgtaaggacaagagtgatgaggagaattgcgcggttgctacctgcaggcccgacgagttccagtgttccgacggcaactgtattcacggttccagacagtgcgatcgagaatacgactgtaaggatatgagcgacgaggtgggatgtgtcaacgtgacgctgtgcgaaggaccaaataaattcaaatgccacagcggagagtgcattaccctggacaaggtgtgtaacatggcccgggactgcagagattggtccgatgaacccattaaggagtgtggcacagcggagtgcttggacaacaacggaggatgctcacatgtgtgtaacgacctcaaaattgggtatgagtgcctgtgccctgacggcttccaactggtcgctcaaaggaggtgtgaggatattgacgaatgtcaggaccctgacacctgttcacagttgtgcgtgaacctcgaagggggctacaagtgtcagtgtgaggagggattccaacttgaccctcacactaaggcctgtaaagctgtggggtccatagcctatctgtttttcacaaatcgccatgaggtgagaaaaatgactttggacagatctgaatatacttccctgatcccaaatctgcggaatgtcgtggccctcgataccgaggttgccagtaatcggatatactggtcagacctgagtcagcgaatgatctgctctactcaattagacagggcccacggcgtttcctcgtacgataccgttatctcaagagatattcaggcccctgacggtttagcagtggactggattcactcaaatatttactggacagattcagtcttgggcacagtgtcagttgcggataccaaaggcgtgaagcgaaagactctattccgagaaaacggctccaagcctcgggcaatcgttgtcgaccctgtgcatgggttcatgtattggactgactggggcacccctgcaaaaataaaaaagggtggcctcaatggggttgatatctattcactggtcaccgagaatatccagtggcccaatgggattacccttgacctgctgagtggacgactttattgggtggactctaagctgcacagcatctcctcaatcgatgtcaacggcggcaaccgaaagacgattttagaagacgaaaaacgcctggcccacccattttctcttgcagtctttgaggacaaggtattttggaccgatatcatcaacgaagctatcttcagcgctaatcgcctgaccgggagtgacgtgaacctcctcgcagagaacctcctctctccagaagacatggtcttattccacaaccttactcagccacgcggggttaactggtgtgaaaggacgaccctgagtaacgggggatgtcaatacctgtgcctgccagcgccacaaattaacccccacagtccaaaattcacatgtgcgtgtcccgatgggatgctgctggctcgggacatgagatcgtgcctcacggaagccgaagccgccgttgctacccaggaaacatctaccgtaagactgaaagtcagttctaccgctgttcgcacacaacacacgacaaccaggccagttcccgacacctcccgccttccaggggcaaccccagggctgaccacagtagagatcgtgactatgagtcaccaggccctgggggacgtggctgggagggggaacgaaaaaaagcctagtagcgtgcgcgccttgtcaattgtgttaccgattgttctgctggtgtttttgtgcctcggcgtgttccttctgtggaaaaactggaggcttaaaaatattaacagcatcaacttcgacaacccggtctatcagaagacaacagaagatgaggttcatatctgtcataatcaggacggatattcctacccctcaagacagatggtgtcgctggaggatgatgtggcg

SEQ ID NO: 414 - DNA, 2580 bp, Artificial Sequence
  Description of Artificial Sequence: Synthetic Transcript Sequence
atggggccctgggggtggaaactcaggtggacagttgccctactgctagccgcagccggaactgcagtaggagataggtgtgaaaggaatgaattccagtgccaggatgggaaatgcatttcctataaatgggtgtgtgatgggagtgctgaatgtcaggacgggagtgatgaatctcaggaaacttgtctgagtgtcacttgcaaatctggagattttagttgtggggggcgtgttaatcggtgcatcccacagttttggcggtgtgacggacaggttgattgcgacaatggatcggatgagcagggatgccctccaaaaacttgttctcaggatgaatttcggtgtcatgatggaaagtgtatatctcgacagttcgtttgtgacagtgatcgagattgtcttgatgggtctgatgaagcatcttgtcctgtgttaacatgtggaccagcctccttccagtgtaacagtagtacatgcataccccagctctgggcctgtgataacgatcccgattgcgaagatggatctgatgaatggcctcagaggtgccggggactttatgtgtttcagggggattcctctccatgctcagcttttgaattccattgcctctcaggggaatgtatccactctagttggcgctgcgatggggggcctgattgtaaagataaatccgatgaagaaaactgcgccgttgccacatgtcgacctgatgaatttcaatgcagtgatggaaactgcatccatggaagtagacagtgtgaccgggaatatgattgcaaagacatgtcagatgaagtgggatgtgttaatgtcacactgtgtgaaggacccaacaaatttaagtgccactcaggggagtgcataacactggataaggtttgcaacatggccagggattgtcgggattggagtgatgaacctataaaagaatgcggaacagcagaatgtcttgataacaacggggggtgcagtcatgtatgcaacgatttaaaaatcgggtatgagtgtctatgcccagacgggttccagcttgtggcccagcggagatgtgaagacatcgatgaatgtcaggaccccgatacatgctcgcagctgtgtgtcaaccttgaaggaggatataaatgccagtgtgaagaaggatttcagcttgatcctcacactaaagcctgtaaggccgtgggatccattgcatacctattcttcacaaaccgccacgaggtgcgcaaaatgactctagatcgatccgaatacacaagtttgatacccaatctcaggaacgttgtggcccttgatacagaagtggcctccaatcgtatatattggtcagacttaagtcagaggatgatttgcagtactcaacttgacagggcacatggagtatcatcctacgatacagtaatatcccgggatatccaggcccccgatggactcgctgtagattggatccactctaatatttattggacagacagtgtgcttggaacagtatccgtcgctgatacaaaaggagttaaacggaaaacactatttagagaaaatgggtcaaagcctcgggccatcgtagtggatcccgttcatggatttatgtattggacagattgggggacacctgccaaaataaaaaaaggaggactgaatggagtggatatctattcgttagtaacagaaaatatccagtggcccaatggaataacactcgatctgctgagtgggcggctttattgggttgatagtaaattgcactctatctcttctatcgatgtgaacgggggaaatcgcaaaactatcttagaagatgaaaaacgcctcgcccatcccttcagtcttgctgtgttcgaagataaagttttctggactgatataataaacgaggccatattttcagctaaccgcctcactgggtcggatgtaaatctgcttgcagagaatcttctatcacctgaagatatggtcctgttccacaaccttacgcagcctagaggggtgaactggtgtgagcgaacaactttatccaatgggggatgtcagtatctctgcctacccgccccccagatcaacccccattcccccaaatttacatgcgcctgccccgatggaatgctccttgctagagatatgcgcagttgtctaacagaagcggaagccgctgtggctacacaggaaactagtacagtgaggctgaaagtgtcatctactgcggtccggacacaacacactactacacgacccgtccccgatacatcacgactccccggggctactccagggctaactactgttgaaatagtgactatgtcacatcaggccctcggagatgtcgccgggcgaggaaatgaaaaaaaaccttcatctgtcagggcgctttcaatcgtgctaccaatagtgctgcttgtcttcctctgtctcggagtattcctgctttggaaaaactggcgcttgaaaaatatcaattctatcaacttcgacaatcccgtgtatcagaaaactacagaagatgaagtgcatatctgtcataaccaagatggatattcatatccttcacggcaaatggtctccctagaagatgatgtggca

SEQ ID NO: 415 - DNA, 2580 bp, Artificial Sequence
  Description of Artificial Sequence: Synthetic Transcript Sequence
atggggccttgggggtggaagttgcgatggaccgtggccctgctgctggcggctgccggaactgctgtgggagatcggtgcgaacgcaacgagtttcagtgtcaggatggaaaatgcattagctacaaatgggtctgcgacgggtcggccgaatgccaggatggttccgatgaatcccaggaaacttgtctgagcgtgacttgcaaatcgggcgatttttcatgcggcggccgggtcaaccggtgcattccacagttttggcggtgcgacggacaggtcgactgcgacaacggatccgatgagcagggctgcccaccaaagacctgttcgcaggatgagttccggtgccacgatgggaagtgcatctcccgccagttcgtgtgcgattcagaccgagattgcctcgacggctccgatgaggcttcgtgtccggtcctgacctgcggaccggcttcatttcagtgtaactcttcaacttgcattccccagctgtgggcctgcgataacgatccggactgcgaggacggttccgatgagtggccacaacgctgccggggactctacgtgttccaaggcgactcgtccccgtgtagcgcctttgaattccattgcctgtcgggcgaatgcatccacagctcgtggagatgcgacggcggtcctgattgcaaggataaaagcgacgaggaaaattgtgctgtggcaacgtgccgcccagacgaatttcagtgttccgacggtaattgtattcacggttcccggcagtgcgatcgcgagtatgactgcaaagacatgtctgacgaggtgggctgcgtgaacgtgaccctttgcgaaggacccaacaagttcaagtgccacagtggggaatgtatcaccctggacaaggtttgtaatatggcgcgagactgccgcgattggtcggatgagccgattaaagagtgcggaacggcagagtgcctcgataacaacggtggatgctcacacgtttgcaacgacctgaaaatcggttacgagtgtctttgcccggatggtttccagctggtggcacagcggagatgtgaggacatcgacgaatgtcaggacccggacacttgttcccagctctgtgtgaacctcgaaggaggatacaaatgccagtgcgaggaaggattccagctggatccccacactaaggcatgcaaggccgttggttcaatcgcgtacctgttcttcaccaatcggcacgaagtccgcaagatgactttggaccggtcagaatacacttcgctcattcccaacctcagaaacgtcgtggcgcttgataccgaggtagccagcaaccgcatctactggtcggacctttcacaacggatgatctgcagcacccaactcgatcgcgcgcatggagtttcgagctacgacacggtcatctcccgggacattcaggcgccagacggactggccgtcgactggatccattcaaacatctactggaccgactcggtgctgggaaccgtctccgtggcggacaccaagggtgtcaaacgcaagactctctttagagaaaacggaagcaagcctagagcgatcgtggtcgacccagtgcatggcttcatgtactggacggactgggggaccccggccaagatcaaaaagggaggactgaatggcgtggacatctattcgctggtgactgagaacatccaatggcctaacggcatcactctcgacctcctgtcggggcgtttgtactgggtggattcaaaactgcatagcatatcctccattgacgtgaatggcggtaaccgcaagaccatccttgaggacgagaagcgccttgcacacccattcagccttgccgtgttcgaggacaaggttttctggaccgacatcattaacgaagccatcttctccgcaaaccgcctgaccggctcggatgtgaacctcctggccgaaaatctgctttccccggaggacatggtgttgtttcataacctgactcaacctcggggagtcaactggtgcgagcgcactactctgtctaacggcggatgtcagtacctgtgtttgccggcaccgcaaatcaatcctcactcgccgaagtttacctgtgcctgcccggacggaatgttgctggcccgagacatgagatcgtgtttgactgaggcggaagcggcggtcgccacccaagaaacttcgactgttaggctgaaagtcagctcgaccgcggtgcgcactcaacacaccaccacgcgtccagtgccggatacttcacgcctgccaggtgcaacgccaggactgacgactgtagaaatcgtcaccatgtcccaccaggcactcggtgatgtggccggacgcggtaatgaaaagaaaccgtcatcggtgcgcgctctcagcatcgtgctgcctatcgttttgctcgtgttcctgtgcctgggagttttccttctctggaagaattggaggctcaagaatatcaattccatcaatttcgacaacccggtgtaccaaaagaccaccgaggacgaagtccacatctgccataatcaagacggctacagctatccaagcagacaaatggtaagcctggaagatgacgttgcc

SEQ ID NO: 416 - DNA, 2580 bp, Artificial Sequence
  Description of Artificial Sequence: Synthetic Transcript Sequence
atggggccgtggggttggaagctgagatggactgtggcactgctgcttgcggcagctggtactgcagtcggtgaccggtgtgagagaaacgaatttcaatgtcaagatggaaagtgtattagctacaagtgggtctgtgacggttcagcagaatgccaggacggcagcgatgaaagtcaagaaacctgtctgtcagtgacgtgtaagtcgggggacttctcctgcggtggcagggtcaaccgctgcattcctcaattttggaggtgcgacggacaagtggattgtgacaacggatcggatgaacaaggctgtcccccaaagacgtgcagccaagacgagttcagatgtcacgatggtaaatgtatctcaaggcaatttgtgtgtgactcggacagagattgtttggacgggagcgatgaagcctcttgtccggtgctcacttgtgggccagcttcctttcagtgtaactccagcacctgtatccctcagctttgggcctgtgataatgaccctgactgtgaggatggatccgatgagtggccacaaaggtgtagaggtttgtacgtgtttcagggtgacagctccccctgctcggcattcgaatttcattgtctttcaggggaatgtattcattcgtcctggagatgtgacgggggacctgactgtaaggataagagtgatgaagagaattgcgccgtggcaacgtgccggcctgatgaatttcagtgttcagatggtaactgcatccatggctcgcgacagtgtgatagagagtacgactgtaaagacatgagcgatgaggtgggttgtgtgaatgtgaccctttgcgaaggacccaacaagttcaagtgtcactcgggcgaatgcattaccttggataaggtttgcaacatggcgagagactgccgtgattggtcagatgaacctatcaaggagtgcgggaccgccgaatgtcttgataacaacggtggttgttcgcatgtgtgcaatgatcttaagattggctacgaatgcctctgccctgatgggtttcaacttgtcgcacaaaggaggtgtgaggatatcgacgagtgtcaggacccagatacttgctcccaactttgtgtgaacctcgaaggtggttacaaatgccagtgtgaagagggcttccaactggatccccataccaaagcatgtaaggcagtgggatcgatcgcctacttgtttttcactaatcgccacgaggtccgaaagatgaccctcgatcgctctgaatacacttcattgatccctaatcttagaaacgtcgtcgcactggataccgaagtcgcatctaatcgaatttactggtcagatttgagccaacgcatgatttgctccactcaacttgatcgtgcacatggcgttagctcgtacgacaccgtcatatcgcgagacatccaagcgccagacggacttgctgtggactggattcattcaaacatctattggaccgacagcgtgctggggacggtgtccgtcgctgatactaaaggggtcaagagaaagactttgttccgagagaacggatcaaagcctagggcgattgtcgtggatccagtgcatgggtttatgtattggacggattggggaacgcctgcaaagattaagaaggggggtcttaatggagtggacatttactcgctggtgactgaaaacatacaatggcctaatgggattacccttgaccttctctccggacgattgtactgggtggattccaagctgcattcgatctcctcgatcgacgtgaatggaggaaaccgaaaaaccattcttgaagatgagaaacgtctggcacatccatttagcctcgccgtgtttgaagataaggtgttttggactgatatcataaacgaagcaatattctccgctaataggctgaccggttcggacgtcaaccttctggcggagaacttgctgagccctgaggatatggtcctctttcacaatctgacccagcctagaggcgtcaactggtgtgaaagaactacgctgtccaacggtgggtgtcagtacctctgccttcccgcaccacagattaatccgcactcgcctaagtttacctgcgcatgccctgatggaatgctcctcgcacgagatatgaggtcgtgtctgaccgaagctgaagccgcagtggcgactcaggaaacctcgactgtgaggcttaaagtgagcagcacggcggtgagaacccagcacaccaccaccagacctgtgccggacacctccaggcttccaggagctaccccaggcctcacgactgtcgagattgtcaccatgtctcaccaagccctgggggacgtggcgggcaggggtaacgaaaagaagccgtcaagcgttcgcgcactcagcattgtgctcccaatagtccttctggtgttcctttgcctgggagtgttccttctgtggaaaaactggcgcttgaaaaacatcaattcgatcaacttcgataacccagtgtaccagaaaactaccgaggacgaggtccacatttgtcataaccaagatggatactcctatccctcccgtcagatggtcagccttgaggacgatgtcgcc

SEQ ID NO: 417 - DNA, 2580 bp, Artificial Sequence
  Description of Artificial Sequence: Synthetic Transcript Sequence
atgggtccttggggatggaagctccgctggacggtcgccctcttgcttgccgccgccggtactgcagtcggtgaccggtgtgagcggaacgaatttcaatgccaagacgggaagtgtatttcatacaagtgggtgtgtgacggatcagccgaatgtcaggatggttcggatgaatcgcaagaaacgtgcctttcagtcacctgtaaatcgggagacttttcgtgtggaggacgcgtgaacagatgtataccgcaattctggcgttgtgacgggcaagtggattgtgataacggcagcgatgaacaaggatgtccccctaagacctgctcccaagatgaatttagatgtcatgatggaaaatgcattagtcgacagtttgtctgtgacagcgatcgtgattgtcttgatggctccgatgaggcatcttgtccagtgctcacgtgtggcccggcttccttccagtgtaacagctcaacttgtataccccaactgtgggcatgcgataacgatccagattgtgaggacggctcggatgagtggccacaaagatgccggggcttgtacgtgtttcaaggagacagctcgccatgttcggccttcgagtttcactgtctttcgggtgagtgcatccattcgtcatggagatgcgacggtgggcctgattgtaaggacaagagcgatgaagagaattgtgcagtcgcaacctgccgcccggatgaatttcagtgctctgacggtaactgtatccatgggagccgccaatgtgatcgtgaatacgattgcaaagacatgtcagatgaagtaggttgcgtgaatgtgacgctttgcgaaggccctaataagtttaagtgtcattccggtgaatgcattaccctggataaagtttgcaatatggcccgagactgtagggattggtccgatgagcctatcaaggagtgcggcaccgcggaatgtctggacaataacggtggttgctcacatgtctgtaatgacttgaagattggatatgaatgtctttgtcctgatggatttcaactggtggcacagcggcgctgcgaggacattgatgaatgtcaagaccccgacacctgctcgcagctgtgcgtcaacctggaaggtggatacaaatgtcagtgtgaagagggattccaacttgatcctcataccaaggcgtgcaaggcagtgggatcaattgcataccttttcttcactaataggcacgaagtgagaaagatgacgctggataggtcggaatacaccagcctgatcccaaaccttagaaacgtggtcgccttggacactgaagtggcgtcaaatcgcatttactggtccgacttgtctcaacggatgatttgctcgactcagctggatagagcacacggtgtcagttcttacgacaccgtgatctccagagacatccaggcccccgatggcctggccgttgattggatccattccaacatttactggaccgattctgtgctcggaactgtgtccgtcgcagatactaagggtgtgaagcgtaagaccctctttagagagaacggttccaaaccgcgagcaatcgtcgtggatccagtgcatggattcatgtactggaccgactgggggactccagccaagatcaaaaaggggggcctgaatggcgtggacatttactcacttgtgaccgaaaacattcagtggcctaatggaattactcttgatctgctctctggtcgcctgtactgggtcgacagcaaactgcattcgataagctccatcgatgtgaacggtgggaaccgaaagactatccttgaagatgaaaagagactggcacaccctttttctctcgcagtgtttgaagataaagtgttttggaccgatatcataaatgaagctatcttttccgcaaatcgtcttaccgggtctgatgtaaacctcctggcggagaatctgctgtcgcccgaggacatggtcctgtttcacaatcttacgcagccccgaggggtcaactggtgtgaacggactactctcagcaacggcggatgccagtacttgtgcctccctgcacctcaaatcaacccccactcgcccaagttcacctgcgcttgcccagacggcatgcttcttgcaagggatatgagatcgtgtctcaccgaagctgaggcggcggtcgccacccaggaaacctcgactgtgagacttaaagtctcatccaccgcagtgaggacgcagcataccaccacccgcccagtgcctgatacctcacgactccccggagcaactccaggactgaccactgtggaaatagtgactatgtcacaccaggcactgggtgatgtcgcaggtaggggcaacgagaaaaagccaagctccgtgagagcgttgtctattgtgcttcctattgtccttctcgtgtttctgtgtctgggagtgttccttctttggaagaactggcggctcaagaacattaactcaataaacttcgataatccagtataccagaaaacgactgaggatgaggtccatatttgtcataaccaagatggatattcctacccttcgcgccagatggtgtcactggaggatgacgtcgca

SEQ ID NO: 418 - DNA, 2580 bp, Artificial Sequence
  Description of Artificial Sequence: Synthetic Transcript Sequence
atgggcccttggggatggaagttgcgatggactgttgccttactgttagccgctgctggtactgcagttggcgacagatgcgagcgaaatgaatttcaatgtcaggatggaaagtgcatctcatacaagtgggtttgcgatggttcggctgaatgtcaggatggaagtgatgagtcacaagaaacctgtctctcagtgacctgcaaatcgggcgatttctcttgtggcggtcgagttaatcgatgcattccacaattctggagatgtgatggtcaagttgattgcgacaacggaagcgatgagcagggctgtccccctaagacttgtagccaggacgaatttaggtgtcacgacgggaaatgcatatctaggcaattcgtctgcgactctgatagagactgcctggacggttcagacgaagctagctgtcccgtgctcacctgtggacccgcttcgtttcaatgtaattccagtacttgtatcccgcaactttgggcatgcgataacgatccggattgtgaagacggttcggatgaatggccccaacgatgccgagggttgtacgtgttccaaggtgactcatctccttgttctgccttcgaatttcactgcctcagtggtgagtgcattcattcatcgtggagatgtgatggaggacctgattgcaaagataagtccgatgaagaaaactgtgctgttgcgacatgtcggcctgatgagtttcagtgtagcgatggaaattgcattcacgggtccagacaatgtgatcgcgaatacgattgtaaggatatgtccgacgaggttggatgcgtcaatgtgaccttgtgcgagggtcccaacaagttcaaatgccactctggtgaatgtataactctggataaagtttgcaacatggctagggactgcagagattggtctgatgagcctattaaggaatgtggaacagccgaatgtttagacaataacggtggctgtagtcatgtatgcaatgatcttaagatcggttatgaatgcttatgtcccgatggctttcaacttgttgcccaaagaagatgcgaagacattgatgagtgtcaggatccagatacttgcagtcagctttgcgttaaccttgagggcggttataaatgccagtgtgaggaaggatttcagctagatcctcataccaaagcttgcaaggccgttggatcgattgcgtatctttttttcaccaatagacatgaagtacggaaaatgacactcgatcgtagcgaatatacatcattaattccaaatctccgtaacgtcgttgctcttgatacagaggtggctagtaataggatctattggtcggatttgagccaaaggatgatctgttctacccagctggatcgagcacacggagtttcctcttatgatacagtgatcagtcgggatattcaagcccccgacggcttggctgttgactggatccattcaaatatatattggacagatagcgtacttggtactgtttctgttgctgatactaaaggagtgaaacgtaagactttgtttagggagaatggatcgaaacccagagcgatagttgtcgatcctgtgcacggtttcatgtactggaccgattggggaactccagctaaaattaaaaaaggagggttgaacggcgttgacatctactcgttagtgactgaaaacattcagtggcctaatggtatcactttagatcttctctcaggaaggttgtactgggtggatagcaagcttcactccatcagctctattgatgtcaacggaggaaatcgaaagactattctagaagacgaaaaacgtcttgctcacccattctctctggccgtgttcgaagataaggttttctggactgacataataaatgaggctattttctctgctaaccgactaacgggatctgacgttaatctcctagctgagaatttgcttagcccggaggacatggtgctcttccataacttgactcagcccaggggcgtcaactggtgcgagcgtacgacgctgtctaatggtggttgccagtacctctgtttgcctgcaccacaaattaatccgcacagcccaaagtttacatgcgcttgtccagatggaatgcttttggcgagggatatgagaagttgtttaaccgaggccgaggctgctgttgcgacacaagaaactagcacggtccgtttgaaagtaagttcaactgccgtccgtacgcagcacaccacgaccagaccagtcccagataccagtcgtctccctggtgccacaccggggctaactacggtggagattgttaccatgtcccatcaagcgttgggtgacgttgcaggccgcggcaatgaaaagaaaccttcatctgttcgagctctctcaatcgttctccctatagttctgttggtgtttctttgcctgggtgtcttcttgctttggaaaaactggcgcttgaagaacattaactctattaattttgacaacccagtttatcagaaaaccaccgaagatgaggtccacatatgccataatcaggatggctattcctatccaagccgtcagatggtgtcattagaggacgacgtagca

SEQ ID NO: 419 - DNA, 2580 bp, Artificial Sequence
  Description of Artificial Sequence: Synthetic Transcript Sequence
atggggccctggggctggaagttgcgctggacagtcgcgttgttactcgctgcagccgggacagcagtgggggaccgttgtgaacggaatgagttccaatgccaggacggaaagtgtatttcatataaatgggtgtgtgatggtagtgctgagtgccaagacggtagcgacgagtcacaagagacttgtctgtctgtgacctgcaaatccggggattttagttgtggcggcagagttaaccggtgtataccacaattctggagatgcgatgggcaagtcgactgcgacaacggttcggatgagcaaggatgcccccctaaaacatgtagccaggatgagtttcggtgtcatgacgggaagtgcatttcgagacagttcgtgtgcgacagcgacagggattgtttggacggctctgatgaagcatcttgcccagtgctgacatgtggtcccgcgagcttccagtgcaactccagtacttgcatccctcaactgtgggcctgtgacaatgatccagactgtgaagacggctctgacgagtggccacagagatgccgcggtctctatgtgttccaaggcgatagttccccctgcagcgcatttgagtttcattgtctcagcggagagtgcatccacagttcgtggcggtgcgatggaggccccgactgcaaggacaagtccgacgaggagaactgtgcagtcgctacatgccggccggatgagtttcagtgcagcgacgggaattgcatccacggatctcggcagtgcgatcgggagtacgattgtaaggatatgagtgatgaggtgggctgtgttaatgtgaccttatgcgagggaccaaacaagtttaaatgccactcaggagaatgcatcacgctggacaaagtctgcaatatggctcgggattgccgagattggagcgacgagcccataaaggagtgtgggacagccgaatgtctcgataacaatggaggctgttcccacgtctgcaatgatctaaagataggctacgaatgcctgtgtcccgacggctttcagctggtagcccagcgccgatgtgaagatatcgatgaatgccaggacccggatacatgcagccagctatgcgtgaacttggagggcggttacaagtgccagtgcgaggaaggttttcaacttgatccccacactaaggcctgtaaagccgtgggcagcatcgcctatctgttcttcaccaaccgtcacgaagtccgaaagatgaccttggacagaagtgagtatacctctctcatccctaacctgcggaatgtcgtggcactggatacagaggtggcctctaaccggatctattggagcgacctgagccagcggatgatctgcagcacacagttggatcgcgctcatggcgtcagcagctatgataccgtgattagccgagacattcaggcccctgatggcctagccgtggattggatccattccaatatctactggaccgattcggtccttggcacagtctctgtggcggacaccaagggggtgaaacgcaaaactctatttcgggagaatggctctaagcccagggccatagtcgtggatcctgtgcatggattcatgtactggacagactggggtactcccgctaagatcaaaaaaggaggtctcaatggcgtggatatttattcactagtgaccgagaacattcagtggccaaacggcattactctagacttgttgagcggtcgactctactgggtggacagcaagctgcattctatctcaagcatcgacgtgaacggagggaatagaaagaccatccttgaagacgaaaaaagattggcacacccttttagcctcgcggtgttcgaggacaaggtgttttggactgacatcatcaacgaagccatttttagtgcaaaccggctgactgggagcgacgtgaatttgttggccgaaaatctcctatccccggaggacatggtgctgtttcacaacctgacccagccaaggggcgtcaattggtgtgagcggactacccttagcaacggcggatgccagtacctgtgcctgccagccccgcagatcaatccacactctcccaaattcacatgcgcatgtcctgatggtatgttacttgccagagacatgaggagctgcctcacagaagcagaggccgccgtggcgactcaggagacatcaactgtacgcttaaaagtatcatctaccgctgtccgcacacagcacacgaccacgcggcccgtgccggacacctctcggctgcccggggccacaccaggcctgaccacagtcgaaatcgtgaccatgtcgcatcaggccctcggagacgtcgccggtcgcggcaacgagaagaagcccagttccgtccgtgccctttcgattgtccttcctatcgttctcctcgtgttcctgtgtctaggcgtgttcctactgtggaagaactggcgactcaaaaacatcaattcgatcaactttgataaccccgtataccagaagacaacagaagacgaggttcacatttgtcacaaccaggatggttacagctacccgtcgcggcagatggttagcctcgaggacgacgtcgct

SEQ ID NO: 420 - DNA, 2580 bp, Artificial Sequence
  Description of Artificial Sequence: Synthetic Transcript Sequence
atggggccctggggctggaaattgcgttggactgttgcattgctgctggcagctgcaggaactgccgttggagaccgctgcgaaagaaacgagtttcagtgccaggatggaaaatgtatttcttacaaatgggtctgcgatggttccgctgagtgccaggatggatcagatgagagccaggaaacctgtctgagcgttacgtgcaagtctggagactttagttgcggaggccgggtcaaccgatgcatccctcagttttggcgatgtgacgggcaagtagactgtgataatgggagcgatgagcaaggttgcccacctaagacgtgcagccaggacgagtttagatgtcacgatgggaagtgtatatctcggcaatttgtgtgtgacagcgatcgggattgcctggacggaagtgatgaggctagttgtccagtgctgacctgtggccctgccagcttccagtgtaattcttctacatgtatcccgcaactgtgggcctgcgacaatgacccggattgtgaggatgggtcagacgagtggccccagcgatgtcgaggactttacgtgttccaaggcgactctagcccctgtagcgcctttgagtttcactgccttagcggagaatgtatacatagctcctggcgatgcgacggcgggcccgattgtaaagataagagcgacgaggagaactgcgccgtcgcaacttgccgacccgacgagtttcagtgctccgacggtaattgtattcacggctcacgccagtgtgatcgcgaatacgactgtaaagacatgtccgatgaggtgggatgtgttaacgtgaccctctgcgaagggccaaacaagttcaaatgccacagcggtgagtgtattacgctcgacaaggtatgcaacatggcgcgggattgtagagattggtccgatgaaccaataaaagagtgtgggactgctgagtgcctcgataataatggcggatgctctcatgtttgcaatgatctgaagataggctacgaatgcctgtgcccggatggattccagcttgtggcacagcggcggtgcgaggacatagacgagtgtcaggaccccgatacgtgtagccaactctgcgtgaatttggaaggaggctataagtgtcagtgcgaagagggcttccaacttgaccctcataccaaagcctgcaaagcagtggggagtattgcttatctgttctttaccaacaggcatgaggtccggaaaatgaccctggaccggtccgagtatacttcactaattccaaacctgaggaatgtcgtcgcccttgacaccgaagttgcctcaaacagaatctactggagcgatctaagccaaaggatgatctgctctactcagctcgaccgggcgcacggagtttcatcctatgatacagtgattagtcgggatatacaggcccccgacggactggccgtggattggatccactcaaatatttactggaccgattctgtgctgggcacagtgtctgttgcggatactaaaggcgtgaagcggaaaaccctttttcgcgagaatggcagcaagccgagagccatagtcgtggacccagtgcacggcttcatgtactggacggactggggcactccagccaagataaaaaagggagggttgaacggtgtggacatctattctcttgtgaccgaaaatatacagtggccaaatgggatcacccttgacttattatctggcagactgtattgggtcgatagtaagttgcactctatttcgtctattgacgtgaatgggggaaatcgcaaaaccattctcgaagatgaaaaacgccttgcccaccccttttcactggcggtcttcgaggataaggttttttggacggacatcatcaatgaggccatttttagtgctaataggttgaccggaagcgacgttaatctgcttgccgaaaacctcctaagtcccgaggacatggttctgtttcacaatctcacccagccccggggggtgaattggtgtgaaaggaccaccttatccaacggggggtgtcagtacctctgtctccctgctccgcagataaatccccattcccctaagtttacgtgtgcgtgcccggatggcatgttactggctagggatatgcgatcatgcttgaccgaagcagaagccgccgtggcgacacaagaaacttcaacggtccgactgaaggtatcgagtacagccgtgcgtacccaacacaccactacccgcccggttcccgacacttcccgcctccccggcgctacacctggcctgacaactgtggagatcgtcacaatgagccatcaggcgttgggggacgtggcgggcagggggaatgaaaaaaaaccatcgtccgttagagcattatccattgtgctgccaatcgtacttcttgtttttctgtgccttggagtgtttcttttgtggaaaaactggcgcttgaaaaatattaattctattaacttcgataatcccgtctaccagaagacaacagaagatgaggtgcacatctgccacaatcaggatggatactcttacccaagccggcaaatggtgtccttggaggatgatgtggcc

SEQ ID NO: 421 - DNA, 2580 bp, Artificial Sequence
  Description of Artificial Sequence: Synthetic Transcript Sequence
atgggaccctgggggtggaagctcagatggaccgttgccctgctgctggccgctgcgggaacggcagtgggagacaggtgtgaacgcaatgagttccaatgccaggatggaaaatgcatcagttacaagtgggtctgtgacggttcggcggaatgccaagacggatcggacgagagtcaggaaacctgtctctccgtgacctgcaaatccggtgatttcagctgcggaggaagagtcaataggtgtatcccgcaattctggcgctgtgatgggcaggtcgactgcgacaatggcagcgacgaacaggggtgtccacccaagacgtgctctcaagacgagttcagatgccatgacggcaaatgcattagtcggcagtttgtctgtgattcggatcgcgattgtctggatggatccgatgaggcctcctgtccggtgctgacttgtggaccggcctcatttcaatgcaactcctcaacctgcatcccgcaactgtgggcctgcgacaacgacccagattgcgaggacggcagcgacgagtggccacagagatgcagaggactctatgtgttccagggagactcctcgccgtgctccgccttcgaattccattgcctgagcggcgaatgcatccacagctcatggcgctgcgacggaggaccagactgcaaggacaagagcgatgaagagaattgcgccgttgctacctgtcggcccgacgagttccagtgctcggatggcaattgtatccacggatcgcgtcagtgcgacagggaatacgactgcaaagacatgtccgatgaagtgggatgcgtcaatgtcaccctgtgcgaagggccgaataagttcaagtgccacagcggcgaatgtataactctggataaggtgtgcaacatggctagagactgtcgggattggtccgacgaaccgatcaaggaatgcgggacggcagaatgcctcgacaataacggaggatgttcacacgtgtgtaacgacctcaagatcgggtacgagtgcttgtgcccagatggcttccaattggtcgcccaacgccgctgcgaggacatcgatgagtgtcaggacccggatacgtgctctcagctctgtgtgaatctcgagggcggttacaaatgtcagtgcgaagaaggcttccaacttgatccacataccaaggcgtgcaaagcggtgggatccatcgcgtacctgtttttcacgaaccgccacgaggtgcggaagatgactctggacagatcagaatacacttcactcatcccaaacctgcggaacgtggtggctcttgacaccgaagtggcctcgaaccgtatttactggtccgacctgagccaacggatgatttgctccactcagctcgaccgggcacatggagtctcttcgtacgacactgtcatctcccgcgacatccaggcccctgacggccttgcagtcgattggatacacagcaatatctactggacggatagtgtcttgggaaccgtttccgtggcggacaccaagggcgtcaaacgcaagaccctgttccgcgaaaatggatccaagccgcgagccatcgtggtagatcccgtccatggatttatgtattggactgattggggcactcctgccaaaatcaagaagggtggcctgaatggtgtggacatttactcgctggtgaccgagaacatccagtggccaaacgggatcaccctggatttgctctcaggccggctctactgggtggattccaagctgcacagcatctcgtccatcgacgtgaacggtggcaaccgcaaaactatactcgaagatgaaaagagactggcgcacccgttcagcctggccgtctttgaggacaaggtgttttggactgatatcatcaacgaggcaatcttcagcgctaacaggctgactggttcggacgtgaaccttctcgcggagaacctgctgtcgcctgaggacatggtcttgttccataacctgacccagccacgcggagtcaactggtgcgaacggaccactctgtcaaacggagggtgccagtacctgtgcctgcccgcgccgcagatcaacccgcactcgcccaaattcacttgcgcatgcccggatgggatgctcctcgcacgagacatgagatcctgcctgaccgaggcggaagcagcggtagccacccaagaaactagcaccgttcggcttaaggtgtcgtcaactgccgtgagaactcagcacactactacccgccctgtgccggatacgagccgcctgccgggggccacccctggacttactacggtggagatcgtaaccatgtcccaccaggctctgggagacgtggccggacgaggaaacgaaaagaaaccttcatcagtgagggcactgtcgatcgttctgccgatcgtgttgttggtgttcttgtgcctgggggtttttcttctctggaagaattggcggctcaagaacattaactctatcaactttgacaatccagtctaccaaaaaactaccgaggacgaagtgcatatctgccacaatcaggacggctactcatacccgtcacggcagatggtgtcgctggaggatgacgtggcg

SEQ ID NO: 422 - DNA, 2580 bp, Artificial Sequence
  Description of Artificial Sequence: Synthetic Transcript Sequence
atgggaccttgggggtggaaactacgctggacagtcgccctgttactagccgcagctgggacagctgttggagaccggtgcgaaagaaacgaattccagtgtcaggatgggaagtgcataagctataagtgggtttgcgatgggtctgctgaatgtcaagacggttccgatgaatctcaggaaacttgtctctcagttacctgtaaatccggtgacttttcatgtggaggtcgggtgaacagatgtataccgcagttttggagatgtgatggccaagttgactgtgataacggctccgacgagcagggctgccctcccaagacctgttcacaggacgagtttcgctgccatgacgggaaatgcataagtcgtcagttcgtgtgtgactccgacagggactgtctggatggcagtgatgaggcatcatgcccggttctgacttgtggtcctgcctcctttcagtgtaactcatctacatgtataccccagctgtgggcatgcgataatgatcccgactgtgaggacgggtccgacgagtggccccagagatgccggggcctgtatgtctttcagggtgacagttctccatgttccgctttcgagttccactgcctgtctggcgaatgtatccactctagctggcggtgtgacggcggccctgactgtaaggacaagagcgatgaagagaattgtgccgtggccacttgcaggcccgatgaatttcagtgctctgatggtaactgcattcacggaagcaggcagtgtgaccgggagtatgactgtaaggatatgtccgacgaggtggggtgcgtgaacgtgactttgtgcgagggtccaaataaattcaagtgccactccggagagtgtatcaccctggataaggtctgcaatatggcccgcgactgccgggactggtctgatgagccaattaaggagtgcggcacagctgagtgcctggataataacggcgggtgtagccacgtgtgcaacgacctgaagataggctacgagtgcctttgcccggacggtttccagctggtggcacagcgacggtgcgaagatatagatgagtgccaagatccagatacttgtagccagctgtgcgtcaatctggaaggagggtacaaatgtcagtgcgaagagggcttccagctagacccacacacaaaggcttgcaaggctgttggcagcatagcatatctttttttcactaaccgtcatgaagttcgaaagatgaccctggaccgaagcgagtacacaagtttaatacccaacctgcgaaatgtggtcgccctggacacagaagttgccagtaacagaatatattggagcgacctgtctcagaggatgatttgctccacccagctcgatcgcgctcacggcgtttcctcctatgacaccgtgattagtcgtgacatacaggcccccgatggcctggctgttgattggatacatagtaacatatactggactgacagtgtcctcggcacagtatccgtggctgacaccaaaggtgtgaagagaaagactctattcagagagaatggcagcaaaccaagagccatagtagttgaccccgtccacggttttatgtactggaccgactggggcactccagctaagattaaaaagggtggtctgaacggcgtggatatctactctctggtgacagagaacatccaatggcccaacgggattacactggaccttctctcaggaaggctttactgggtcgattccaagctgcacagtatctctagcatcgatgtgaatgggggaaataggaaaaccatcttagaagacgaaaaacgattggcacacccattctccctggctgtattcgaagacaaggtcttctggaccgatatcatcaatgaggcaatattctctgctaatcggctgaccggatctgatgtgaacctgctggccgaaaacttgctgagccccgaggacatggttctatttcacaatctaactcaacctcggggcgtgaattggtgcgaacgaaccacccttagcaacggcgggtgtcagtacttatgtctgccagccccacagatcaacccccatagtccaaagtttacctgcgcctgtccagacggtatgttattagcccgggatatgcggtcctgtctcacagaagcagaagccgccgtggctactcaggagaccagcactgtgcgcctaaaagtttcatctactgccgtgcgtacacagcataccacaactcgccccgtcccagatacaagccgactgccaggagccaccccagggttgaccaccgttgagatcgtgaccatgtctcaccaggctctgggagacgtggccggaaggggcaacgaaaagaaaccttccagtgtgcgcgccttgagcatagttttacctattgtgctgctggttttcctgtgtctgggcgtgttcttgttgtggaagaattggagactgaaaaacatcaacagtataaactttgacaaccctgtttatcaaaaaacaacagaagacgaggtccacatctgccataatcaggatggctattcctacccttctcgacagatggtctctctggaggacgacgtggca

SEQ ID NO: 423 - DNA, 2580 bp, Artificial Sequence
  Description of Artificial Sequence: Synthetic Transcript Sequence
atgggaccatggggatggaaactgagatggaccgtggcgctgctgctggctgcggctgggaccgccgtgggagatcgatgtgaacgcaacgagtttcaatgtcaggacggcaagtgtatctcctataagtgggtgtgtgatgggagcgcagagtgccaggatggctccgacgaatcccaagaaacctgtctttccgtcacctgcaagagcggagacttcagctgcgggggacgcgtgaaccgatgcatccctcagttttggcgctgcgacggtcaggtcgactgcgataacggttccgacgagcagggttgcccaccaaagacgtgctcacaggacgaatttaggtgtcatgatggcaaatgcatcagccgccaatttgtgtgcgacagcgatcgcgactgcctcgatgggtcggatgaagcctcctgtccagtgctgacttgcggacctgcgagctttcagtgcaactcctccacttgcattccccaactttgggcctgtgacaacgatccggattgcgaagatggctcggacgaatggccacagcgatgccgaggactttacgtctttcagggagactccagcccgtgttccgcgttcgagtttcattgcctctcgggcgaatgcatccattcctcctggcgttgcgatggtggaccggattgcaaggacaagagcgatgaggagaactgcgctgtcgccacttgcagaccggatgaattccagtgctcagacggtaactgcattcatggctcacgccaatgcgatcgcgagtacgactgcaaggacatgagtgatgaggtcggatgtgtcaacgtcaccctgtgcgaaggcccgaacaagttcaagtgccattcgggggaatgcatcaccctcgataaggtgtgcaacatggcacgcgactgccgggattggtcggatgagccaatcaaggagtgcggaacggccgaatgcctggataacaacgggggttgctcccacgtgtgtaacgacctcaagatcggatacgaatgcctgtgccccgatggcttccaactcgtggcccagagacggtgtgaggacatcgacgagtgccaggacccggacacttgctcacaactgtgtgtcaaccttgagggtggatacaagtgccagtgcgaagagggcttccagctcgacccacacactaaagcatgcaaggcagtgggttcgatcgcgtatcttttcttcacgaatagacacgaggtgcggaagatgacccttgaccggtcagaatacactagcttgatcccaaatctcagaaacgtggtggccctcgacaccgaagtggccagcaatcgcatctactggtcggacttgtcacaacggatgatctgttccactcaactggatagagcccacggggtgtcatcgtacgacaccgtgatctccagagatatccaggccccggacggtctggcggtggattggatccattcaaacatctactggactgactccgtgctcggaaccgtcagcgtcgccgatactaaaggagtgaaaaggaaaactctgttccgggaaaacgggagcaaaccacgggcaatcgtggttgatcccgtgcacggcttcatgtactggacggactggggaactccagccaagataaagaaagggggactgaacggagtggacatatactctctggtgaccgagaacatccagtggccgaatggaatcaccctggatctgctgagcggtcgcctgtactgggtggactctaagttgcactcgatctccagcatcgatgttaatggaggaaatcggaaaaccatcctggaagatgaaaagagattggcccatccgttcagcctggcagtgttcgaagataaagtgttctggacggacatcattaatgaggcgattttctcagccaacagactgaccggaagcgatgtcaacctcttggccgagaatctcttgtcgcctgaagatatggtcctgtttcacaatctgacccagccacggggagtgaactggtgcgaaagaactactctgtctaacggaggctgccagtacctgtgccttccggccccgcaaatcaatcctcactccccaaaattcacctgcgcgtgtccagatgggatgctccttgcgcgggatatgcggtcatgtctcactgaggccgaagctgccgtggctactcaagagacttcaactgttcggctgaaagtctcgtccactgcagtgaggactcagcacacgacgacgcgcccggtgcctgatactagccgactccctggagccacccccggactcactactgtggaaatcgtgactatgtcccaccaggcactcggagacgtggccggccgggggaatgagaaaaagccaagcagcgtccgcgccctgtcgattgtgcttcccatcgtcctcctggtctttctctgtctcggagtattcctgctgtggaagaactggagactgaagaacatcaacagcatcaatttcgacaatcctgtctaccaaaagactaccgaggatgaagtgcatatctgccataatcaggatggatatagctacccttcacggcagatggtgtctttggaggatgacgtggca

SEQ ID NO: 424 - DNA, 2580 bp, Artificial Sequence
  Description of Artificial Sequence: Synthetic Transcript Sequence
atggggccgtgggggtggaagttgcggtggaccgtagccctgctgctggcagcagcaggcactgccgtgggcgacagatgcgagcggaatgaatttcagtgccaggatggcaagtgcatcagttacaagtgggtgtgcgatggtagtgccgaatgccaggatgggtcggacgaatctcaggaaacttgcctctctgtgacatgcaaatcaggagatttcagctgcggcggccgtgtcaatcgttgcatccctcaattctggcgttgcgacggacaggtcgattgcgacaacgggtccgacgaacaggggtgccccccaaagacctgctcgcaggatgagtttcgctgccacgacggcaaatgtatctcaagacagttcgtttgcgatagcgatcgggattgtctggacgggtccgacgaggcttcctgtcctgtcctcacgtgcggccccgcgtctttccagtgcaattccagcacatgcatcccacagctctgggcttgcgacaacgatcccgactgcgaggacgggagcgacgaatggccccagaggtgtaggggtttatacgtgttccagggagattctagtccctgcagcgctttcgagtttcactgtttgagcggagaatgtatccatagctcctggaggtgcgatgggggtcccgactgcaaagacaagtccgacgaggagaactgcgcagtcgcgacttgtaggcccgacgaatttcagtgctcagacgggaactgcattcacggaagcaggcagtgcgatcgcgagtatgattgtaaggacatgtctgatgaggtcgggtgtgtaaatgtcaccctgtgcgaaggtccaaataagttcaagtgtcacagtggggaatgcatcacactggataaggtctgcaatatggctagggactgtcgagactggagcgacgaacctattaaagagtgcggaaccgccgaatgtctggacaataatggagggtgttctcacgtgtgcaacgatctaaagataggctacgaatgcctgtgccctgatggattccaactcgttgcccagcggcgctgcgaagatattgacgagtgccaggatccagatacctgttcccagctgtgcgtcaacttagaggggggttacaaatgtcagtgcgaagagggctttcagctcgatcctcataccaaggcctgcaaagcagtgggctcaattgcttacctcttctttacaaaccggcatgaggtgagaaagatgactcttgataggtctgaatacacctccctgattccgaacttgcgaaacgttgtcgcgctggatactgaggtcgccagtaataggatatattggtcagacctgagtcagaggatgatctgtagcactcagctggaccgggcccatggggttagctcatacgataccgttatctccagagatatccaggcgcccgacggattggcggtcgattggatacactccaatatctactggaccgactcagtgctgggtaccgtctctgtggcggatactaagggtgttaagaggaagaccctctttcgagagaatggatctaaaccaagagcaatagttgttgaccctgtgcatggatttatgtattggactgattggggaacgcccgcaaaaatcaaaaaaggaggattgaacggtgtagacatctatagtctagttacggagaacatccagtggcccaatggaattaccctcgacctcctgtcaggacgcctctattgggtggactccaaactgcatagcattagcagtatcgatgtcaacggagggaacagaaagacaatcttggaggatgagaagaggcttgcccatccattttccttagccgtgtttgaggacaaagtcttttggaccgacattatcaacgaggctatatttagcgcgaataggctcactgggtctgatgttaacctgttggcagagaacttgctaagtcccgaagatatggtcctattccacaatttaacccagccaagaggcgtcaactggtgtgagaggactaccctgtcaaacggagggtgtcagtacctgtgcctgcctgctccccagatcaatccccacagccccaagttcacctgtgcatgccctgacgggatgctcctggcgcgcgacatgcgctcctgtctgaccgaagcagaagcggccgtggcaacccaggaaacaagtactgtcaggcttaaagtctccagcaccgccgtgcgcacgcagcacaccaccacaaggcctgttcccgacacctcccggcttcctggggctacccctggtctgaccacagtcgagatagtgactatgtctcaccaggcactgggcgatgtggctggcagaggcaatgagaagaagccttcctcggtacgagccctatctatagtcctgccaatcgtcctgctcgtgttcctgtgccttggtgtgttcctgctgtggaagaactggcgattaaagaatataaacagcattaactttgataacccagtctaccagaaaacaaccgaggatgaggtgcacatttgtcacaaccaggacgggtactcttaccctagtaggcagatggtgtccctggaagatgacgtcgct

SEQ ID NO: 425 - DNA, 2580 bp, Artificial Sequence
  Description of Artificial Sequence: Synthetic Transcript Sequence
atgggaccttggggatggaaattaaggtggactgttgcgttacttttggcggccgcgggaaccgcggtcggcgaccgctgtgagcgaaatgaatttcaatgccaggatggaaagtgcataagctacaaatgggtttgtgatggatcagcagaatgtcaggatggaagcgacgaatcgcaggagacttgtttgtcagtgacttgcaaaagtggagactttagctgcggaggaagagttaatcgctgtattcctcagttctggaggtgtgatggccaggtggactgcgataacgggtctgatgagcaaggatgcccaccgaaaacgtgttcacaggatgaatttagatgtcatgatggaaagtgcatctctcgccaatttgtctgtgactcggaccgcgattgcctggacggctccgatgaggcaagctgcccggtcctcacgtgtgggcctgcctccttccaatgcaattcatcgacctgcatacctcagttgtgggcctgcgataatgatccagattgtgaggacgggtctgacgagtggcctcagcgttgccgagggctttatgtgttccagggggattcatcaccgtgttcagcgtttgaatttcattgcttatcgggagagtgtatccattcatcatggcgctgcgatggcggaccggattgtaaagataaatcagatgaggagaactgcgcagtcgctacttgcagaccggacgagtttcagtgcagcgacggcaattgtatccacggctcccggcagtgcgacagagaatacgattgtaaagatatgagcgatgaggttggatgcgtcaacgtcacattatgtgagggtcccaacaaatttaaatgccacagtggggagtgcattacacttgataaggtctgcaacatggcgagagactgtcgcgattggagcgatgaaccaattaaagaatgtggtacggcggagtgcctcgacaataatggaggttgttctcatgtatgcaacgatttgaaaatcggttatgaatgtttatgtccggatggctttcaactggtggctcaaagaagatgtgaggatatcgatgaatgccaggatccggatacctgctcgcaattatgtgtcaaccttgaaggggggtataaatgccagtgtgaggagggatttcagcttgatcctcacacgaaggcttgcaaagcagtcggatcaatcgcttaccttttctttacgaatcgccacgaagtacggaaaatgaccttagatcgttctgaatatacgtctcttattccgaatctaagaaatgtggtcgcgctcgatactgaggttgctagtaaccggatatactggtcagatctgtcacagcggatgatctgcagcactcagcttgaccgggcccatggggtttctagctacgatacagtcatcagccgcgatattcaagctccggatggcctcgctgtagattggatccactcgaatatttattggacagattcggtcctgggaacagtctcggtagcagatacaaaaggtgtgaaacgcaagactttgtttcgtgaaaacggctcaaagccacgcgccatcgtggtagatccggtacacggcttcatgtattggacagattggggaacaccggcaaagattaaaaagggtggattgaacggggtggatatttattcccttgtcacggaaaacattcaatggcctaatggaatcacactcgatttacttagtggtcggctttactgggtggattcaaagttgcacagcattagctcaattgacgttaatggcgggaatcggaaaacaatcctagaagacgaaaaaagacttgcgcacccgttttctcttgcggtgtttgaggataaggtattctggacagatatcatcaatgaagctattttctctgccaatcgcttgacgggatccgacgtaaacttgctagcggaaaatttactttctccagaggatatggtactgttccataatctaacacaaccgagaggtgtcaactggtgtgagcggacaacactctcaaatgggggctgccagtatctgtgtttgccggccccgcagataaatcctcatagtccgaagttcacgtgcgcctgtccggatggcatgctcctcgccagagatatgcggagctgtttgacagaggcggaagctgcggttgcgacccaagaaacgagcacggtcagacttaaggtctcttcaacggccgttcggacacagcataccacaacccgcccggttccggatacaagtcgtttgcctggagctacgccggggttaacaactgtcgaaattgttactatgtcccatcaggcattgggcgatgtcgcagggcgagggaatgaaaaaaaaccgtcatctgtccgtgctttaagcattgtgctcccgatagtgttgctggtctttctttgcctcggcgtttttctactctggaagaattggcggcttaaaaacattaactctatcaactttgacaatcctgtgtatcagaagacaacggaagacgaagttcatatatgccataatcaagacggttattcctatccgagcagacaaatggtttctctagaagacgacgttgcc

SEQ ID NO: 426 - DNA, 2580 bp, Artificial Sequence
  Description of Artificial Sequence: Synthetic Transcript Sequence
atggggccctgggggtggaagctccgctggaccgtcgccctgctgctggcggcagccggcaccgctgtgggagatcgctgtgagcgcaatgagttccagtgtcaagatgggaagtgcatttcgtacaaatgggtttgtgacggtagcgcagaatgtcaggacggatccgatgaatcccaggagacatgcttgagcgtgacctgcaagtctggggatttctcttgtggggggcgagttaaccgatgcattcctcagttctggcggtgtgatgggcaggttgactgtgataatggaagtgatgaacagggttgcccacctaagacctgtagccaggacgagttcaggtgccacgacggtaaatgcatatccagacagttcgtctgcgattcagatagggactgtctcgatggtagtgatgaagcctcttgtcccgtgctgacttgcggccccgcatctttccagtgtaacagctcgacttgcatcccacagctgtgggcctgcgataatgatcctgattgtgaagacggcagcgatgaatggccccagcggtgtagggggctctacgtgttccagggcgacagctctccctgcagtgcgtttgagtttcattgtttgagcggggagtgcatccatagtagttggcgctgcgatggaggccccgactgtaaggataagtccgatgaagaaaattgtgcagtcgcaacttgcaggccagatgagtttcaatgctccgacggcaattgtatccacggaagtaggcaatgtgacagggagtatgactgtaaggacatgtcagatgaggtaggttgcgtgaacgttaccctttgtgaaggcccgaacaagtttaagtgtcacagtggcgaatgcataaccctggacaaggtgtgtaatatggcccgtgattgccgcgactggagtgacgaacccattaaagaatgcggcacagcagaatgtttagacaataatgggggatgctctcacgtatgcaacgacctgaaaatcggttatgaatgtctctgtcccgacgggtttcaactggtagctcagcggaggtgcgaggatattgacgagtgccaggaccccgacacatgctcccagttgtgcgtcaatttggaaggaggctataaatgtcagtgcgaggagggatttcagttggacccacacacaaaagcctgcaaggcggtaggcagtattgcatatctgttcttcaccaacagacatgaggttcgaaagatgactttagatcgatccgagtacaccagcctcatccccaacctccggaacgtagttgcactggataccgaggtggcgagtaaccgaatatactggtccgacctgagccagcggatgatatgtagtacccagttagatagggcccacggggtcagttcatatgacactgtaatcagtcgggacatacaggcccccgacgggctggcagtcgactggatacactctaatatctactggaccgattcggtcctgggaacagtatccgtggccgacactaaaggagttaaacgcaagacgctcttcagggagaacggtagcaaaccccgagctattgtggtggaccccgttcacgggttcatgtactggacagattggggaacccccgctaagattaagaaggggggcttgaatggggtcgatatatacagcctggtgactgagaacatccagtggcccaacggtatcactctcgacctgctgagtggccggctctattgggtggattccaaacttcactctattagctcgatcgacgttaatggaggaaatagaaaaaccattctagaggacgaaaagcgtctggcccacccttttagcctggccgtctttgaggataaggtcttctggacagatatcataaacgaagccattttctccgcaaatcgactgacgggaagcgacgtcaatctgttagccgagaatctcctctcccccgaagacatggtcttatttcacaatctgacccagccaaggggggtaaattggtgcgagaggaccaccctgtctaatggaggttgtcaatacctgtgcctgccagctcctcagataaacccacatagtcctaagtttacctgtgcgtgccctgacgggatgctgctggctagagatatgaggtcctgcctgaccgaggcagaggcagccgtggccacacaggagacctcaacggtgcgcctgaaggtctcttccacagctgtgcggactcagcacaccacaactcgcccggttcccgatacttcaaggttgcccggggcgaccccaggtctcaccaccgtggaaattgtcaccatgagccaccaggccctgggggatgtcgccggtcgaggtaacgaaaagaagccttcatctgttcgggctctctcaatagtcttgcccatagtgcttctcgtcttcctctgcttaggcgtattcctcctgtggaagaactggcgactgaaaaacattaacagcattaactttgacaatcccgtctatcagaagacaactgaagatgaggtgcacatctgtcacaatcaagacggttacagctatccttcgcggcaaatggtttcactagaagatgatgtggca

SEQ ID NO: 427 - DNA, 2580 bp, Artificial Sequence
  Description of Artificial Sequence: Synthetic Transcript Sequence
atgggaccgtggggctggaaacttagatggaccgtggcattgctcctcgcggccgccggcactgccgtgggagacagatgcgagcggaacgaattccagtgccaagacggcaaatgcatcagctataagtgggtgtgcgacggctcggccgaatgtcaggacggtagcgacgaatcgcaagaaacgtgcctgtcggtgacctgtaagtcaggcgacttctcatgcggcggacgggtgaatcgctgtattccccaattctggagatgcgacggacaggtcgattgtgacaacggatcagacgagcagggatgcccgccgaaaacgtgttcacaagacgaattccggtgccacgacgggaagtgtatctcacgccagtttgtctgcgattccgatcgggattgcctcgacggcagcgacgaggcttcgtgcccggtcctcacttgcggcccggcttcgttccagtgcaactccagcacctgcattccgcagctgtgggcctgcgacaacgatccagattgcgaggatggctctgacgagtggccacagagatgtcgtggactctacgtgttccagggggacagctcaccttgctcggcgtttgaattccattgcctctccggagaatgcatccacagttcctggcgctgtgacggcggcccagactgcaaagacaagtccgatgaagaaaactgtgccgtcgcgacctgccgacctgacgagttccaatgctcggacggtaactgtatccacggcagccggcagtgcgacagagagtacgattgcaaggacatgagcgatgaggtcggctgcgtaaacgtgactctttgcgaagggccgaataagttcaaatgccactccggggaatgcattactctcgacaaggtgtgtaatatggcccgcgattgccgggactggtcggatgagcctatcaaggaatgtggtaccgcggaatgcctggacaataatggaggttgtagtcatgtgtgcaacgacctgaagatcggatacgagtgtctctgtcccgacggatttcagctcgtggcgcaaagaagatgcgaagatatcgacgagtgccaagacccggacacctgctcccaactctgtgtgaacctcgaggggggatacaagtgccagtgcgaagaagggtttcagctggatccccacaccaaagcctgcaaggcggtgggctccatcgcgtacttgttcttcaccaatcgacacgaggtgaggaaaatgaccctggacaggagcgaatacacttcgctgattccgaacctgcgtaatgtggtcgccctcgatacggaggtcgcatcaaatcgcatttactggtccgatttgtcacagcggatgatctgttctacccaactcgaccgcgcccatggagtctcctcatacgacaccgttataagccgggacatccaggcaccagatggacttgctgttgattggatccactctaacatctactggaccgattcggtgctgggaactgtcagcgtggcggataccaagggcgtcaagagaaagacgctgttccgcgaaaatggatctaagccacgggccattgtggtggatccggtccatggattcatgtactggaccgactggggaacccccgccaagatcaagaagggagggctgaacggggtggatatctacagtctcgtgaccgagaacatccaatggccaaacggaatcaccctcgatctgctgtccggacgcctgtactgggtggactctaagctgcactctatctcatccatcgacgtgaatgggggtaatcgcaaaaccatcctcgaagatgagaaaagactggcgcacccgttctccttggccgtctttgaggacaaggtcttttggacggacatcataaacgaagcgatcttctctgcaaaccgcctgactggatcggatgtcaacctcctggccgagaatttgctgtccccagaagatatggtgctgttccataacctgacccagccgcgtggggtaaactggtgcgaacgcaccaccctgtccaacggcggatgccagtatctgtgcctgccagctccgcaaatcaacccacattcacccaaattcacgtgcgcttgccctgacggcatgctcttggcacgggacatgcgctcatgtctgactgaggctgaggcggccgtcgcgacgcaagaaactagcactgtgcgcttgaaggtgtcatcaaccgccgttcggactcagcatactaccactagacctgtgcctgatacttcgagactgccgggagccactccaggtttgactactgtggaaatcgtcaccatgtcgcatcaggctctgggtgatgtggccgggaggggaaacgaaaagaagccctcctcagtccgggcactctcaattgtgcttcctatagtgctgctggtctttctgtgccttggagtgttcctgctctggaagaattggcgattgaagaacatcaattccatcaatttcgacaatccagtgtaccagaaaactaccgaggatgaggtgcacatctgtcacaaccaggacgggtactcatacccgtcccggcagatggtgagcctggaagatgatgtggct

SEQ ID NO: 428 - DNA, 2580 bp, Artificial Sequence
  Description of Artificial Sequence: Synthetic Transcript Sequence
atggggccgtggggctggaaactgcggtggaccgtcgctctcttgcttgctgccgccggaaccgcggtcggcgacagatgcgaacggaacgagttccagtgccaagatggaaagtgcatctcttacaaatgggtctgtgatgggtcggccgaatgccaagacggatccgacgaaagccaagaaacctgtctgtcagtcacatgcaagtcaggtgatttttcttgtggcgggagggtgaatcgctgtatcccccagttctggcgatgcgatggacaggtggattgtgacaatggtagtgatgagcaggggtgcccgccgaagacgtgttcacaggacgagttccggtgtcatgatggcaagtgcatatcccggcagttcgtctgtgatagtgatcgagattgtctggacggttctgatgaggcaagttgccctgtcttgacttgcggacctgcgagttttcagtgtaactcgagcacgtgcattcctcaactttgggcatgcgacaacgatccggactgcgaggatggcagcgatgagtggccccagcggtgtcggggactctatgtgttccagggcgatagttcaccttgctccgcattcgagtttcactgtctgtcgggcgagtgcatccatagcagctggaggtgcgatggcgggcccgactgcaaggacaagtccgacgaagagaattgtgccgtggccacgtgtaggcccgacgagtttcagtgctctgatggaaattgcatccacggctccagacagtgcgatcgagagtatgattgtaaggatatgagtgacgaagtgggatgtgtgaacgtcacactttgtgaggggcctaataagttcaaatgccacagtggggagtgcatcactctggacaaggtatgcaatatggctagggactgtagggattggagtgacgagcccattaaggaatgtggcactgctgagtgcttagacaacaacggaggatgcagccatgtctgtaacgacttgaagatcgggtatgagtgcctctgtcctgatggattccaactggtggctcagcgcaggtgcgaggatatcgatgagtgtcaggaccccgacacctgttcacagctctgcgtgaatctcgagggaggctacaagtgccagtgtgaggagggcttccagttggacccacataccaaggcatgcaaagccgttggctctatcgcttacctcttctttaccaacaggcacgaggtccgaaagatgacattggatcgttccgaatacacctctttgattccgaaccttaggaatgtggtggccctggacaccgaggtcgctagcaacagaatctactggagcgatctctctcagaggatgatttgttccacccagttggaccgcgcacacggtgtatcaagctatgacaccgtgatcagccgcgacatccaagcacccgatggactagcagtggattggatccactcgaacatctactggactgactcggtgctagggacagtatctgtggcagatacaaagggtgtgaagagaaagactctgtttcgggagaatggcagcaagccgagagcaatcgtggtagatccagtacatgggttcatgtactggaccgactggggcactccagccaagatcaaaaagggcggactgaacggggtggacatttattccctggtgacggagaacattcagtggcccaacggaatcaccctggacttgctatccggtagactgtactgggttgacagcaaactgcatagcatctcatccatcgacgtcaacggcggaaataggaagacaatcctggaagatgagaaaagactcgctcatccgtttagcctagctgtttttgaggacaaagtgttctggaccgatattattaacgaagctattttctcagctaaccggctgaccgggtccgatgtgaatctgctagccgagaatctgttgagccccgaggacatggtcctgttccacaacctgactcaaccccgtggcgtgaattggtgcgaaaggacgacactgagcaatggtggatgccagtacctctgcctgccggcccctcagatcaacccccatagcccaaagttcacgtgtgcctgtccagatggaatgctgctggccagggacatgcgttcgtgcctcaccgaagcagaagccgcagtagctacccaggaaacctctaccgtgaggttaaaagtgtcctctaccgcagttcgcacccagcacacaaccacgcggccggtgcccgatacttctcgactcccaggggctactcccggcctgactactgtggagattgtcaccatgtcgcaccaggctttaggggacgtcgcagggagagggaatgagaaaaaaccttcctcagtgcgagccctctccatcgttctgccgattgtcctgctggtctttctgtgtctcggagtgttcctgctgtggaaaaattggcggctcaagaacatcaactccattaacttcgacaacccagtctatcagaaaaccaccgaggacgaggttcacatctgccataatcaagacgggtactcatatccaagccgccagatggtgtctctggaagacgacgtagct

SEQ ID NO: 429 - DNA, 2580 bp, Artificial Sequence
  Description of Artificial Sequence: Synthetic Transcript Sequence
atgggcccatgggggtggaagttgcgatggaccgtggcactcttgctggccgcagccggtactgcggtcggagacaggtgcgagcgtaatgaattccaatgtcaagatggaaagtgcatttcttacaaatgggtgtgcgatggatcagcggagtgccaggacggttcagatgaatcacaggaaacttgcctgtcggtcacttgcaaatccggggactttagctgcggaggacgcgtcaatagatgtatcccacaattctggcgctgtgacggacaagtggattgcgataacggctccgacgagcaggggtgcccgcctaagacctgctcccaagatgagttcaggtgccatgatggaaaatgcatttcccggcagttcgtatgcgattcagacagagactgcttggatggatccgacgaggcctcctgccctgtactcacttgtggtccagcgtcctttcagtgtaatagcagcacctgcatcccgcagctgtgggcctgcgataatgatcccgactgtgaagatgggagcgacgagtggccccaacgctgcagaggactgtacgtgtttcagggtgatagctccccgtgctctgccttcgaattccactgcctctccggtgagtgtattcattcaagctggaggtgcgacggcggcccggactgcaaggacaagtccgacgaagagaattgcgcggtcgcaacttgcagaccggacgaatttcagtgttcggacggaaattgcatccacgggagccggcagtgcgaccgggaatacgattgtaaggacatgtccgatgaggtcggatgcgtgaacgtgacgctgtgcgaaggaccaaataagttcaagtgccactcgggagaatgcatcactcttgataaggtgtgcaacatggcccgcgattgtagagattggagcgacgaaccaatcaaagaatgtggtacggcggaatgcctcgacaacaacggaggttgctcgcacgtctgtaacgacctcaagatcggatatgagtgtctgtgcccggatggctttcagctcgtggctcaacgccggtgcgaagatattgatgaatgtcaagacccggacacctgctcacagctgtgtgtcaatctcgagggaggctacaaatgccaatgcgaagagggattccaactcgatccgcacactaaggcctgcaaagccgtgggttcaatagcctacctgttcttcacgaaccgacatgaagtgcggaaaatgaccctggatcggtccgaatatacctcgctgatccctaacctccggaacgttgtggccctcgataccgaggttgcctcgaaccggatctactggtccgacctgagccaacggatgatctgctcgactcaattggacagagcccatggagtgtccagctatgacacggtgatctccagggacatccaagcccctgacggactggctgtcgactggatccattcgaacatctactggactgattccgtcctcggaactgtgtccgtggcggacaccaaaggagtgaagaggaaaactctgtttcgcgagaacgggtcaaaacccagagccatcgtggtggatcccgtgcacggtttcatgtactggactgactggggaacgccggccaagattaagaagggcgggctcaacggagtggacatctacagcctcgtgaccgagaacatccagtggccgaatggaatcacgttggacctgctcagcggacggttgtactgggtggattcaaagttgcactctattagctcaatcgatgttaacggcggaaatcgcaagaccatcctggaagatgagaaacggctcgcccaccctttctcgctcgcagtgttcgaggacaaggtgttctggaccgacatcatcaatgaagctattttctcagctaaccggttgaccggcagcgacgtcaacctgctggcagaaaacctgctgtcgccggaggacatggtgctgttccataacctgacccaacctcggggagtcaactggtgtgaacgcacgaccctttccaatggaggatgtcagtacctgtgcctccctgcaccacagatcaacccacactcgcctaagttcacgtgcgcgtgtcccgacggcatgctgctggcgcgtgatatgaggtcctgtctgaccgaagccgaggccgcagtggctactcaggagacgtcaaccgtcaggctcaaggtatcctcaaccgctgtgcgcacccaacacaccactacccgcccagtgccggacacctcacggctgcccggtgcgactccggggttgaccaccgtcgaaatcgtgacgatgagccaccaagccctgggagacgtcgccggacgcggcaatgaaaagaagccatcatcagtcagagcactgtctatcgttctgccgatagtgctcctggtgtttctctgcttgggagtctttctgctttggaaaaactggaggctgaagaacatcaatagcatcaacttcgacaatccagtttaccagaaaaccaccgaggatgaagtgcacatttgccacaatcaggatggctactcctacccttcgaggcagatggtgtcgcttgaagatgacgtggcg

SEQ ID NO: 430 - DNA, 2580 bp, Artificial Sequence
  Description of Artificial Sequence: Synthetic Transcript Sequence
atgggcccctggggttggaaattgcgctggacggtggcactgctccttgccgcagcaggcaccgccgtgggagatcggtgcgaacggaacgagtttcaatgtcaggacggcaagtgtatttcgtacaagtgggtgtgtgacggcagtgccgagtgccaagatggatcggatgagtcccaagaaacttgcttgtcggtgacttgcaagagcggagatttttcttgtggcggcagggtcaacaggtgcatccctcagttttggcgatgtgacggacaggtggactgcgataacggtagcgacgagcaaggatgtccgcctaagacttgctcgcaggatgaattccgttgccacgatggaaagtgcatttcccggcagttcgtgtgtgattctgacagggattgtttggatgggagcgatgaagcatcgtgtcccgtgctcacgtgtggtccagcatctttccaatgcaattcatcaacgtgtatcccccaactttgggcatgtgacaatgaccctgattgtgaggacggtagcgatgagtggccacaaaggtgtcgcggtctgtacgtctttcagggagactccagcccatgttccgcctttgagttccattgcctgtcgggtgaatgtatccactcctcctggcggtgtgatggagggcctgattgtaaagacaaaagcgacgaagagaactgtgccgtcgcgacctgtcgacctgatgaatttcaatgttcggatggtaactgtatacatggtagccgacagtgcgatagagaatacgattgtaaggatatgtcagatgaagtgggctgtgtgaacgtcaccctgtgcgaagggccaaataagttcaagtgtcattcgggagagtgtattacccttgataaggtgtgcaacatggcccgtgactgcagagattggtcagatgagcccatcaaggaatgtggaacggcagagtgtctggacaacaacgggggatgttctcacgtgtgtaatgacctcaagattggatacgaatgcctttgtccggacggattccagctcgtggcccaacggagatgtgaggatatcgatgaatgccaggacccggatacctgtagtcaactgtgcgtgaaccttgagggcggatacaaatgtcaatgtgaggaggggtttcagctcgatccccacacgaaggcatgtaaggcagtcggctcaatcgcatacctgtttttcactaaccggcatgaggtccggaaaatgactctggaccgctcagaatacacttcactgatcccaaacctcagaaacgtggtcgcacttgataccgaagtggcatcaaacagaatctattggtccgacctgagccagcggatgatttgctcaacccaacttgacagagcacatggagtgtcatcatacgacactgtcatctcccgcgatatccaggcacccgatggcctggccgtggactggatccactccaacatttactggactgactccgtcctgggaaccgtgtcggtggcagatactaaaggagtgaagcgtaagaccctgtttcgagagaatggatctaagcctagagcaatcgtcgtggatcctgtccacgggtttatgtactggacggattggggaaccccagcaaagatcaaaaaaggagggcttaacggcgtggatatctactcccttgtcactgaaaacatacaatggcccaacggtatcactctcgatcttctgagcggccgtctgtactgggttgattccaaacttcatagcatttcgtcaatcgatgtgaatggaggcaaccgaaagactattctggaagatgaaaagcgtcttgcacatccttttagcctcgcggtattcgaggacaaggtcttttggacggatatcattaacgaggcaatcttttcggctaacaggctgactggatcagatgtcaatcttcttgcagaaaaccttctgtcgcctgaagatatggtccttttccataacctgacccagccaaggggagtgaattggtgtgagaggactaccttgagcaatggaggatgtcaatacctctgtctgccagcgccacagataaatccacattccccaaaattcacttgcgcgtgccctgacggaatgcttctggcgcgcgacatgaggtcgtgtcttacggaagcggaagcagcagtggcaacccaggaaacctccaccgtgcgactcaaggtgtcaagcaccgcagtccggacccagcatactaccaccaggcctgtgccagacacttcaagattgccaggggccactcctggcctcactaccgtcgaaattgtcaccatgtcccatcaggcgctgggtgatgtcgcaggtaggggaaacgagaagaaaccctcgtcggtccgtgcactctcgatcgtgcttcctatcgtgctgcttgtctttctctgcctcggagtgtttcttctgtggaagaattggcggctgaagaacatcaacagcattaactttgataaccctgtgtaccaaaagactaccgaggatgaagttcatatttgtcataaccaggacggttactcctacccgtcgcgtcagatggtgagcctcgaagatgatgtggcg

SEQ ID NO: 431 - DNA, 2580 bp, Artificial Sequence
  Description of Artificial Sequence: Synthetic Transcript Sequence
atgggcccctggggttggaaacttcggtggaccgtcgccctcctgcttgcggcagcggggactgcagtgggagatcgatgcgagcgcaatgagttccagtgtcaagatggcaagtgcatttcgtacaagtgggtgtgtgacggttcagcagagtgccaggatggtagcgatgaatcccaggaaacttgtctttcggtaacctgtaagtcgggagatttctcatgtggtggaagagttaatagatgcattcctcagttttggcgatgtgatgggcaggtggactgtgacaacgggtcggacgagcaaggatgtccgcccaaaacttgttcacaggacgaatttcggtgccatgatggaaaatgtataagccgccaattcgtgtgtgattccgatcgtgattgtctcgatggcagcgatgaagcctcctgtcccgtgctgacctgtggcccagcctccttccagtgcaactccagcacctgtattccacagttgtgggcttgtgacaatgatccagattgcgaggacggttcagatgaatggccgcaacggtgccgcggtctttacgtgtttcagggtgattcatccccctgttctgcgtttgaatttcattgcctttcgggagagtgtattcactcgtcgtggagatgcgacggagggcctgactgtaaggataagtctgatgaagaaaactgtgcggtcgctacctgcagacctgatgaatttcaatgcagcgatggaaattgcatccatggttcgcgccagtgcgacagagaatatgactgcaaggatatgtcggatgaagtgggatgtgtgaatgtcaccctgtgcgaaggtccaaataagtttaagtgtcactcaggagaatgcatcactctggacaaggtatgtaacatggcgagggattgccgcgactggtcggatgagccaattaaggaatgtggcaccgcagaatgtctggacaacaacgggggttgttcgcacgtgtgcaatgacttgaagattggatacgaatgtctctgccctgatggcttccaactggtggcccaacgtcgttgtgaagatatcgacgaatgtcaggaccctgacacttgctcgcagctctgtgttaaccttgagggaggatacaaatgtcagtgtgaagagggcttccagctggatcctcataccaaagcatgtaaagctgttggttccatcgcctacttgttcttcaccaacagacacgaggtccgtaagatgactcttgatcgaagcgaatacacttccctgatcccaaaccttcgcaacgtggtcgccctggacaccgaggtcgcatcaaataggatttactggtcagatctctcgcaacgtatgatctgttccactcaactggatcgcgcacatggagtgagctcgtacgatactgtgatttcacgtgacatccaagcgccagatgggctggcagtggattggatccattcgaacatttactggacggattcagtgcttgggactgtgtctgtcgcagacaccaaaggagtgaagagaaaaaccttgtttcgcgaaaacggtagcaaaccgagagccattgtggtggaccccgtgcacggatttatgtactggaccgactggggtacccccgcaaagatcaagaagggaggactcaacggagtggatatctattcactggtgactgagaacatacagtggcctaatggtattaccctggatctgctgtcaggtagactctattgggtggactccaagctccactcgatatcctcgatcgacgttaacggtggaaaccgcaagacgattctggaagatgaaaagagacttgcccatccattttcgcttgccgtgtttgaggacaaggtcttttggactgatatcattaacgaggcaatattctcagcaaatagactcactggatcggatgttaacctgctggcggaaaacctgttgtccccagaggacatggtgctgtttcataacctgactcagccgcgaggagtgaattggtgtgagagaaccaccctgagcaacggaggttgtcagtatctttgtctgccagcccctcagatcaacccacattccccaaagttcacctgcgcatgccctgacggcatgcttcttgctcgcgacatgaggtcatgtcttaccgaagccgaggcagcagtggcaactcaggaaacttccacggtcagacttaaggtgtcgagcacggcagtgagaacccaacacaccacgaccaggcctgtgcctgacacctcgaggttgccaggcgcaacccccgggctgaccactgtggagattgtgaccatgagccaccaggcgctgggggatgtggcaggtagagggaatgaaaagaaaccgagcagcgtacgcgcattgtcgatagtcctgcctattgtgctcctggtctttctgtgcctcggcgtgttcctgctctggaagaattggagactcaaaaacataaactctatcaattttgataatcccgtgtaccagaaaaccaccgaggacgaagtccacatttgtcataaccaagatgggtactcatacccatcgcgccaaatggtgtcgcttgaagatgacgtggcg

SEQ ID NO: 432 - DNA, 2580 bp, Artificial Sequence
  Description of Artificial Sequence: Synthetic Transcript Sequence
atgggaccctggggctggaaacttagatggacggtggcccttttgcttgcagccgcggggacggcagtgggggatcggtgcgaacgaaacgaatttcagtgtcaagatgggaagtgcatttcgtacaagtgggtgtgcgatggttcggcagaatgtcaagacgggtcggatgaaagccaagaaacctgtctcagcgtgacttgtaagagcggcgatttcagctgtgggggaagagtcaatagatgcattccccagttctggcggtgtgatggtcaagtggattgtgataacggctccgacgagcagggttgcccacctaagacttgttcccaagatgagtttcgatgccatgacggtaaatgtatatcgaggcagtttgtgtgtgattcggatcgtgactgcctggatggatcagacgaagcatcatgtcctgtcctcacttgcggtcctgcatcatttcaatgcaacagcagcacctgtatcccacaactgtgggcatgcgataatgatcctgattgcgaggatggctccgatgaatggccacaacgttgccggggactttatgtgtttcagggagattcaagcccatgcagcgcctttgagtttcactgcctgtcaggagaatgtatccattcctcatggaggtgcgacggaggtcctgactgtaaggacaaatcggatgaagagaactgtgccgtcgcaacctgtcgtcctgatgagtttcagtgttccgatgggaattgtattcatggcagcagacaatgtgatcgggaatacgactgtaaggatatgtccgatgaggtcggttgcgtgaatgttaccctctgtgaggggcctaataagttcaagtgtcattcgggagaatgtattaccctggataaggtctgtaacatggcaagagattgccgcgattggtccgacgaacctatcaaggaatgtggcaccgcagagtgtctcgacaataatggcgggtgtagccacgtgtgcaatgatctcaaaattggctacgagtgcttgtgccctgatggatttcaacttgtggcgcagcgcagatgcgaggatatcgatgaatgccaggatcctgatacgtgctcacagctgtgtgtcaacctcgagggtggttacaagtgccagtgcgaggagggttttcaactggacccacatactaaggcatgtaaggcagtgggttctatcgcgtaccttttcttcaccaatagacatgaagtcagaaaaatgacccttgatcgatcagaatacaccagccttatccccaacctgcgtaatgtggtggcgttggacaccgaagtcgcgtcgaatcgaatttactggtccgaccttagccagcgcatgatttgttccactcagctcgatcgggctcatggcgtctcgtcatacgataccgtgatttcacgtgatattcaagcacctgatgggctcgcggtggactggatacactcaaacatttactggaccgactcggtcttgggcactgtgagcgtggccgacaccaaaggtgtcaaacgcaagactctgtttcgagaaaacggatcaaagccaagagcaattgtggtcgatccagtgcatggcttcatgtactggacggattggggtactccggccaagattaagaagggtggattgaatggagtggacatatactcgctcgttactgagaacatacagtggcctaacggtatcaccctcgaccttcttagcggacggctgtattgggtggatagcaaactgcactcgatctcatcgatcgacgtcaacggaggaaacagaaagactattcttgaggacgaaaaacgactcgctcatccgttttcacttgccgtgttcgaggataaggtgttttggacggacatcatcaatgaggccatcttttctgccaatcgcctcaccggatccgacgtgaaccttctggcagaaaatctgctctctccagaggacatggtcctctttcacaacctgacccaaccacgcggcgtgaactggtgtgaacggactactctctcgaacggtggatgtcaatacctgtgtctgcctgcgccacagattaaccctcattcgccgaagttcacttgtgcatgccctgatggtatgttgcttgcacgggatatgcgatcctgcctcaccgaagcagaagcagcagtggcaactcaagagacttcgaccgtgcgactcaaggtgtccagcactgctgttcggactcaacacaccaccaccagaccagtgccggatacgtcgcggttgccaggagcgactcccggactcactactgtggaaattgtcacgatgagccaccaggcactcggagatgtggcagggcgcgggaacgagaagaaaccaagctcagtgagggcactgtcaatagtgcttccaattgtgctgcttgtttttctctgtctgggcgtgttcctgctgtggaagaactggagattgaagaacattaactcgatcaatttcgataaccccgtgtaccaaaagaccacggaggatgaagtgcatatttgtcacaaccaagacgggtactcctacccttcccggcagatggtgagccttgaagatgacgtggca

SEQ ID NO: 433 - DNA, 2580 bp, Artificial Sequence
  Description of Artificial Sequence: Synthetic Transcript Sequence
atgggaccttggggctggaagctccggtggaccgtggcactgttgttggccgctgccggtacggcagttggcgataggtgcgaaagaaacgaatttcagtgccaggatggtaaatgtatcagttacaagtgggtgtgtgatggcagcgcagagtgccaagacggaagcgatgagtctcaggaaacctgtctgtcagtcacgtgtaaatcgggcgatttttcatgcgggggccgagtgaacaggtgtataccccaattttggaggtgcgacggccaagtggactgcgacaacggatcggacgaacaggggtgcccccccaaaacttgttcccaagatgagtttaggtgccatgatggcaaatgcatctctaggcaatttgtgtgtgactcagatcgggattgccttgacggcagcgatgaagctagctgtcccgtacttacttgcgggcctgcatcttttcagtgcaactcctccacttgcattccacagctgtgggcttgtgataatgacccggattgtgaggacggaagtgacgagtggccacagagatgtagaggcttgtatgttttccagggagacagtagcccgtgtagcgcttttgaattccactgcctctccggagaatgtatccatagttcctggaggtgcgatggtggtcctgattgcaaagataaaagcgacgaagagaactgcgctgtcgctacttgccggcctgatgaatttcagtgtagcgatgggaattgcatccatggcagcagacagtgcgacagagagtatgattgtaaagatatgagcgatgaggttggttgcgtgaatgtcacactctgcgaaggccccaataagttcaaatgccactccggcgagtgcattactttggataaggtttgcaacatggctcgcgattgccgggattggtccgacgaaccaatcaaagaatgtggcactgctgagtgcctggataacaacggagggtgcagccacgtctgcaacgatctgaaaattgggtacgagtgcctgtgccccgatggattccaattggtggctcaacgcaggtgtgaggatatcgacgagtgccaagacccagacacctgtagccagctttgtgtgaatctcgaggggggatataaatgccagtgtgaagagggctttcagctagatccacacactaaagcctgtaaagcagtgggatctattgcctacttgttctttactaacagacacgaggtgcgcaaaatgactctggatcgctctgagtacacatctctgatccctaatctgagaaacgtcgtggcactggataccgaagtggcgagcaacagaatctactggagtgacctcagccaacggatgatctgctctacccaattggaccgggctcatggtgtctctagttacgacaccgtcatcagtcgtgacatacaagctccggacggtctggcagtggattggatccacagtaacatctactggacagactcagtgttgggaacagtgagtgtagccgacactaaaggtgttaagcgaaagacgttgtttagggagaacggttccaagccgcgagctatcgtggtggatccagtgcacggcttcatgtactggacagattggggaactccagcaaagattaagaaaggtgggcttaacggggtggatatctactctcttgtcacagagaatatccaatggccaaacggcatcaccttagaccttctgtctggccggctctactgggttgactctaaactgcacagtatctcatctattgatgtgaatggaggaaacaggaaaacaattctggaagacgagaagaggctcgcccaccccttttcactagccgtgtttgaggataaggtcttttggaccgatatcatcaacgaggctatcttcagtgccaatcgactaacaggtagtgatgtgaacttgctggccgagaacctgctgagtcctgaggacatggtcctttttcacaacctcacacagccgaggggggtcaattggtgtgaaaggaccacactttcgaacggcggctgccagtatttatgtctgcctgccccacaaatcaacccacattcacccaaatttacctgtgcctgcccagacggtatgcttctggctagggatatgagatcatgcctgacagaggcagaggcggctgtggccacccaagagacatccacagtgcgcctcaaagtctctagcaccgctgtgagaacacagcacacaacaacacggccggttccggatactagtagactcccaggggctacaccaggactgactaccgtggagatcgtgaccatgtcccatcaagccttgggggatgtggccggcaggggtaatgagaaaaaaccatccagcgtgcgtgctctttctatcgtactgccgattgtccttttggtctttctgtgtctgggagtgtttctcctgtggaagaattggcgcctgaagaacattaattcaatcaacttcgacaaccccgtgtaccagaaaactacagaagacgaagtccacatttgccataaccaggacgggtactcttaccctagcaggcagatggttagcctcgaggacgacgtggca

SEQ ID NO: 434 - DNA, 2580 bp, Artificial Sequence
  Description of Artificial Sequence: Synthetic Transcript Sequence
atgggcccgtggggttggaagctgcggtggacggtggctctcctgctcgcggctgcaggaaccgcggtgggtgatcgctgtgaaaggaatgaattccaatgccaagatggaaagtgcatctcttacaaatgggtctgcgacggaagcgccgagtgccaggatggttcggatgagtcccaggaaacttgtttgtcggtgacctgcaaatcgggcgacttctcgtgtgggggaagggtgaacagatgcatcccccaattctggcgctgtgatgggcaagtggattgcgataatggatcggatgaacagggctgtccgcctaagacctgctcacaggatgaatttcgctgccacgacggcaagtgcatctcacgccagttcgtgtgcgattcggatagagactgcctcgacggttccgacgaggcttcctgcccggtgctcacttgtggccctgccagcttccagtgcaattcatccacctgcatcccacaactgtgggcgtgcgacaacgacccagactgcgaagatgggtctgatgagtggcctcagcggtgcagaggactgtacgtgttccagggagactccagcccttgctccgcgttcgagttccattgcctgtctggtgagtgtatccatagctcatggcgctgcgacggaggaccggactgcaaagacaagtccgatgaagaaaattgcgccgtggctacgtgtaggccagacgaatttcaatgttcggacggaaactgcattcacggctcaagacagtgtgaccgcgagtacgattgtaaggatatgagcgatgaggtaggatgtgtgaatgtgaccctgtgcgagggaccaaacaaattcaagtgccactccggcgagtgtatcactctggacaaggtgtgcaacatggcgcgcgattgtcgcgactggtcggatgagccaatcaaggaatgcggaaccgccgagtgcctggataacaacggaggatgttcccatgtgtgcaatgacctcaagatcggatacgaatgcctgtgcccggatggctttcagctggttgcgcagcggcgctgcgaggacatcgacgaatgccaggacccggatacctgttcgcaactctgcgtgaacttggaaggtggatacaagtgccagtgcgaagaaggattccaactggatccgcacaccaaagcatgcaaggcggtggggtcaatcgcctatttgttctttacgaatcggcacgaggtgcggaagatgactctcgacaggtcagaatacaccagcctgatccccaatctcagaaacgtggtggcactcgataccgaagtcgcctcgaataggatctactggagcgatttgagccagcgtatgatttgtagcacccagcttgatcgggcgcacggagtgtcatcctatgataccgtgatcagcagagatattcaagcccccgacgggcttgccgtggattggattcattcgaacatctactggactgattcagttctggggaccgtgtcagtggcagacactaaaggagtgaagcgcaaaaccctgttccgcgagaatggatccaagccacgagcaatcgttgtggacccggtgcacggatttatgtactggaccgactggggcaccccggccaaaatcaagaagggagggctgaacggagtggacatatactcactggtgactgaaaacatccaatggccgaacggcatcactctcgacctgctcagcggacggctctactgggttgattccaagttgcattccatttcgagtatcgatgtcaatggtggaaacagaaagactatcctcgaagatgaaaaaagactggcccacccgtttagcctggcggtgttcgaagataaagtgttctggactgacattatcaacgaagctattttctcagccaatcgcctgactggaagcgacgtcaatctgctggccgagaaccttctgtccccggaggacatggttctgtttcacaacctgactcaaccgcggggagtgaattggtgtgagcgcaccactctgtcaaacggaggatgccagtacctctgtctcccggctccgcagatcaacccacattctccaaaattcacttgcgcctgtccggatggaatgctgctcgcgagggatatgcgctcatgcctgactgaagcggaggcggcggtggctacccaggaaaccagcaccgtgcgcctcaaagtctccagcacggcggtccgcactcagcacaccaccactagaccggtgccggacaccagcaggctcccgggggccactcctgggctgactacggtggaaatcgtcactatgtcccatcaggcattgggagacgtagcaggccgcggcaacgagaagaagccttcgtcggtgcgtgcgctgtctatcgtgctgccgatcgtcctgttggtgttcctctgcctcggtgtgttcctgctgtggaagaattggcgcttgaagaatatcaacagcatcaatttcgacaatccggtctaccagaaaaccactgaagatgaggtgcacatctgccacaaccaagacggatacagctacccgtcaagacagatggtgtccctcgaggatgacgtggcc

SEQ ID NO: 435 - DNA, 2580 bp, Artificial Sequence
  Description of Artificial Sequence: Synthetic Transcript Sequence
atgggcccctggggttggaagctgcggtggacagtggccctgctactggccgcggccggaaccgcggtgggagacaggtgtgagaggaacgagttccagtgtcaggacggtaagtgcatctcttataaatgggtctgtgacggatccgcagaatgtcaggatgggtctgatgagtcgcaggagacctgtctgtctgtcacctgcaagtccggcgattttagctgcgggggacgggtgaacaggtgcatcccacagttttggcgatgtgatgggcaagtggattgtgataatggctctgatgagcagggctgtcccccaaaaacctgctcacaggatgaattccgctgccacgacggcaagtgtatttcaagacagttcgtttgcgacagtgaccgagactgtctggacggatcagacgaggcatcctgccctgtcctcacatgcggccccgccagcttccagtgcaattcttctacatgcatcccacagctttgggcttgtgacaatgacccagattgcgaggacggaagtgacgagtggccacaaaggtgccgcggtctgtacgtattccagggcgactcttccccatgctctgcgttcgagttccattgtctctcaggcgagtgcatccattccagttggcgctgtgacggtggcccagattgcaaagacaagtccgatgaagagaattgtgcagttgctacatgtcggccagatgaatttcagtgtagtgatggaaactgtatccacgggtctaggcagtgcgaccgagagtacgattgcaaggatatgtctgacgaagtgggttgtgtgaatgtcacactttgcgaaggacccaacaagtttaagtgtcacagtggagagtgtattacactggacaaggtttgtaacatggctagagactgccgggattggtctgacgaaccaataaaggagtgcgggactgctgaatgccttgacaacaacgggggctgcagccacgtttgtaacgaccttaaaataggctatgaatgcctctgccccgacgggtttcagcttgtcgcgcagcgtcgttgcgaggacattgacgaatgtcaggaccccgacacgtgtagtcagctgtgcgtaaacctggaagggggatataaatgtcagtgtgaggagggattccagctggacccccacactaaagcctgcaaagcagtgggcagcatcgcctacttgttctttacgaatcgacacgaggtaagaaagatgacacttgaccgatctgaatacacatcgctcattcctaatctgcggaatgttgttgctctggataccgaagtggccagcaatcgcatctactggagcgacctgtcgcaacgtatgatctgttccacacagctcgatcgcgctcacggggtatctagctatgacacggtgatatcgagggacatccaggccccggacggtctcgcggtggattggatccatagcaatatttactggacagattccgtacttggcacggtgtctgtcgcagacactaagggtgtgaagcgcaaaactctgtttcgggaaaacggatccaagccccgagccattgtggtcgaccctgtacatggctttatgtactggaccgattggggaacacctgccaaaataaaaaaaggcgggttgaatggggtcgacatttacagtctggtcactgagaacatacaatggccaaacggcatcactctggacctgctaagcgggcgcctgtactgggtggactctaaactccattccatctcctcaattgacgtaaatggggggaatcggaaaacaatcctggaagacgagaagcgcttagcccaccccttttctctggcagtttttgaggacaaggtgttttggactgacatcatcaatgaggccatcttctccgcaaatcgcttaacgggatctgatgtaaaccttctcgccgaaaacctgttgagcccagaagatatggtcttgtttcataatctgacccagccccgcggagtgaattggtgcgagcgcacgaccctgtccaatgggggatgccagtacctatgcctacccgccccccagattaatccccattctcctaaattcacttgcgcatgtccagatggaatgttactggcgagagatatgcgcagttgcttgacggaggccgaagcagccgttgccacccaggaaaccagtacagtgcgacttaaagtgtcgtcaactgctgtgcgcacccagcatactactacacgtcccgtacccgatacgtcacgcctgccaggcgctacccccgggctgaccactgtggaaatagtcacaatgtctcatcaggctttaggggacgtagcgggacggggtaacgagaaaaagccttcttctgtgcgcgctcttagtatagttctgcctatagtgctcctggtcttcttgtgccttggggtgtttctgttatggaaaaactggcggttaaagaatattaactcaattaacttcgacaatccagtgtatcagaaaaccaccgaggatgaggtccatatctgtcataatcaggacggatattcctaccccagccgacagatggtcagcttagaggatgacgtggcg

SEQ ID NO: 436 - DNA, 2580 bp, Artificial Sequence
  Description of Artificial Sequence: Synthetic Transcript Sequence
atggggccctgggggtggaagttgagatggactgtcgcactgctgttagcggcagccggcacagctgtaggtgacagatgtgagcggaacgaattccagtgtcaggatggcaaatgtataagctataaatgggtatgcgacggctccgctgagtgccaagatggaagtgacgaaagccaggagacatgtctttcggtgacatgtaaatccggggactttagctgcggaggcagagtgaatagatgtattcctcaattttggcggtgtgacggtcaggtagattgtgataatggctccgatgagcaagggtgtccccccaagacctgtagccaggatgaatttaggtgccatgatggtaagtgtatatccagacagttcgtttgcgattctgacagagattgtctggatgggtctgacgaagcttcctgccctgtgctgacgtgcggacccgcttcatttcagtgcaattccagcacatgtatacctcagctgtgggcatgcgataacgaccctgattgtgaagacggaagcgacgagtggccacagagatgccgaggtctttacgtgttccagggagattcttctccttgctcagcgtttgagtttcactgcctgtccggcgaatgtattcattcatcatggaggtgcgacggcgggcccgactgtaaggataaatccgatgaggagaattgcgcggtagctacttgcagacctgacgagtttcagtgtagtgacgggaattgtattcacggatctcgtcagtgcgatcgcgagtatgactgcaaagacatgagtgacgaagtagggtgcgtgaatgttacactgtgcgagggcccaaacaagttcaagtgccattcgggggaatgtattacgctcgacaaagtgtgcaatatggctcgagactgcagggactggagcgatgaaccaattaaggaatgtggcaccgccgaatgcctcgacaacaatggcggctgctcgcatgtctgcaacgatctcaaaatcggttacgagtgtctatgcccggacggatttcagttggttgcccagagacggtgcgaagatatcgacgaatgccaagaccccgacacatgcagccagctctgtgtgaacttggagggcggatacaagtgtcagtgtgaggaagggtttcagctggatccccataccaaagcttgcaaagctgtgggatccattgcctatctcttcttcactaatcgccacgaagtgcggaaaatgactctggaccgttcagaatatacctcccttatacctaatctccggaatgtcgtcgcgttagacacagaggtggcaagtaacagaatatactggagtgacctgagccagaggatgatttgttctacccagcttgatcgcgctcacggcgtcagctcatatgacacagtcatcagtcgggatattcaagcaccagatggattagcggtggattggatccactccaacatttattggaccgactcggttcttggtaccgtctcagtcgctgatactaagggcgttaagagaaaaactctttttcgggagaacggcagcaagccccgtgctatcgttgtggacccagtgcatgggtttatgtattggaccgattggggcacacctgctaaaataaaaaaaggtggattgaacggtgtcgacatttatagcctcgtaacggaaaacattcaatggccaaatggcattactctcgacctgttatcaggccgcctgtattgggtggattctaagctccattccataagttcaatcgacgtaaacggcggcaatagaaagaccatcctagaggatgaaaaacgtttagcccacccattttccctcgctgtgttcgaggataaagttttttggacagatatcataaatgaggccatcttctcagcaaacagactcacagggtcggacgtcaatctactagccgagaatctacttagccctgaagatatggtcctgtttcataacttaacccagccccggggagtgaactggtgtgagcgaacaacactgtctaacggcggctgccagtatctttgccttccggcgcctcagataaatccacattcccctaagtttacctgtgcctgtcccgacggcatgctgctggcacgggatatgcggtcttgtctcaccgaggctgaggcagccgttgccacgcaggaaactagtacagttcggctgaaagtctccagtaccgcagtcaggactcagcatactactactcggcccgtcccagatacatctcgcctgcccggagctacgccaggtctgaccactgtggagattgtgaccatgtcccaccaagcattgggggacgtcgcaggacgcggcaatgaaaagaaaccatcaagcgttagggccctctcgatcgtgctgccaatagtgcttctggtcttcctgtgcctgggggttttcctgctttggaagaattggcgccttaagaatatcaattctataaacttcgacaaccctgtataccaaaagaccactgaagatgaggtccatatttgccacaatcaagatggatattcctacccctccaggcagatggtgtctctggaggatgatgtcgct

SEQ ID NO: 437 - DNA, 2580 bp, Artificial Sequence
  Description of Artificial Sequence: Synthetic Transcript Sequence
atgggtccttggggatggaaactgagatggactgtggcgctgcttcttgccgccgcaggtactgcagtgggggaccgctgtgagaggaacgaattccagtgtcaggacggaaagtgtatctcctacaagtgggtgtgtgatgggtcagcagagtgtcaagatggatccgatgaatcacaggaaacttgtttgtcggtcacctgtaaatccggggatttctcctgcggtggcagagttaatagatgtataccgcagttctggcgatgtgatggacaggtggattgtgataacggatcagacgagcaaggatgccctccgaaaacttgttcccaagacgagtttagatgccacgatggtaagtgcattagcagacagtttgtgtgtgacagcgacagagattgtctcgatggttcggatgaggcttcgtgcccagtcctgacctgtggtccagcgtcatttcaatgtaatagctctacctgtattccccagctctgggcgtgcgataacgaccccgattgtgaggacggctccgacgaatggccacaacggtgccgcggactgtacgtgtttcagggtgattcgtccccttgttccgcgttcgagttccattgtctttcgggagagtgtatccactcgtcgtggcgctgtgatggtggacccgactgtaaggataagtcagatgaggaaaattgcgctgtggccacctgtagacctgatgagtttcagtgctccgacggaaactgtatccatggctcccggcagtgtgatcgggaatacgattgtaaggacatgtcggatgaggtcggctgtgtcaacgtgacgctgtgcgagggacccaataagtttaagtgtcattccggagagtgcatcactctggataaggtgtgtaacatggctcgagactgccgggattggtcggatgaaccaatcaaagagtgtggaactgctgaatgtcttgataacaatggcggttgtagccatgtctgtaatgacctgaagattggatacgaatgtctgtgccctgatggctttcaacttgtggcacagcggcgttgcgaagatatcgacgaatgtcaggatccggatacttgttcgcaactctgcgtgaaccttgaaggaggatacaagtgccagtgtgaagaggggttccaacttgacccacatactaaggcatgtaaagcagtggggagcatagcgtacctgtttttcactaaccgacatgaagtgcgcaaaatgaccctggacaggtcagaatacacctcactgattcccaatcttcgtaatgtggtggcactggatactgaagtggcaagcaaccgcatctactggtcggacctgtcgcagcggatgatttgttcgactcaactggacagagcacatggtgtctcctcctacgataccgtgatatcaagagatattcaggcgcccgatggtcttgcggtcgactggatacatagcaacatttactggactgattccgtgctgggcaccgtctcggtcgccgataccaagggggtcaaacgtaagaccctttttcgggagaacgggtcgaagcctcgtgccatagtggtggaccctgtccatggatttatgtattggactgactggggtacccctgcaaagataaagaagggcggcctcaatggtgttgatatctactcactcgtgaccgaaaacatccaatggccgaatggtattaccctcgatctcctgtcggggagactttactgggtggattcaaaacttcactcgattagctccatcgacgtgaacggtgggaacagaaagaccatattggaagatgaaaaacggctggctcatccattctcgctggccgtgtttgaggacaaggtgttctggaccgacataatcaacgaggccattttctccgccaaccgtttgaccggtagcgacgtgaatctgctggcagaaaatctgctctcccctgaggacatggtcctgttccataaccttacccaaccgaggggtgtcaattggtgcgagcgcaccacgctgtcaaatggtggttgtcagtatctctgccttcctgcaccacaaatcaatccacattcccctaagttcacctgcgcctgtcccgatggcatgctgctcgcacgtgacatgcgatcgtgcctgactgaggcagaagccgccgtggcaactcaagaaaccagcactgtgcgtttgaaggtttcgtcgacggcagtgagaacgcaacataccactacgcgcccggtccctgatacctcccggctccccggcgcaactccaggacttaccaccgtggaaattgttactatgtcccatcaggcgcttggtgacgttgcagggagaggtaacgagaagaagccctcatcggtgagagcactttcaattgtgttgcccatcgtccttctcgtgttcctgtgtctgggagtctttctcctttggaaaaactggcgacttaagaacataaactccatcaatttcgacaacccggtgtaccagaaaacgactgaagatgaagtccacatatgtcacaaccaggatggatactcgtacccctctcggcaaatggtgtcactggaagatgacgtcgca

SEQ ID NO: 438 - DNA, 2580 bp, Artificial Sequence
  Description of Artificial Sequence: Synthetic Transcript Sequence
atggggccgtggggctggaaactgagatggaccgtcgcgcttctgctggcggcggccggtaccgcagtcggcgaccggtgcgaaaggaatgaattccaatgccaagacggaaaatgcatttcctacaagtgggtgtgcgacggctcagcagagtgtcaggatggatcggatgagagccaggagacttgcttgtctgtgacctgcaagtccggtgacttttcttgcggaggccgcgtgaacagatgcatcccgcagttctggagatgcgatggtcaggtggactgcgataacggaagcgacgaacagggatgccctccgaaaacctgctcgcaagatgaattccgctgccatgacggcaagtgcatcagccgccaattcgtgtgcgattccgacagagactgcctggacggatcggacgaagccagctgccccgtgctgacttgcggcccggcctcctttcagtgtaattcaagcacctgcataccacagctctgggcatgtgacaatgatccggattgtgaagatggctccgacgagtggccacaacgctgccggggattgtacgtctttcagggcgactcgagcccgtgtagcgcgttcgagttccattgtttgtccggagagtgcatccattcgtcttggcggtgcgatggaggaccagactgtaaggacaaatcggatgaggagaattgcgcggtggcgacttgtcgcccggatgagtttcaatgctccgacgggaactgcattcacggcagccgccagtgcgatcgagaatacgactgtaaggatatgtccgacgaggtcggctgcgttaacgtgactctctgcgaaggaccgaacaagttcaagtgccattccggtgaatgtatcactctggacaaggtgtgcaatatggcacgggattgtcgggattggtctgacgagcccatcaaggaatgtggaactgccgaatgcctcgacaacaacggtggttgcagccatgtgtgtaacgacctgaagatcggctacgaatgcctctgcccagacggtttccagctggttgcacagcggagatgcgaagatattgatgagtgccaggatcccgacacgtgtagccagctgtgtgtgaatcttgagggcgggtacaagtgtcagtgtgaggaaggattccaattggacccgcacaccaaagcctgcaaggcggtgggctcgatcgcctacctgttcttcactaatcgccacgaggtgaggaaaatgactctggaccgctcggaatacacctcgctgatcccgaatttgagaaatgtggttgccctggataccgaagtggccagcaatagaatctactggtctgacttgtctcaacgcatgatttgttcaacccagttggaccgggcacacggagtctcctcctacgatactgtgatctcgcgcgacatccaggcaccggacggactggccgtcgattggattcacagcaacatctactggacggattcggttctgggaactgtgtccgtggcagacactaagggagtcaagaggaaaactctcttccgggagaatggctcaaagcccagggccatcgtcgtggatccggtgcatggcttcatgtactggaccgattggggaactcccgccaaaatcaaaaaaggaggactgaacggagtggatatctattcgctcgtgaccgagaatatacagtggccgaacggaatcaccttggatctgctcagcggaaggctgtactgggtcgatagcaagctgcacagtatctcatccatcgacgtgaatggtggcaacagaaaaaccatactggaggacgaaaagcgcctcgcgcaccctttttccctcgcggtgttcgaagataaggtcttttggacggatatcattaacgaagctattttctcagccaaccgcctgaccggttccgatgtgaacctgttggcagagaatcttctctcccctgaggatatggtgctgtttcacaatcttactcaaccacgcggagtgaattggtgtgaaagaaccaccctgtccaacgggggatgccaatacctgtgcctcccggcccctcagatcaacccgcacagcccaaagttcacttgtgcttgccctgatggcatgctcctcgcgagagatatgcgctcgtgtctcactgaagctgaagccgccgtggctactcaggaaacgtcgaccgtgcgcctcaaagtgagctcgaccgctgtgcggacccaacataccactactcggcctgtgcctgatacttcgaggctgcctggagctacgccgggccttacgacggttgaaatcgtcaccatgagccatcaagctctcggagatgtggcgggacggggaaacgaaaagaagccctcctcagtccgggcgctctccatcgtgctccccatcgtgcttctggtgtttttgtgtctgggagtattccttctgtggaagaattggcgcctcaagaacatcaactccatcaacttcgacaacccggtttaccagaaaactaccgaggacgaagtgcacatctgccacaatcaggacggctattcctacccttcacggcaaatggtatccctggaggacgacgtggca

SEQ ID NO: 439 - DNA, 2580 bp, Artificial Sequence
  Description of Artificial Sequence: Synthetic Transcript Sequence
atggggccgtggggatggaagctgagatggactgttgcactcctgctggcggcagccggaactgctgtgggtgatcgttgcgaaaggaatgagtttcaatgtcaagatggtaaatgtatctcgtacaagtgggtgtgtgacggatcagccgaatgccaagacggatcagacgagtcgcaagaaacctgcctgtccgtcacttgcaagtccggggacttctcctgtggcggacgggtgaatcggtgcattccgcagttttggcggtgcgacggccaggtggactgtgacaacggaagcgacgaacaggggtgtcctccgaaaacttgtagccaagacgagttccggtgtcacgatggtaaatgcatctcgcgccagttcgtgtgcgactcggacagagattgcctcgatggatccgacgaggcttcttgccctgtgctgacctgcggtccggcctcgtttcagtgcaactcgtccacctgcatcccgcaactttgggcctgcgacaatgaccctgactgcgaagatggatccgatgaatggcctcagcgctgtcgcggcctttatgtgttccagggtgattcatccccgtgttcagccttcgagttccactgcctgtcgggcgaatgcatccattcgtcctggcgctgcgacggcggccctgattgcaaagataaatcggatgaagaaaactgtgcggttgcgacgtgtagaccagacgaattccaatgctctgacggtaactgcatccacggatcgagacaatgtgatcgtgaatatgactgtaaggacatgagcgatgaggtcgggtgtgtcaatgtcaccctctgcgaaggtccgaacaaattcaagtgccatagcggagaatgcatcacgctggataaggtctgcaatatggcccgcgattgtcgggattggtctgacgaaccgatcaaagaatgcggaaccgcagaatgcctggacaataacgggggatgctcacacgtctgcaatgatctgaagattgggtacgaatgtctctgcccagacggcttccaactggtggctcagaggagatgcgaggacatagatgagtgccaggaccccgacacttgctcacaactgtgcgtcaatctcgagggaggatacaaatgccagtgtgaggaaggattccagctcgatccacacactaaggcatgtaaagccgtcggttcgattgcctacctctttttcactaatcgacatgaggtgagaaagatgactctcgatcgatcagaatacaccagcctcatcccgaaccttcggaatgttgtggcgctggatacggaagtggcctcaaaccgcatctactggtcggacctctcgcagcggatgatctgctcgactcaattggatcgtgctcatggagtcagctcctacgataccgtgatcagcagagacatccaggcccctgacggcctcgccgtggactggatccattcaaacatctactggaccgactcggtcttgggtaccgtctccgtggcggacaccaaaggagttaagcggaaaaccctttttcgcgagaacgggtcgaaaccgcgcgcgatcgtggtggacccagtgcatggttttatgtactggactgactggggaactccggccaagatcaagaagggaggcctcaatggggtggacatctactctctcgtgactgagaacatccaatggcccaacggcattaccctggacctgctgtcaggacgcctgtactgggtggattcaaagctgcatagcatcagctccatcgacgtgaacggaggcaatcgcaaaacgatactggaggatgagaagcggctggcgcatcctttctccctcgcagtgttcgaggacaaggtgttctggactgatatcatcaacgaggcaattttcagcgcgaataggctcactggctcggatgtgaacctgctggcagagaacctgttgagcccggaggatatggtcctgtttcacaatctgacccagccgcggggcgtcaactggtgcgaaagaacgaccctttcgaacggcggctgccagtacctctgcctgccggctccgcagatcaacccgcactctccaaagttcacttgcgcttgcccggacggaatgcttttggcccgggatatgagatcttgcttgactgaagcggaagccgccgttgcgacgcaggagacttcgactgtgcggctgaaagtctcctccactgcggtgcggacccagcacacgactacccgcccagtgccagacacctcaagacttccgggagctaccccaggcctcaccaccgtcgaaatcgtgaccatgagccaccaggctcttggtgatgtcgctgggcgcgggaacgaaaagaaaccaagctcggtgcgcgcgttgtccatcgtccttccgatcgtcttgttggtgtttctgtgcctcggcgtctttctgctgtggaagaattggcggctcaagaacatcaacagcatcaacttcgacaaccccgtctaccagaaaactacggaggacgaagtgcacatttgccacaatcaggacggatactcctacccgagccgacagatggtgtcactggaggacgacgtggcc

SEQ ID NO: 440 - DNA, 2580 bp, Artificial Sequence
  Description of Artificial Sequence: Synthetic Transcript Sequence
atggggccatggggatggaagctgcgatggaccgtcgccctgctgctggcagctgcaggaactgccgtgggtgatcggtgcgagcggaacgaattccagtgccaggacggtaaatgtatctcgtacaaatgggtgtgtgacgggtcggcagagtgtcaagacggctcagatgaatcacaggaaacttgcctctccgtcacttgtaagagcggggacttctcttgcggcggtcgcgtgaatagatgcatccctcagttctggcggtgcgacggacaggtggactgcgataatggaagcgacgagcagggctgtcctccgaaaacttgttcgcaggacgagttcaggtgccacgacgggaagtgcatatcccggcaattcgtgtgtgactcggatagagattgcctggacggatcggacgaggcctcctgccccgtgctcacttgtggacccgcgtccttccaatgtaactcctccacttgcatcccgcaattgtgggcctgcgataacgatccggactgcgaagatggtagcgacgagtggcctcaacgctgcaggggcctgtacgtgttccagggtgattcctcaccatgctccgcgtttgaattccattgcctttcgggagagtgcattcatagctcatggagatgcgatggcggaccagattgcaaggacaaatctgacgaggagaactgcgccgtggccacctgtcgcccagacgaatttcagtgttcagatgggaactgtatccatggttcgcgccagtgcgatcgcgaatatgactgcaaggacatgtcggacgaagtgggatgcgtgaacgtcacgctgtgtgagggtcccaacaagttcaagtgccattctggagaatgcatcaccttggataaagtgtgcaatatggcacgcgattgcagagactggtccgacgaaccgataaaagaatgtggcaccgccgaatgtcttgataacaacggaggatgctcccacgtgtgcaacgacctgaagatcgggtacgagtgcctgtgtccagatggcttccagctggttgcgcaacgccgctgcgaggacattgacgaatgccaagacccggatacctgcagccagctctgcgtgaacctggaggggggctacaagtgccaatgcgaggaaggattccagctggacccgcacactaaggcctgcaaggccgtcggatcgatcgcgtacttgttctttaccaacaggcacgaagtgcggaagatgactctggatagatcagaatacaccagccttatccctaacctgcgcaacgtcgtggcgctggataccgaggtggcaagtaatcgcatctactggagcgacctttcccaacgcatgatctgctccacgcaactggatcgcgcccacggcgtgtcgtcgtacgacactgtgatctccagggatattcaagcgcctgacgggctcgccgtcgactggatccacagcaatatctactggaccgactcggtactgggaactgtgtcggtggccgacacgaaaggagtcaagcgcaaaactctgtttcgggaaaacggatccaagccgagggcgattgtcgtcgacccggtgcacggattcatgtactggactgactggggaacgccggccaaaatcaagaagggagggctcaatggtgtggacatctacagcttggttactgaaaacatccagtggccaaacggcataactcttgatctgctgagcggaaggttgtactgggttgactccaaactgcacagcattagctcaatcgacgtcaacggaggcaaccgcaagaccattctggaggatgaaaagagactggcccacccttttagcctggcggtgttcgaggataaggtcttttggactgatatcatcaacgaggcaatcttctccgcgaatcgcctgactggatcagatgtgaacctgctggctgaaaacctgctgtcacctgaggacatggtcttgttccacaatttgacccagccaagaggtgtgaactggtgtgagcggactacccttagtaatggaggctgtcagtatttgtgcctgccggccccgcagattaatccgcacagccctaagttcacgtgcgcatgccccgacggcatgcttttggcaagggacatgcgctcgtgtctcacggaggcagaggccgccgtggctacccaggaaacctccacggtcagactgaaggtttcatcgaccgctgtgcgcacccaacataccaccactaggccggtcccagatacctcccgtctgccgggtgccaccccgggacttactactgtggaaatcgtgaccatgtcgcatcaggccctgggagacgtcgctggacgcggcaacgaaaagaaaccttctagcgtaagggcgctgtccatagtgctcccgattgtcttgctggtctttctttgcctgggcgtctttctgctctggaagaattggcggctcaagaatatcaactcaatcaatttcgacaatcccgtttaccaaaaaaccacggaggatgaagtccacatctgccataaccaggacggatactcgtacccatccagacagatggtgtccctcgaagatgacgtggcc

SEQ ID NO: 441 - DNA, 2580 bp, Artificial Sequence
  Description of Artificial Sequence: Synthetic Transcript Sequence
atggggccctgggggtggaaactcaggtggacagttgcactgctactcgcagctgccggtaccgctgtgggcgatcgttgtgagcgtaacgagtttcagtgccaggatgggaaatgcataagttacaagtgggtctgcgatggatctgctgagtgtcaagacggttctgatgaatctcaggaaacttgcctctcagtgacatgcaaatcaggtgatttctcatgtgggggccgtgtgaatcgatgtataccccagttctggaggtgcgacggtcaggtggattgcgacaacggtagcgacgagcaggggtgccccccaaaaacttgttcacaagatgaattccgatgccatgacggaaaatgcatctcccggcaatttgtctgcgattccgatcgggactgcctcgatggttctgatgaagcctcttgtcccgtactgacatgtgggccagcctcattccagtgcaacagttcaacctgtattccacaactatgggcctgcgacaatgaccccgattgcgaggatggtagtgatgaatggcctcaacggtgtagagggctgtacgtgttccagggtgattcttccccctgcagtgcatttgaatttcattgtctgtccggggaatgcattcactcctcatggcggtgtgacggcgggcctgactgcaaagacaaatcggacgaggagaattgcgccgtggcgacctgtcggccagatgagttccagtgtagtgacggcaattgcattcacggcagccggcagtgcgatcgcgagtatgactgcaaggacatgtcagacgaagtgggatgcgtgaacgtgaccctgtgcgaaggcccaaataaattcaagtgccactcgggcgagtgcattaccctggataaggtgtgtaatatggcgcgggactgcagggactggtccgacgagcccattaaggagtgtgggaccgcagagtgtctggataacaacggaggctgttcacacgtatgcaatgaccttaagatcggctacgagtgcctctgccccgatggtttccagttggtggcccaaaggcggtgtgaagacattgacgagtgccaggaccctgatacgtgttcacagctttgcgttaatcttgagggcgggtacaagtgtcagtgtgaagagggctttcagctcgacccccacaccaaagcctgcaaagcggtgggatcaattgcctacctcttttttaccaaccgacacgaagtacgcaagatgaccttagataggagcgagtacacatctctcatcccaaatctgcggaacgtagtcgcattggacacagaggtcgcttccaatcgcatttactggtccgatctctcacagaggatgatctgcagtacacagctagacagagcacacggcgtgtcgtcatatgatacagtcatcagtagagatatacaggctccagacggtttggctgtcgattggattcacagtaacatttactggaccgattccgtgctcggtactgtgagcgttgctgacacgaaaggagtgaagcgcaagacccttttccgagagaatggatctaaacctagggccatcgtggtggatcctgttcatggtttcatgtattggaccgactggggcactcccgcgaagatcaagaaaggcgggctgaacggtgtcgacatatatagtctggtaaccgaaaacatacagtggccaaatggaatcactctggacctcctttcagggcgtctgtactgggtcgattcaaagctgcattccatttcaagcatcgacgttaacggcggcaatcggaaaacgatcttggaggacgagaagcggctggcacacccgttttccctcgcagtgtttgaggataaagttttctggacagatataataaatgaagctatcttctccgcaaaccgtctaacaggcagtgatgtgaacctattagctgagaatctgctttctcctgaggacatggtcctgtttcacaatttgacccaaccaaggggtgtgaactggtgcgagaggacaactctgtccaatggcggctgtcagtacctctgccttcccgccccacagattaacccacacagtcccaagttcacgtgcgcttgccccgatgggatgctgttggcacgagacatgcgatcttgcttgaccgaggcagaggccgccgtcgccacccaggaaacaagcacggtaaggctgaaggtttcatccaccgccgtaagaacccagcacaccactaccaggccagtgccggacacaagccgcctgccaggagctacgcccggcctaaccacggtcgaaatcgtgacgatgtctcatcaggccttaggggacgtagctggccgtggaaatgagaagaaacctagtagtgtgagggcgctctccatcgtgcttcctatcgtcctactggtgttcctatgtctaggtgttttcttgctgtggaagaactggcgcctaaagaatatcaattcaatcaacttcgacaaccccgtgtaccagaagaccactgaggatgaggtgcacatctgccataatcaggatggatacagttatccttctcgccaaatggtgtccctcgaagacgatgttgcc

SEQ ID NO: 442 - DNA, 2580 bp, Artificial Sequence
  Description of Artificial Sequence: Synthetic Transcript Sequence
atgggtccttggggatggaaactgagatggacggtcgccctgcttctggcagccgccgggaccgcagtcggtgaccgctgcgaacgaaacgaatttcagtgccaagatggcaagtgtataagctacaaatgggtgtgtgatggtagcgccgaatgccaggacggaagcgacgagagccaagaaacctgccttagcgttacgtgtaaatcaggagatttctcgtgtggtggaagagtgaaccgctgtattccgcagttttggagatgtgatggccaggttgattgtgataacggcagcgatgagcaaggatgcccccctaagacctgcagccaggatgaatttcggtgtcacgacggaaagtgtatctcgagacaatttgtgtgtgactcggatcgtgactgccttgatggatcggacgaagcgagctgcccggtgttgacctgtggccctgcatcttttcagtgcaatagttcaacctgtattccacaactctgggcatgcgataatgatccagattgcgaggacgggtccgatgaatggccacaacgctgtagaggactctacgtgtttcaaggagattcctctccctgttccgcgttcgaatttcattgtttgtcaggagaatgcatacactcctcatggcgctgtgatggtggacccgattgtaaggataagtccgatgaagaaaactgcgccgtggccacgtgccgtccagatgagttccaatgttcggatggaaattgtattcatgggtccagacaatgtgacagagaatacgattgcaaggatatgtcagatgaagtcggttgtgttaatgtgaccctgtgtgagggacccaataagttcaaatgtcattcgggagaatgtattaccttggataaagtgtgcaatatggcacgggattgccgggattggagcgatgaacctattaaggagtgcgggaccgctgagtgtctggataacaacggaggatgttcacacgtctgcaatgaccttaagataggatacgaatgcttgtgtcccgacggttttcagctcgttgctcaacgtcgatgcgaagatatcgatgagtgtcaggaccccgatacgtgttcgcaactctgtgtgaatctggagggaggctacaagtgccagtgtgaggagggcttccaactggacccacataccaaggcatgtaaagcagtggggtcaattgcatatcttttctttaccaacagacatgaggtcagaaaaatgactcttgatcgctccgagtacacttcactgattcccaacctgcgcaacgtggtcgcgctcgataccgaagtggccagcaacagaatctactggtcggatcttagccaacgcatgatctgctcgacgcagcttgatagagcacacggagtgtcctcctacgataccgtgatctctagggatattcaagcacctgatgggcttgcagtggactggattcactcaaacatttactggactgatagcgttcttggaactgtgtccgtggctgacacgaaaggtgtgaagcgtaagacccttttcagagaaaacgggagcaaaccaagagcgatcgtggtggatccagtccacggttttatgtactggacggattggggcactcccgcgaagattaagaagggtggactcaatggtgtggacatctactcgctggtgactgaaaacatccaatggcctaacggaattactcttgatctgctgtcgggaagattgtactgggtcgattcgaaacttcatagcatttccagcattgatgtgaatggcggcaatcggaaaaccattctggaggatgaaaagagacttgcccatccatttagccttgccgtgtttgaagataaggtgttttggactgacatcataaatgaagcgatcttttcagccaatcgattgactggatccgacgtgaacctgttggctgaaaacctgctctctcctgaggatatggtgctgtttcacaaccttactcagccgaggggagtcaattggtgtgagcggactaccctttcgaacggcggctgtcagtacctttgcttgcctgcccctcagataaaccctcactcgccgaagttcacctgcgcatgtccagacgggatgcttctggcccgggatatgcgctcctgcctcaccgaagcagaggcagcagtcgcgacccaggagacttcaaccgtccgtctgaaagtgtcctcgactgcggtgcgcactcagcatacgaccacgcggcctgtcccagacacttcgaggctgcccggtgcgacgccgggactgacgacggttgaaatagtgaccatgtcccatcaggcacttggagatgtcgcaggcagaggaaacgaaaagaagccctcttcggtgcgcgcactttcaatcgtactgcctatcgtgttgctcgtctttctttgtctgggggtctttcttctctggaagaactggcgcctcaagaatatcaattccatcaatttcgataacccggtgtaccaaaagactacggaagatgaagtgcatatttgtcataaccaagacggttacagctatccgagtcgacagatggtgtccctcgaagatgatgtggct

SEQ ID NO: 443 - DNA, 2580 bp, Artificial Sequence
  Description of Artificial Sequence: Synthetic Transcript Sequence
atggggccctggggctggaagctccgatggaccgttgcactgttgttggcagcagctggaaccgccgtgggagatagatgcgaacggaatgagttccaatgccaggacggcaagtgcattagctacaaatgggtctgcgacgggtctgcggaatgccaggacggctccgatgagtctcaggagacttgcctgagcgtcacctgcaaatcaggcgacttctcttgcggcgggagggtcaaccgatgtattccccagttctggcggtgcgacggacaagtggactgcgataatggcagcgacgagcaaggatgccctcccaaaacctgctcacaggacgagttccgctgtcatgacggtaagtgcatttctagacagttcgtctgcgacagcgatcgcgattgcctggacgggtctgatgaggctagttgtcccgtgctcacgtgtggccccgcctccttccagtgcaactcctcaacatgtataccgcaactgtgggcatgtgacaacgaccctgactgtgaagatggaagtgatgagtggcctcaacgctgccgcggactgtacgttttccagggtgacagcagcccatgctcagccttcgaatttcattgtttgtccggggagtgcatccactcctcttggcgatgtgatgggggacctgattgcaaggataagagtgatgaagagaactgcgccgtggccacgtgtcggccagacgagtttcagtgttctgacggaaactgcattcatgggagtagacagtgtgatagggaatacgactgtaaggacatgtctgatgaggtcggctgcgtgaatgtaacgctgtgcgaaggccccaataaatttaaatgtcattcaggcgagtgcatcacattggacaaggtgtgcaacatggctcgggactgccgggactggtccgacgaacctatcaaggaatgtggcacagccgaatgcctggataataatggaggctgtagccacgtctgcaacgaccttaagatcgggtacgaatgtttgtgcccagatggatttcagctggtcgctcagcgacggtgcgaggacatcgacgaatgtcaggatcctgacacctgcagtcaactgtgtgtcaatcttgaggggggctacaagtgtcaatgcgaagagggattccagctcgacccgcataccaaagcttgcaaggctgttgggtcaattgcctatttgtttttcacaaaccgacatgaggtacgcaagatgacactggaccggagcgaatataccagcttgatccctaatctcagaaatgtcgtggccctcgacactgaggtggcctccaaccgaatatactggtctgatctgtcccagaggatgatttgctcaacacagctggatcgagcgcatggagtttcttcctacgacactgtgatttctcgcgatattcaagcccccgacgggctggccgtagattggatacattctaatatctattggaccgatagcgtgttgggtaccgtgtctgtggcagacacaaaaggggtcaagcgcaagactctctttcgggagaatgggagtaaacccagagcaatagtggtggatcccgtgcacggatttatgtattggaccgattgggggactccagctaagattaagaaaggcggcttgaatggcgttgacatctactccctggttacggagaacattcaatggcccaacggtatcaccttggatttgttgtccgggagactgtactgggtggattcaaagctgcactctatctcctccatcgacgtcaatggaggcaacaggaaaacaatactcgaagacgaaaaaagactggcacatcccttttcactggcagtgtttgaggataaagtcttttggactgacataatcaatgaggcaattttctccgctaatagacttacaggaagcgatgttaatctgctggccgaaaatctgctgtcacccgaggatatggtcctcttccacaacctgacgcagccaagaggcgtgaattggtgcgaaagaaccaccctgtccaacgggggatgccagtatctgtgccttccagccccccagataaaccctcacagcccgaaattcacctgcgcatgtcctgacggaatgttgttggcccgggacatgcggtcctgcctgacagaggctgaagctgccgtcgctacccaggaaacttcaaccgtgagactgaaggttagtagcaccgcggtcagaactcagcatactacaactcggccagttccagatacaagtcgactgcctggagccaccccgggcctgactaccgtcgagattgttaccatgagtcaccaggccctgggagatgtcgccggccgcgggaacgagaaaaaaccctcatccgtcagagccctgagtatcgtactgcctatagttctgcttgtgtttttgtgccttggggtgttcctcctgtggaaaaactggaggctgaagaacattaacagtataaactttgacaatccagtctatcagaaaactacagaggatgaggtacacatttgtcataatcaggacgggtattcctacccctcccggcaaatggtgtccttggaggacgacgtggct

SEQ ID NO: 444 - DNA, 2580 bp, Artificial Sequence
  Description of Artificial Sequence: Synthetic Transcript Sequence
atgggaccttggggctggaaactacggtggacagtggcattactgctagctgctgcaggaaccgccgtgggcgatcggtgcgaaagaaatgagttccagtgtcaagacgggaagtgcattagttacaagtgggtgtgtgacggcagcgccgagtgtcaggatgggagcgacgagagccaagaaacgtgtttgagcgtgacatgcaagtccggtgactttagttgcggcggtagggtgaaccggtgtattccacagttctggagatgtgatgggcaggtcgattgtgataatggtagtgatgaacaaggttgtccccccaaaacatgttcccaggacgaatttaggtgccatgatggcaagtgcatttcccgacagtttgtatgtgacagtgaccgcgattgtcttgatggatccgatgaggcctcctgccctgtgctgacatgcggccctgcctcttttcagtgcaactccagtacatgtatcccacaactatgggcctgtgacaacgaccccgactgcgaagacggtagtgacgagtggcctcaaagatgcagaggcctgtatgttttccagggtgactcgtccccttgcagcgcttttgagttccattgcttgagcggcgagtgtatccatagctcttggaggtgcgacggaggtccggactgtaaagacaagagcgatgaggagaactgcgccgttgccacctgccggcctgatgagttccagtgttcagacgggaattgcatacacgggtcaagacaatgtgatcgagagtacgactgtaaagacatgagcgacgaggtagggtgtgtcaacgtcacgctctgtgaggggcctaataaatttaagtgccactcaggcgagtgtatcacactggacaaggtgtgcaacatggctcgggattgtagagactggtctgacgagccaatcaaggagtgtggaaccgcggagtgccttgataacaatggtggatgctcacatgtttgtaacgacctcaaaataggatacgagtgtttgtgtccagacggattccaactggtcgctcaacgccggtgtgaggatatagatgagtgtcaagaccctgatacctgcagccagttgtgcgtgaacctcgagggtggctacaagtgtcaatgcgaagaggggttccaactggatcctcacacaaaagcctgcaaagcggtgggatccatcgcatatttgtttttcacaaatcgccacgaagtcaggaagatgacattggatcggtcagagtacactagcctgatcccaaacctgcggaacgtggtggccttggatactgaagtagcaagtaaccggatttattggtcagacctgtctcagcgcatgatatgcagtacacagctggaccgcgcacatggagtctctagctatgacactgtgatttcaagagatatacaggcgccagacgggcttgctgttgactggattcattcaaatatctattggaccgattcggtcctgggcacagtttctgtggccgacacgaaaggagtgaaacgaaaaacattgtttagggagaatggttccaagcctagggccatcgtcgtggatccagtccacgggttcatgtactggacggattgggggactcctgctaaaattaaaaaagggggtctcaatggggtggacatttattcactggtgactgagaacatccagtggcctaacggaattacactcgatctgcttagcggtcgactctattgggttgactcaaaactgcacagcattagcagtatagacgtgaatggcggaaaccggaagacaattctagaagatgaaaagagactggcccacccattctccctcgcagtattcgaggataaagtgttctggacggacattattaatgaggcgatattttcagctaacaggttgaccggcagcgatgtgaacctgctggccgagaacttgctttcccctgaggacatggtgttgtttcacaacctgacacagccccgtggcgtcaactggtgcgagaggactactctgtccaatggcggctgtcagtacctctgcctgccggccccacagattaacccgcatagtcccaagttcacatgtgcctgtcccgacggaatgctgctggcccgagatatgcggagctgccttaccgaagccgaagccgctgtcgccacgcaagagacctctactgtgaggctgaaggtatcaagcacagccgtgcggactcagcataccacaacccggccagtaccagacacatcgcgcctcccaggggctacgccggggttgacaactgtggaaatcgtaacgatgtctcaccaggcactgggtgacgtcgctggtcgcggcaatgaaaagaagcctagctctgtgcgcgctttgagtatcgtgctcccaatcgtcctcctcgtgttcctctgcttaggggtgtttctgctgtggaagaactggagattgaagaacattaactccatcaacttcgacaatccggtgtaccagaagactactgaagatgaggtgcatatctgccataatcaagatgggtatagctacccttctagacagatggtcagccttgaagatgacgtagct

SEQ ID NO: 445 - DNA, 2580 bp, Artificial Sequence
  Description of Artificial Sequence: Synthetic Transcript Sequence
atgggaccctggggatggaaactgcggtggaccgtggctctgctgctggcggccgccggcactgcagtcggtgatcgctgcgaacggaatgagtttcagtgtcaggatggcaaatgtattagctacaagtgggtgtgcgacggaagtgctgagtgccaggatggcagtgacgaaagccaggaaacctgcttaagtgtgacatgtaagtccggagatttctcatgcggcggacgtgttaataggtgtattccccagttctggaggtgtgatggtcaggtggactgtgacaatggaagtgatgaacaaggctgtccgccaaagacttgttcacaggatgagtttagatgtcatgatggaaagtgtatctcacgccagttcgtctgcgactctgaccgggactgtttagacgggtctgacgaagctagctgtcccgtgctgacatgcgggcccgcctcgttccaatgtaattcttctacgtgtattccgcagttgtgggcttgcgacaacgatcccgattgcgaagatggcagcgatgagtggcctcagcggtgtcgggggctgtatgtgttccagggcgactcatccccatgctcggctttcgagtttcattgcttgtcaggagaatgcatccatagctcttggcggtgtgacggtggtcccgattgcaaagataagtctgacgaggagaattgcgctgttgcaacttgccgccccgacgaattccagtgtagtgacggtaattgcatccacggctcccgccagtgcgaccgggagtatgactgtaaggacatgtccgatgaggtgggctgtgtcaacgttacactgtgtgaaggccccaacaaattcaagtgccattcgggggagtgtatcaccctggacaaagtgtgcaatatggctcgcgattgtcgggactggagcgatgaacctatcaaggagtgtggcaccgcagagtgcttggacaacaacgggggatgtagtcacgtgtgcaatgatctgaaaattggctatgagtgtttgtgcccagacggattccagttggttgcacaacgacgctgcgaagatatcgatgaatgccaggatcctgacacatgctctcagttgtgcgttaacctcgagggcgggtacaaatgccagtgtgaagaaggattccagctagatccacacaccaaagcctgcaaagccgtgggctctatcgcatatctgttttttacgaaccgccacgaagttcgcaagatgacgctagacaggtcagaatatacaagccttatcccaaacctgcgcaacgtcgttgctctggacaccgaagtggcttctaatcgaatttattggtctgatctctcccaaaggatgatttgcagcactcagcttgacagagcacatggagtgagctcttacgataccgtaattagcagagatatccaggcccctgacggtctcgccgttgactggatacatagcaatatctactggacagacagcgtgctggggactgtatccgttgcggacaccaagggcgtgaagagaaaaacgctgttccgagaaaacggttcaaagcccagggcaatcgttgtagaccctgtacacggtttcatgtactggacagactggggaacccccgcaaagatcaagaaagggggtctcaatggcgtggatatctactccctggtcacagaaaatatccaatggccaaatggcattacgctggacttgctgtcaggacgtctctattgggtcgattctaagctgcattctatttcgtctatagacgtgaacggaggtaacaggaagacaattttggaggacgagaagcgcctggcccacccgttctccctcgctgttttcgaggataaggttttctggaccgatattatcaatgaggcaattttctccgcaaacaggctgacaggctctgatgtgaacctgctggccgaaaacttattgtcccccgaggacatggtgctttttcacaacttgacccaacccagaggggtgaactggtgtgaacgcacgaccctgtctaacggaggatgccagtacttgtgcctgcccgcgccccagataaacccccattcgcccaaattcacttgtgcgtgtcccgatggtatgttacttgcacgcgatatgcgcagttgcctgacggaggcagaggccgccgtggccactcaggagacaagcacggtgcgattgaaggtttcctctacggctgtgcggacgcaacacacaacaacacgacctgttccagacaccagtcgcctgccgggtgctacaccgggactcaccactgtggagatcgtaaccatgtcacatcaggctctcggcgacgtggcaggacgtggcaatgagaagaagccatcctccgtgagagccttaagtattgtgctgcccatagtgctgctcgtattcctgtgccttggggtctttctgttgtggaagaactggcggttaaagaacatcaacagcatcaactttgataacccagtgtaccagaaaacaaccgaggacgaggtgcacatttgccataatcaggatgggtactcatacccctcgcggcagatggtgtccctggaagacgatgtggca

SEQ ID NO: 446 - DNA, 2580 bp, Artificial Sequence
  Description of Artificial Sequence: Synthetic Transcript Sequence
atgggtccgtggggatggaagctccgctggacggtggccctcctgttggccgcagccgggacggctgtcggagatcgatgcgagcggaatgagttccaatgccaggatgggaagtgcatctcctacaagtgggtgtgcgacggaagcgccgaatgccaagacggatcggatgagtcccaagaaacctgtctgtcggtgacgtgcaaatcaggagacttttcctgtggaggacgggtgaaccggtgtatccctcaattctggcggtgcgacggccaggtggactgtgacaacggatccgacgaacaggggtgcccgccgaaaacctgcagccaggacgagtttcgctgccacgatggcaaatgcatctcgcggcagttcgtttgcgatagcgatcgcgattgtctcgacgggagcgatgaagccagctgcccagtcctgacttgtggcccggcgagcttccagtgcaactcctccacttgcatcccgcaactctgggcgtgtgataacgacccggactgcgaggatggatcggacgagtggcctcagcggtgcaggggactgtacgtgttccagggcgattcatcgccctgctcggccttcgaattccactgcctgtcaggcgagtgcatccactcgtcatggcgctgcgatggcggaccagactgcaaagacaagtcggacgaggagaattgcgcagtggcgacttgccgccctgacgaattccaatgctcggacggaaactgcattcacggaagccggcaatgcgaccgcgaatatgattgcaaggacatgtcggatgaggtcggctgcgttaacgtgaccctttgcgaagggcctaacaagtttaagtgccattcgggagaatgtattaccctggacaaggtgtgcaatatggcccgagactgccgggactggtccgatgaaccgatcaaggaatgtggaaccgctgaatgccttgacaacaacggtgggtgctcacacgtgtgcaatgacctgaagatcggctacgaatgcctctgcccggacggattccaactcgtggcacaacgccgatgcgaagatattgatgaatgtcaagaccctgacacttgctcccagctctgtgtgaatctcgagggaggctataagtgccaatgtgaagaaggattccagctcgatccgcacactaaggcttgcaaggccgtgggttcgatcgcctacctgtttttcacgaataggcatgaagtccggaagatgactctggaccgcagcgaatatacctccctgataccgaacttgcggaatgtggtggctttggataccgaagtggcatctaatcgaatttactggtccgatttgagccagcgcatgatttgctccacccaactggatagggcgcatggagtgtcctcgtacgacactgtgatctcacgcgacattcaggccccagacggacttgctgtggactggatccactcgaacatctactggaccgattccgtgctgggaacggtcagcgtggccgatacgaaaggagtcaagcgtaagaccctcttcagagagaatggatcaaaaccgcgggcgatcgtggtggatccggtacacggatttatgtattggactgattggggcactccggccaaaatcaagaagggaggattgaacggagtggacatctactccctggtgaccgaaaacatccagtggcctaacggaataaccctcgatctgctgagcggcagactgtactgggtcgactcgaagctgcactcgatcagctcgatcgatgtgaatgggggaaaccggaaaactatccttgaggatgagaaaagactggcgcacccgttttcgctggccgtctttgaagataaggtgttctggactgacatcattaatgaggcaatcttctcagcaaaccgcctcaccggcagcgacgtgaacctgctcgccgagaatctcctttcgccggaagatatggtgttgtttcataacctgacccaaccccgcggcgtgaattggtgcgagcgcaccaccttgtcgaatggaggttgtcaatacctgtgcctcccggctcctcaaatcaacccacattctcctaaattcacctgcgcgtgcccggacgggatgctccttgccagagacatgagatcatgcttgacggaggccgaggccgccgtcgcgactcaggagactagcactgtcagactgaaggtgtcgagcactgccgttcggactcagcacacgaccacccgccctgtcccagacacctcccggctgcccggagcgaccccgggcctcaccacggtggagatcgttactatgtcccaccaggcgctcggagacgtggcaggccggggcaacgagaagaagccatccagcgtgcgcgctctctctatcgtgctgccgatcgtgctgctggtgttcctgtgcttgggcgtgttcctgctgtggaagaattggcggctgaagaacatcaattcaattaacttcgacaatcctgtgtaccagaaaaccactgaagatgaagtgcatatttgccacaaccaggatggctactcatacccaagcaggcagatggtgtccctggaagatgatgtggct

SEQ ID NO: 447 - DNA, 2580 bp, Artificial Sequence
  Description of Artificial Sequence: Synthetic Transcript Sequence
atggggccctggggatggaagctgcgatggactgttgccctgttgctggccgctgccggaacagctgtaggcgatcgctgtgagcggaacgagtttcagtgtcaagacggtaagtgcatcagttataagtgggtatgtgacggatctgccgagtgtcaggacggatccgacgagtcgcaggaaacatgtttatctgtgacgtgcaaatccggagacttttcctgcggcggtcgggttaatcggtgcattccacaattctggcgctgtgacggtcaggtggactgcgataacggaagcgacgaacaaggctgtccccctaaaacctgcagccaggacgaattcaggtgtcacgatggcaagtgcatctcccggcaattcgtgtgcgattcagatcgagactgtctcgacggctcggacgaggcatcttgtccagtgctcacctgcggtccagctagctttcagtgcaattcctcgacttgtatccctcagctctgggcctgcgataacgacccggactgcgaggacggtagtgatgaatggccccagcgttgtcgaggtctatacgtgttccagggcgacagcagcccgtgcagcgccttcgaattccactgcctctccggggagtgcatccactcctcgtggaggtgcgatggggggccagattgcaaagacaagtctgacgaagagaattgcgctgtggctacctgccgcccagacgaatttcagtgtagtgacggaaattgtatccacggcagtcgccagtgtgatcgcgagtacgactgtaaggatatgagcgacgaggtcggctgcgtcaatgtgactctttgtgagggcccaaataagtttaagtgccattcgggagagtgcatcactctcgataaggtctgcaatatggctagagattgccgggactggagcgacgagccgattaaagaatgcggtacagctgagtgccttgataataacggcggttgtagccacgtatgtaacgacctcaagatcggctatgagtgcctgtgccctgacgggtttcagcttgtcgcacaaaggcggtgcgaagacatcgacgagtgccaggacccagatacttgctctcagctgtgcgtgaatctcgagggtggctacaaatgccagtgtgaagaggggtttcagctcgatcctcacactaaagcatgtaaggccgttgggtcgattgcttatttgttttttactaacaggcatgaagtgcgaaagatgactctcgatcgctccgagtatacttccctgatccccaacttgcgcaacgtggtggccctggatacagaggtcgcctctaatcggatctactggtcggatctctctcagagaatgatatgcagcacccaactcgaccgcgctcacggcgtgtcctcctacgatacagtgatatcccgtgatatccaggcgcccgatggtcttgctgttgactggattcattccaatatctactggaccgacagcgttctcggcactgtgagcgtggccgacaccaaaggcgtgaaacgaaagacgttatttcgcgagaacggtagcaagccaagggccatcgtcgttgatcctgtgcatggcttcatgtattggacggattggggcaccccagccaagattaagaaaggagggctgaacggtgtcgatatctacagccttgtcaccgagaacattcagtggcctaatggcatcacacttgatctcctgtcaggcaggctgtactgggtggactctaagcttcattcaattagtagtattgatgtgaacgggggtaacagaaagacgatccttgaggacgagaaaagactggcacacccttttagtttagccgtgttcgaagataaagtcttctggactgatattatcaacgaggcaatctttagcgccaatcgcctcaccggctctgatgtgaacctcctcgccgaaaacctgttaagtcccgaggacatggtgctgttccacaatttgacacagccacgcggagtgaactggtgcgaacgtactaccctcagcaatggggggtgccagtacctatgcttgcccgctccgcaaataaaccctcattcgcctaagttcacctgtgcctgccccgatggcatgctgctggccagggacatgaggagttgtctgaccgaagcggaggctgccgtagccactcaggaaacctccactgtgcggctaaaagtctcttcaacggctgtgagaacccagcacacaaccacaagacccgttcctgacacatcccgcctgccgggtgctaccccgggattaaccactgtggaaatcgtgaccatgtctcaccaggccttgggagacgtggccggtcggggcaacgaaaaaaagccatcttcagtccgcgccctcagtattgttctgcccatcgtgctcttggtgttcctctgcttgggcgtcttcctgctctggaaaaactggagactgaagaatattaactccataaactttgacaatcccgtttaccagaaaacaactgaggacgaggtgcacatttgtcacaaccaagacggctacagctacccctcacgccagatggtgtcactggaggatgatgtagca

SEQ ID NO: 448 - DNA, 2580 bp, Artificial Sequence
  Description of Artificial Sequence: Synthetic Transcript Sequence
atgggcccgtggggctggaaacttcgatggactgtggcattgctgctcgctgcagcaggtactgctgtgggtgatcgctgcgaacggaacgaatttcagtgtcaagatggcaagtgcatttcatacaaatgggtctgtgacggttcggcagaatgccaagacggatccgacgaatcccaggaaacctgcctctcagtgacctgtaagtcaggcgacttctcctgcggagggcgcgtcaatagatgcattcctcaattttggcggtgtgatggacaggtggactgtgacaacgggtccgatgaacaaggttgtccccctaagacttgttcgcaggacgaatttcgctgtcacgatgggaagtgcatatcaaggcaatttgtctgtgattcggatagagattgtctcgacggctcggacgaggcatcgtgccctgtgctcacttgtggtcctgcatcgttccagtgtaactcctcgacctgtattccacagctttgggcatgtgataacgatccagattgtgaagatggctcagatgaatggccgcagaggtgtcgcggcctctacgtttttcagggtgactcgagcccgtgttcggcgtttgagtttcattgcctgagcggggaatgtatccactcgtcttggaggtgcgatggagggcctgattgcaaagataaatcagacgaagaaaactgtgcagtggctacttgcagaccagatgagttccagtgttcagatggtaactgcattcacggctcgaggcagtgtgatagggagtacgactgtaaggatatgagcgatgaggtcgggtgtgttaacgtgactctctgcgaaggaccaaacaagtttaagtgccactctggtgaatgcatcaccttggataaggtgtgcaacatggccagagattgtcgggattggtccgatgagccaattaaggaatgtggaactgccgagtgtctggacaacaatggaggatgttcgcatgtgtgtaacgacctcaagatcgggtacgagtgcctgtgccccgatggttttcagcttgtggcacaacgcagatgtgaagatatcgatgaatgtcaggaccctgatacctgttcacaactttgtgtcaatctcgagggaggctacaagtgtcaatgcgaggagggtttccagcttgaccctcacactaaggcatgtaaggcagtcggaagcattgcatacttgttctttactaaccgacacgaggttaggaaaatgactctggatcgatcagaatatactagccttatccccaacctcaggaacgtggtggcacttgatactgaagtggcatcgaatagaatttactggtcagatctcagccaacggatgatatgttcgacccagctggatagagcccacggcgtgtcgtcgtacgacaccgtgatcagcagagacatccaagcccccgacggactcgcagtggactggattcatagcaacatatactggactgacagcgtcctggggaccgtgtccgtggcagatactaagggggtcaagcggaaaactctcttccgggaaaacggcagcaagccgagggccattgtggtggatcctgtgcatggattcatgtactggactgattggggtacccccgctaaaatcaagaaaggaggacttaatggtgtggacatttactccctggtgaccgaaaacattcagtggcctaacggaattactctcgatcttctctccggacgtctttactgggtggattcgaagttgcattcgattagctccattgatgtgaatggtggaaaccgtaagaccatactggaggacgaaaagcgccttgcacatcccttctcactggccgtatttgaagataaggtgttttggaccgacattatcaatgaagcgattttctcggcgaaccgactgaccgggagcgatgtcaaccttctcgcagagaacctgctgtcgcccgaggacatggtgctgtttcacaaccttacccagccccggggtgttaactggtgcgagcgcactaccctttcgaatggcggctgccaatacctgtgtctccctgctcctcaaatcaaccctcacagccccaagtttacctgtgcgtgtccagacggtatgctgctcgcgcgtgatatgcgcagctgcctgactgaagccgaagccgcagtcgccactcaagaaacctctaccgtgagactcaaggtgtccagcactgcggtcaggacccaacacaccactactcgaccagtccctgatacgagccggcttcccggagccaccccagggttgacgaccgtcgagatcgtcaccatgagccaccaagccctgggtgatgtggccggcagggggaatgaaaagaagccctccagcgtgagagcactgtcgattgtcctgccaattgtgcttttggtgtttttgtgcctcggtgtgttcctgctttggaagaactggaggttgaagaatatcaacagcatcaattttgataatccagtgtaccaaaagacgaccgaagatgaggtgcatatatgccacaaccaagatggatactcatacccttcaagacagatggtgtcgctcgaagatgacgtggca

SEQ ID NO: 449 - DNA, 2580 bp, Artificial Sequence
  Description of Artificial Sequence: Synthetic Transcript Sequence
atgggtccttggggatggaagttgagatggacagtagccctccttcttgccgccgccggtaccgctgttggagacaggtgcgaacgcaatgaatttcaatgtcaggacgggaaatgtatttcctataaatgggtgtgtgacggcagcgccgagtgtcaggacggttcagatgaatcacaggagacctgtttgtctgttacctgtaagagcggtgacttctcatgcggtggcagggtgaatcgatgtataccccagttctggaggtgtgatggccaggtggattgcgacaatggcagtgatgaacagggctgtcccccaaaaacctgctcccaggacgaatttaggtgccatgacggcaagtgcatctcccgccagtttgtgtgcgattctgaccgggactgtctggatggctctgatgaggctagctgccccgtgttgacttgtgggcccgcctcattccaatgcaatagcagcacatgcattccacagctgtgggcctgtgacaacgacccagactgtgaggacggttccgacgagtggccccaacgatgccgcggcctctatgtgtttcagggtgacagttcaccatgtagcgcatttgaatttcactgcttgagcggcgaatgtatacactcttcttggagatgtgatggcgggccagactgtaaggataagagcgatgaggaaaactgcgcagtggccacctgtaggccagatgagttccagtgttccgatgggaattgcatccacggctccaggcagtgtgacagagagtatgattgcaaggacatgtcagatgaggtggggtgcgttaatgtgacactctgcgaagggccaaacaaatttaagtgtcacagtggagaatgtatcacactggataaggtgtgcaacatggctcgggattgcagagactggtctgacgagcccattaaggagtgcggcaccgcggaatgcctggacaacaacggcggttgtagccacgtgtgtaatgacctgaaaataggttacgagtgcctgtgccctgatggatttcaactggtcgcccagcgcagatgtgaagacatcgacgagtgccaggatcctgatacctgtagccagctgtgtgtgaatctggagggcggctataagtgccagtgcgaagagggattccagctcgatcctcacacaaaagcttgcaaggcggtcggatccattgcttacctgtttttcactaatagacacgaagtgaggaagatgacattggataggtccgaatatacttctttgatccctaatctgcgcaacgttgttgccctggacaccgaagtggcatctaaccgcatctactggagtgatctgagtcagcggatgatctgcagcactcagctggatcgagctcacggtgtgtccagctatgacactgtcatatctcgagacatacaagccccggacggcttggctgtcgactggattcatagcaacatctattggaccgacagcgtgctggggacagtgtcagttgcagatactaaaggggtgaaacgcaagacacttttccgcgaaaatggaagcaagccgcgcgccattgtggttgatcctgttcatggattcatgtattggactgactggggtactcctgctaagatcaagaaaggaggcctgaatggtgtagacatctacagtctcgtgaccgagaacatccagtggcccaatgggatcacactggaccttttgtctggccggctttattgggtggattcaaagctccacagtatatcctctattgatgtaaacggaggaaatcggaagacaatcctcgaggacgagaaacggctcgcccatcctttcagccttgcagtgttcgaggacaaagtattctggactgacattattaatgaagcgatcttttccgcgaatcgacttactgggtctgacgtgaaccttcttgccgagaatctgttgtcccccgaggacatggtgcttttccacaacctgacccaaccgcggggggtcaactggtgcgaacggacgacactgtcaaacgggggctgccagtacctttgtctcccagcccctcaaataaaccctcactctcccaagtttacttgtgcgtgtcccgacggtatgctcctggcaagggacatgcggtcctgcctgacagaggctgaagccgccgtggctacccaggaaactagcactgtgcgcttgaaagtcagcagcaccgccgttcgcactcagcacactacaactcgccctgtgcctgatacctccaggctcccgggcgcaacaccgggtctgactaccgttgagatagtgactatgtctcaccaggccctgggcgatgtagccgggcgaggcaacgaaaaaaaaccctcctctgtcagggccctgtctatcgttttgccaattgttcttctggtgttcctgtgtctgggagtgttcctgctctggaaaaactggcgactgaaaaatatcaactctatcaacttcgataaccccgtgtatcagaaaaccacggaggatgaggtgcacatctgccataatcaagatggatactcatatcccagcaggcaaatggtgtcccttgaagacgatgttgcc

SEQ ID NO: 450 - DNA, 2580 bp, Artificial Sequence
  Description of Artificial Sequence: Synthetic Transcript Sequence
atgggtccatggggctggaagctgcgttggaccgttgcactcctcctggcggcggcaggcaccgcggtgggtgaccggtgcgagcggaacgaatttcaatgtcaagatggcaagtgcatttcatacaaatgggtgtgtgatggatcggcagagtgccaggatggatcagacgagtcgcaagaaacttgtctttcagtcacctgcaaaagcggagatttcagctgtgggggcagggtcaatagatgcattccccagttttggagatgtgatggacaagtggactgcgacaatggatcggatgagcaagggtgtcctccaaagacttgctcccaagacgaatttaggtgccatgatggaaagtgtatttccaggcaatttgtgtgtgatagcgatcgcgactgccttgacgggtcggacgaagcatcatgtccagtgcttacttgtggacctgcctcgtttcaatgcaactcctcaacttgcattccgcagttgtgggcgtgcgacaatgatcccgactgcgaggacggaagcgacgaatggccacaaaggtgtcgagggctctacgtgttccagggggactcatcaccttgctccgcattcgaatttcattgtctttccggagagtgcattcactcgagctggaggtgtgacggaggacctgattgtaaggacaagtcggatgaggagaactgtgccgtggccacctgccgacctgatgagtttcaatgctccgatgggaactgtatccatggatcgagacagtgcgaccgcgaatacgattgcaaggatatgagcgacgaagtgggttgtgtcaacgtgactctgtgtgaaggacctaacaagttcaaatgccattcgggagaatgcattactctggataaggtgtgtaatatggcaagagactgtcgtgactggtccgatgagccaattaaggagtgtggtactgcagaatgccttgacaataacggagggtgctcacatgtgtgcaatgacctcaaaatcggttatgaatgcttgtgcccagacggatttcaactggtcgcccagagaagatgcgaggatatcgacgaatgtcaggatcccgacacttgcagccaattgtgtgtcaacctcgagggagggtacaagtgtcaatgtgaggaaggattccaactggatccacataccaaggcttgtaaggccgttgggtcaattgcatacctctttttcactaacagacacgaggtcagaaagatgacccttgatcgctcggagtacacctctcttattcctaatctgcgtaatgtcgtcgcacttgatacggaggtcgcctcgaaccggatctactggtcagatctctcgcaaagaatgatttgttccactcagctggatcgcgcacatggagtgtcgtcttacgataccgtgatttctcgcgacattcaggcaccagacggactcgcagtcgattggattcattccaatatctactggaccgattcagtcctgggaactgtctccgtggcagacactaaaggagtcaagagaaagaccctctttagagaaaatggctccaagcctcgggccattgtcgtggatcccgtgcatggatttatgtactggaccgactggggcaccccggcaaaaatcaaaaaaggtggccttaacggcgtggacatttactccctggttactgaaaacattcaatggccaaacggcattacgctcgaccttttgtcggggcgtctttactgggtggatagcaagctccattccatttcctccattgatgtcaatggcggaaacagaaagactattttggaggatgagaaacgactggcacatccattttcactggctgtgtttgaggacaaggtgttctggactgatatcatcaatgaagcaatattcagcgcaaacaggctgaccggaagcgacgtcaaccttctcgccgaaaaccttctttcacctgaagatatggtgctgtttcataatcttacccaaccgagaggtgtgaactggtgtgaacgcactactctcagcaatggaggttgccagtacctctgccttcctgcaccgcagataaaccctcattcccctaagtttacttgcgcgtgcccagatggaatgcttcttgcccgcgatatgagatcatgtctcaccgaagccgaggcggcagtggccacccaggaaactagcactgtgcggcttaaggtgtccagcaccgcagtgcggacgcaacataccaccactcgccccgtgcccgatacctccagactccccggcgccaccccagggcttaccaccgtggaaatcgtcaccatgtcgcatcaggcacttggcgatgtggcaggtaggggaaatgagaagaaaccttcgtcggtgagagcccttagcatcgtgcttccaattgtcctcctcgtgtttttgtgtttgggggtgtttcttctgtggaaaaactggcggctgaaaaacatcaattccattaacttcgataatcccgtgtaccagaaaaccaccgaagatgaggtgcacatttgtcacaaccaagacggatacagctacccatccagacaaatggtgtcgctggaagatgacgtcgca

SEQ ID NO: 451 - DNA, 2580 bp, Artificial Sequence
  Description of Artificial Sequence: Synthetic Transcript Sequence
atggggccatggggatggaagctgagatggactgtggccctcctgctggcggcggcaggtacggcggtgggagatcgatgcgagagaaatgaattccagtgccaagacggaaagtgcatatcttacaagtgggtgtgtgatgggtcggcggaatgccaggacgggtcagacgaaagccaggagacttgtctgtctgtcacttgcaagagcggggacttctcgtgtggcggccgcgtgaatcgctgcatccctcagttttggcgctgcgacggacaggtggactgtgataacggaagcgacgaacaaggttgcccgccgaaaacgtgctcgcaagatgagtttcggtgtcatgatggtaagtgcatttcacgccagttcgtctgcgattcagatagagattgcctggacggatcggatgaagcctcctgcccagtgctgacttgtggaccggcatccttccagtgtaatagctcaacctgtatccctcaactgtgggcatgtgataatgatccagattgcgaggacggctccgacgaatggcctcagagatgccgcggactgtacgtgttccagggagatagcagcccctgctccgcattcgaatttcactgccttagcggcgagtgtatccactcgtcctggagatgcgatggaggaccggactgcaaggataaatccgacgaagaaaactgcgcagtagcgacttgtagacccgacgaattccaatgctcagacggaaactgcatccacggctcgagacagtgcgaccgcgagtacgactgcaaagatatgtcagacgaggtgggatgcgtgaatgtgactctctgcgaaggaccgaataagttcaagtgccactcaggagagtgcatcacccttgataaagtctgcaacatggcccgggactgccgggattggtcagacgaaccaatcaaggagtgcgggactgccgagtgcctggataacaatggaggatgctcgcacgtgtgcaacgacttgaagatcggatacgaatgcctctgccccgacggcttccaacttgtggcacagcgccgatgtgaggacattgacgaatgtcaagatcccgatacctgctcgcaactgtgcgtcaacctcgaaggtggctacaaatgccaatgtgaagagggattccagctcgatccgcataccaaggcctgtaaggccgtgggaagcatcgcatacctgtttttcacgaaccgccacgaagtgcggaaaatgactctcgatcgctcggaatacacttccttgatccctaaccttcggaacgtggtggccctcgacacggaggtggcatccaatcggatctactggtcggacctgtcccaaagaatgatttgctccactcagctggaccgcgcccacggagtgagttcgtacgatacggtgatctcaagagatatccaggccccggacggactcgcggtggactggatccattccaacatctattggaccgattcagtcctgggcacggtgtcagtggccgacactaagggagtcaagagaaaaaccctgttccgcgagaacggttcaaagccgcgagcgatcgtggtggatccggtgcatggcttcatgtactggaccgactggggcaccccggcgaagatcaaaaagggaggcctgaatggtgtcgacatatactccctggtgacggagaacatccagtggccaaacggaattaccctggatctcctttcaggccgcctgtactgggtggactcaaagctccactcgatctcgtcgatcgatgtcaacggaggaaaccgcaaaaccatcctcgaggacgaaaagcgtcttgcgcaccccttctccctggccgttttcgaggataaggtgttctggaccgacatcatcaacgaagctatcttttccgcgaatcgcttgaccgggtcggacgtgaacctcttggccgaaaatctgctgagcccggaagatatggtgttgttccacaatctgactcagccgcgcggcgtgaactggtgtgagagaaccactctgtccaacggagggtgtcagtacctgtgcttgccggctccacagattaacccacactctccgaagttcacttgtgcctgtccggatggaatgctcctggcacgcgacatgcgcagctgcctcaccgaagccgaagcggccgtggcgactcaggagacttcgactgtgagactgaaggtgtcctccaccgcagtgaggacccagcacactactacccgcccggtgccggacacctcgaggctgccaggtgccaccccgggactgaccactgtggagatcgtgactatgtcacaccaggcgctgggtgacgtggcaggccggggcaacgaaaagaaaccatccagcgtgcgcgctctgtcaatcgtgctcccgatcgtcctgttggtgttcctctgtttgggagtgttcctcctgtggaagaattggaggctgaaaaacatcaattccatcaacttcgacaaccctgtctaccaaaaaaccactgaagatgaagtccatatatgccataaccaggacggatactcgtaccctagcagacaaatggtgtccctggaggatgacgtcgca

SEQ ID NO: 452 - DNA, 2580 bp, Artificial Sequence
  Description of Artificial Sequence: Synthetic Transcript Sequence
atgggaccttgggggtggaagctcagatggactgtggcgctgcttttggcagcagcaggaaccgccgtcggtgaccgttgcgagaggaacgagttccagtgccaagatggtaaatgtatcagctacaagtgggtgtgtgatggatccgccgaatgtcaagatggttcggacgaatcccaagagacttgtcttagcgtgacttgtaagtcgggagacttctcgtgtggaggtagggtgaacaggtgcatcccacagttttggcgctgtgatggtcaggtggattgcgacaatggctccgatgaacaagggtgtcccccgaaaacctgttcgcaagatgaatttcgttgtcatgatggaaagtgtatatcgcggcagtttgtgtgtgatagcgaccgcgactgcctggatggctcggacgaagcatcatgcccagtgcttacctgcggaccagcatccttccagtgcaacagctccacctgcattccacaactctgggcctgtgataatgatccagattgtgaagatggttccgatgagtggccacaacgatgccggggcctctacgtgtttcagggtgattcgtcaccctgttcggcatttgaattccattgtcttagcggagaatgtattcactcaagctggcgttgcgatggtggcccagattgcaaggataagtccgatgaggaaaactgtgccgtggcaacttgtagacccgatgaatttcagtgttccgatggaaactgcattcacggtagccgccaatgtgatcgcgaatacgactgcaaagatatgagcgatgaagtcggatgcgtgaatgtcactttgtgcgaaggcccgaacaaattcaagtgtcattcaggcgagtgtataaccctggataaggtgtgcaatatggccagggattgtagggattggtcagatgaacctattaaggaatgtgggaccgcagaatgtcttgacaataacggcgggtgctcccatgtgtgcaatgatcttaagattggctacgaatgtctttgtcccgatggttttcagctcgtcgcacagaggcgctgtgaggacattgacgaatgtcaggaccctgacacttgttcgcaactttgtgtaaacctggaaggtggatataagtgccagtgtgaagaaggttttcaactggatccacatactaaagcgtgcaaggccgtggggtccatcgcataccttttctttactaacaggcacgaagtcagaaaaatgacgctggatcgctccgaatacacgtcgctgattccaaacctgagaaatgtcgtggccctggatactgaagtcgcatccaatcgcatctactggtccgatctgtctcaaagaatgatttgctcgactcagctggacagagcacatggtgtgtcatcctatgataccgtgatttcgcgcgatattcaggcacctgacggccttgcagtcgattggattcattcaaacatttactggacggactccgtcctcggtaccgtgagcgtggcggatacgaagggtgtgaagcgaaaaacccttttcagagagaacggctcaaagcctcgcgccatcgtggtggatccagtccatggcttcatgtactggaccgactgggggaccccagcaaagatcaagaaaggagggctgaacggtgtggacatctactccctcgtcaccgagaatatccagtggccaaatggtatcaccctggatcttctgtccggccggctgtactgggtggattcgaagttgcattccattagctcgatcgacgtgaacggcggaaacagaaagaccattttggaagatgaaaagagacttgcccacccttttagtctggctgtgtttgaagataaggtgttttggactgacattatcaacgaagcgattttctcggcgaatcgtcttaccggatcggatgtgaacctcttggcagagaatctgctgtcgcccgaggatatggtgctgttccataatctgacccagccaagaggcgtcaattggtgtgaaagaacgactctgtcaaacggcggttgtcaatacctttgtctccccgcgcctcaaatcaatcctcattcgccaaagtttacttgcgcatgcccagacggtatgctgctcgctagggatatgaggtcctgccttaccgaagccgaggctgccgtcgccactcaagaaacctcaaccgtgcgtctcaaggtttcctccacggccgtgaggacccaacacactaccactcgcccggtgcctgatacttcgagacttcctggtgcgacccctggacttactaccgtggaaattgtgactatgtcgcaccaagcactgggtgacgtggcggggagaggcaatgaaaagaagccttcctctgtgcgtgcactgtccattgtcctgcctatcgtcctgctggtctttctttgtctgggagtgtttcttctttggaaaaactggcggttgaagaacattaacagcatcaattttgataacccagtgtaccagaaaaccaccgaagatgaggtgcatatctgtcataaccaggatgggtactcgtatccatcccgccagatggtgtcccttgaggatgacgtcgcc

SEQ ID NO: 453 - DNA, 2580 bp, Artificial Sequence
  Description of Artificial Sequence: Synthetic Transcript Sequence
atgggcccttgggggtggaaacttcgttggaccgtggcattgttgctggctgcagctggaaccgcagtcggtgacagatgtgaacgaaatgagtttcagtgccaggatggaaaatgcatatcttataagtgggtatgcgatggttctgccgagtgccaggatggtagcgacgaatctcaggaaacttgtctgagcgtgacctgtaagagcggcgattttagctgtgggggacgagtcaatcgctgcatcccacagttctggaggtgcgacgggcaggtggattgtgataacggctctgacgaacaggggtgccctccgaagacatgctctcaagacgaatttcgctgccacgatggaaagtgcatcagccgacagttcgtgtgtgatagtgacagggactgcctcgacgggagtgatgaagcttcctgtcctgtgctgacatgcggtcctgcgtcatttcagtgtaattcgtcaacttgcatccctcagctttgggcttgtgataacgacccggactgcgaggacggcagtgacgagtggccacagaggtgccgtggtttatatgttttccagggagatagtagcccgtgctccgcttttgagttccactgcctttccggagaatgcattcactcctcttggcgctgtgatggcggtcccgattgcaaggacaaatctgacgaggagaactgcgctgtagctacctgccggccggatgaatttcagtgttctgatggaaactgtatccacggcagtcgccaatgcgatagagagtacgactgtaaggatatgtctgatgaggtggggtgcgttaacgtaactctgtgcgagggccctaacaagtttaaatgccattctggggagtgtatcacgttagataaggtgtgtaacatggccagagattgtcgtgactggtccgacgagcccatcaaggaatgcggaaccgcagaatgcctagacaataacggaggctgctcgcacgtgtgtaacgaccttaaaatcgggtacgagtgcctatgcccagacggatttcagctcgtagcccagaggcgttgtgaggatattgacgagtgtcaggatcccgatacctgcagccagctgtgtgtcaatcttgaagggggctataagtgtcagtgtgaagaaggattccagttggatccacacacaaaggcttgcaaggctgtgggttcaatcgcttacctgttttttaccaaccgccacgaggtgcgcaagatgacactcgaccggtctgagtacaccagcttaatcccaaatttgaggaatgttgtcgcactagacaccgaggtagccagtaacagaatttactggtcggacctgagtcagaggatgatctgtagcacacagctagacagggctcacggagtgtcttcttatgataccgtgatttctagagacatccaggcccctgatggcctcgccgttgattggatacactccaatatctattggacagactccgtccttggcactgtgtcagtagcagacaccaagggcgtcaagaggaagactctgttcagggagaacggctctaagcctcgggcaattgtggtggaccctgttcatgggttcatgtactggacggattggggaacgcctgccaagattaaaaaaggcggtctcaatggggtggatatttattccctcgtgacagagaatattcaatggcccaacgggatcacactggacctactatctggacgtttgtactgggtggattccaagctccacagtatttcatctatcgacgttaatggcggaaacagaaagacaattctcgaggacgagaaaaggctcgcccatccttttagtctggccgttttcgaggacaaagtcttctggactgatatcatcaatgaagccatcttctccgccaataggctgactgggtccgacgtaaacttactcgcggaaaatctgctaagtcctgaggatatggtgctgttccataatctcactcagcctagaggggtaaattggtgtgagcgaaccacactaagtaacggcggctgccagtacctctgtctgcccgccccacaaatcaaccctcacagtcccaaattcacatgtgcatgtcccgatgggatgctgctcgcacgggacatgcgatcttgcctgacagaagccgaggcagcggtggccacacaggagacgtccaccgtccgactgaaggtctccagtactgccgtacgcacacagcacacaaccacaaggccagttccggatacctctagactgccaggcgccactcctggccttaccaccgtggaaatcgtgactatgtcacatcaggcactcggcgacgtcgcaggtcggggaaatgagaaaaagccatcatctgtccgagctcttagcattgtcctgccgatcgtacttcttgtgttcctatgcctgggcgttttcctcctgtggaagaactggaggctgaagaacataaatagcattaatttcgataacccggtgtatcagaagaccaccgaggatgaggtgcatatctgtcataaccaagatggctacagctacccttcacggcaaatggtgagcttggaggatgacgtcgca

SEQ ID NO: 454 - DNA, 2580 bp, Artificial Sequence
  Description of Artificial Sequence: Synthetic Transcript Sequence
atggggccctggggatggaagctccgttggacagtcgccttgcttcttgcggccgccggtactgcagttggggaccgatgcgagcgcaacgagtttcaatgccaggatgggaagtgcatcagctacaaatgggtgtgcgatggcagcgctgaatgtcaggatggttctgacgagtcgcaggagacctgtctctcagttacgtgcaagtccggagatttctcttgcggcggccgtgttaaccggtgcattccccaattctggcgctgtgacggtcaggtcgattgtgataacggaagcgacgaacaaggttgtcctccgaagacctgctcccaggacgagtttagatgccatgacggcaagtgcatctcgcgccaattcgtctgcgactcggaccgcgattgtctcgacggctccgatgaggccagttgccctgtgctgacctgcggtcccgcctccttccagtgcaacagctccacttgcatcccccagctctgggcgtgcgacaacgatccagattgcgaagacggtagcgatgagtggcctcagcgttgtcgcggcctctacgtattccaaggtgactcgtcgccctgctcggccttcgaattccattgtctgtctggggagtgcattcattcatcgtggaggtgtgacgggggtcctgattgcaaggacaagtcggacgaagaaaactgtgccgtcgctacctgcagacctgacgaatttcagtgcagcgacggcaactgtatccatggctccagacagtgcgacagggaatatgactgtaaggatatgagcgatgaggtgggctgcgtgaacgtgaccctgtgcgaaggtcccaacaagtttaagtgccactccggtgagtgtataaccctcgataaggtttgtaacatggctcgtgactgccgcgactggtcggacgagcccatcaaagaatgcggtaccgcggagtgtctggataacaacggtggttgctcccacgtctgtaacgaccttaagattggttacgagtgcctctgtccagatggattccagctagtggcccagaggagatgtgaagacattgatgaatgccaggaccccgatacctgcagccaactttgtgtcaacctggagggtggctacaagtgtcagtgcgaggaaggcttccagttagaccctcacaccaaggcctgtaaagcggtgggttccattgcatacctgttcttcaccaacagacacgaagtgcggaaaatgaccttggatcggagtgaatacacgtctctcatcccgaacctgcgcaacgtggtcgccctcgacaccgaggtcgcctctaaccgcatctactggagtgacttgtcgcagaggatgatctgctcaactcagctggatagagcccatggtgtgagctcgtatgacacggttataagccgcgacattcaggctcctgatgggttggccgtcgactggatccactctaatatttactggaccgattccgtactcggaacggttagtgttgctgacaccaagggagtgaagaggaagaccttgttccgtgaaaacggcagcaagccgcgcgctatcgtggtggaccctgtccatggcttcatgtattggacggactggggtacccccgccaagattaaaaaaggggggctcaacggtgttgacatttactcattggtcaccgagaacattcaatggcccaatggtattaccttagacctcttgtccggtcgcctgtactgggtcgactctaagctgcatagcatctccagcatcgacgtcaacggaggtaaccgcaagactatcttggaagatgagaagcgcttggcgcatccgttttccctggctgtgttcgaggacaaggtcttttggactgatatcatcaacgaggctatctttagcgccaaccggctgacgggctctgatgttaacctcctcgccgagaatctgctctcccccgaggacatggtcctgttccataacctgactcaacccaggggtgtcaactggtgcgagaggaccacgttgtccaacggaggctgccagtacctttgcctgcctgcccctcaaattaacccgcacagccccaagtttacctgtgcctgtccagacggcatgctcctggctcgggatatgcgctcgtgtctgaccgaggctgaagctgccgtggccacccaggagacctcgaccgtgcgtctgaaggtgtcgtcgacggccgtgcggacccagcataccaccacgaggccggttccagacacctccagattgccgggtgctacccctggtttgacgaccgtcgagatcgtaaccatgtcgcaccaggccctcggtgatgtagctggcagaggtaacgagaagaaaccttcgtctgttagagccctttcgattgtcctccctattgtgttgctcgtttttctgtgccttggagtattcctcttgtggaaaaactggcgtctcaagaacatcaacagtatcaattttgacaaccctgtctaccaaaaaactaccgaagacgaggtccacatctgccacaaccaggacggatatagctacccctcccgtcagatggtctcccttgaggacgacgtcgct

SEQ ID NO: 455 - DNA, 2580 bp, Artificial Sequence
  Description of Artificial Sequence: Synthetic Transcript Sequence
atgggtccctggggctggaagctccggtggactgtggccctgctcttggcagccgcgggaaccgctgtgggggatagatgtgaaagaaatgagtttcaatgtcaggatggcaagtgtatcagctacaaatgggtatgtgacgggtccgcagagtgtcaagatggcagcgatgagtcccaggaaacctgtctttccgtgacttgcaaatccggagacttttcgtgtgggggacgtgtgaatcgctgtattccacaattttggagatgcgatggccaggtggactgtgataatggttcggacgagcaaggttgccctcccaagacctgctcgcaagacgaatttagatgccacgatggaaagtgtatatcaaggcaattcgtctgcgattcggaccgcgactgcctcgatggttcagacgaagcctcgtgtccagtcttgacttgcggccccgcgtcctttcagtgtaactcgtcgacgtgcattcctcagttgtgggcctgtgataacgaccccgactgtgaggacggctcagacgagtggccccaacgttgcagagggctttacgtgttccagggtgattcgtctccatgttcggcatttgagttccactgcttgtccggtgagtgtatacattcaagttggcgctgtgatggaggtccggattgtaaagataagtccgatgaggaaaattgcgcagtagctacctgtagacctgacgaatttcagtgcagcgatgggaattgcattcacggatcgagacaatgcgatagagagtacgattgtaaagacatgtcggacgaagtcgggtgtgtgaacgtcaccctgtgtgagggtccgaataagttcaaatgtcattccggcgaatgcatcactctggataaagtgtgcaacatggcaagagattgtcgggattggtcagacgagcctattaaggaatgtggcacggcggaatgcctggacaacaacggaggttgttcccatgtgtgcaacgacctcaagatcggatacgaatgcctgtgccctgacggtttccaactcgtggcacaaaggcgttgtgaagatattgacgagtgccaggatcctgatacgtgtagccagctttgtgtgaatctcgaaggcggatacaagtgccaatgcgaagaggggtttcaacttgatccccacactaaagcatgtaaagcggttgggtcgatcgcatacctcttctttactaacaggcatgaggtgagaaagatgaccctggatcgcagcgaatacacttcgcttatccctaatctgagaaacgtggttgcgctggataccgaagtcgcgtccaacaggatatactggtccgatctgtcacaaagaatgatttgttccacccagctcgacagagcacatggagtttcctcctacgatactgtcatctcgcgtgacatccaggcacctgatggactggcagtggattggatccacagcaacatttactggaccgattcagtgcttggaacggtgtcagtggccgacaccaagggagtgaagagaaagaccctttttcgtgaaaacggctcgaagcctcgggcgattgtggtcgatcctgttcatggattcatgtactggaccgactgggggacgccagcaaagatcaagaaaggcggcctcaacggtgtggatatctactccctggtgacggaaaacattcaatggccgaacggtatcactcttgacctcttgagcggtcggctttactgggttgactccaagctgcattccatatcttccatcgatgtcaatgggggaaacagaaagaccattctcgaggacgaaaagcgactggcccatccattttcccttgcagtgttcgaagataaagtgttttggactgacattatcaacgaggcaatattctccgccaacaggctgaccgggagcgacgtcaatctgctggcagaaaacctgctctcacctgaagatatggtgctgtttcacaacctcactcagccccggggtgtcaactggtgtgaacggaccaccctgtccaatggtggatgccagtacctgtgccttccggcacctcagattaatcctcattcccctaagtttacctgtgcctgtccggatggtatgctgctggccagggatatgcggtcctgccttactgaagccgaggccgcagtggcgacccaagagacttcaactgtccgccttaaggtgtcatccacggcagtgcgtactcaacataccactacccgcccagtccctgacactagtagattgccaggtgcaacgcccggtctgactactgtggagatcgtgaccatgtcacatcaagccctgggtgatgtggcagggcgcggaaatgaaaagaaaccctcaagcgtcagagctttgtccattgtgctgcctattgtgctcctcgtgtttctttgtctcggtgtctttctgctgtggaagaactggcgcctgaagaacattaactccataaactttgacaaccccgtgtaccaaaagactaccgaggatgaagtgcacatctgtcataatcaggacggatattcctatccttcgagacaaatggtttcccttgaagatgacgtcgca

SEQ ID NO: 456 - DNA, 2580 bp, Artificial Sequence
  Description of Artificial Sequence: Synthetic Transcript Sequence
atgggaccatggggatggaagctgagatggaccgtggctttgctgctggccgcagcgggaactgctgtgggggatcggtgcgagaggaatgaattccaatgtcaggacggaaagtgcatctcgtataagtgggtctgcgacggttccgcggagtgccaagacggatccgacgagtcacaagaaacttgcctttccgtgacctgcaagtctggtgacttcagctgcgggggacgcgtgaacagatgcataccccagttctggcgctgcgatggccaggtggactgtgacaacgggtcggatgagcagggctgcccccctaagacgtgctcgcaagacgagttcagatgtcacgatggaaaatgcatctcaagacaatttgtgtgtgactcggaccgggactgtctggatggttcagatgaggcatcctgtcctgtccttacctgcggtcctgccagcttccagtgcaattcttccacttgcattccccaattgtgggcctgcgataacgatcctgactgcgaagatggcagcgacgagtggccgcaacgctgcagaggattgtatgtattccagggcgacagcagcccgtgctcggctttcgagttccattgcctgtccggggaatgcatccattcctcatggcggtgcgatgggggtccggactgtaaggacaagagcgacgaagaaaattgtgctgtggcaacctgtcggccggatgagtttcagtgctccgacggaaactgtatccacggatcgcgccagtgcgaccgcgaatacgactgtaaagacatgagcgatgaagtgggatgcgtcaacgtcactctctgtgaagggccgaacaagttcaagtgccactccggagaatgcatcacgctggataaagtatgcaatatggctcgagactgcagggattggtcagacgaacccatcaaagagtgcggaaccgcagagtgcctggacaataacggagggtgctcgcatgtgtgcaatgaccttaagatcggttatgagtgcttgtgcccagacggctttcagctggtcgcacagcgccgatgcgaggacattgacgaatgtcaggacccggatacttgctcgcagctctgtgtgaacctcgaggggggttacaaatgtcagtgcgaggaaggttttcagttggacccgcacactaaggcttgcaaggccgttggaagcattgcttacctgttcttcaccaatcggcatgaggtcagaaagatgacgctggaccgctctgagtacacgtcactgatcccaaacctgaggaatgtggtggcgttggacactgaagttgccagcaatcggatctactggtccgatctgtcgcaaagaatgatttgctccacgcaactcgatcgagcacacggagtgtcatcctacgacaccgtgatctcacgcgacatccaggctccagacgggctcgcagtggactggatccattccaacatatactggactgacagcgtcctgggaaccgtctcggtggcggacaccaaaggcgttaagcgcaagaccctgttccgcgagaacggttcgaagcctcgcgccatcgtcgttgatccagtgcacggattcatgtactggacggattggggcacgcccgcgaaaatcaaaaagggcggactgaacggcgtggacatctacagcctggtgaccgagaatattcagtggccgaacggtatcactttggacctcttgtccggcagactgtactgggtcgattcaaaactccactccatctcgtccatcgacgtgaatggaggcaatagaaagaccatcctggaggacgagaagagactggcccaccccttctcactcgcggttttcgaagataaggtcttttggaccgacatcataaatgaagccattttcagcgccaaccgcttgaccggatccgacgttaacctgcttgccgaaaacctgctgagcccggaagatatggtgctgttccacaacctgacccaaccgcgcggggtgaactggtgtgagagaacgactctgtcgaacggcggttgtcagtatttgtgtctgccggcccctcagatcaatcctcactcaccgaagttcacctgtgcatgccccgacggcatgctgcttgcccgcgacatgcggagctgcctgactgaggcagaggcagctgtggcgacccaagaaacttcaacggtgcgcctgaaagtctcaagtaccgcggtccggactcaacacaccactactcggccagtgcctgatacttcgagactcccaggagccaccccgggactcactaccgtggagatcgtgaccatgtcgcatcaggccctcggagatgttgcgggaaggggcaacgagaagaagccgtcgtcggtgcgcgcactgtccattgtcctgcctatcgtgctgttggtctttctctgtcttggagtgttccttctgtggaagaactggcgcctgaagaacatcaattcgatcaactttgataacccggtctaccagaaaaccaccgaagatgaggtccacatctgtcataaccaggatggttactcatacccgagccgacagatggtgtctttggaagatgatgtggca

SEQ ID NO: 457 - DNA, 2580 bp, Artificial Sequence
  Description of Artificial Sequence: Synthetic Transcript Sequence
atgggcccatggggttggaagctacggtggacagtagcactgctgctggccgctgccgggactgcagtcggcgatcggtgcgagcgcaacgagttccaatgccaggacgggaagtgcatcagctataaatgggtgtgcgacggcagtgccgaatgtcaggacgggtccgatgaatctcaagagacgtgcctaagcgttacctgcaagtccggtgacttttcctgcggcggcagggtgaataggtgtatccctcagttctggcgttgtgacggacaggtggattgtgataacggaagcgatgagcagggctgtccgcccaagacttgctctcaggacgaatttcgttgccacgatggcaagtgcatctctcggcagttcgtgtgcgattcagatagagattgcttagatggcagtgacgaggcctcctgcccagtgctgacatgtggacctgcatctttccagtgtaattcttctacgtgtatccctcaactttgggcttgtgacaacgacccagattgcgaggacggctccgacgagtggccacagagatgccgaggactttacgtattccaaggagattcctccccatgtagcgcttttgagtttcattgcctgagcggagaatgcatccatagcagttggcgctgtgacggggggcctgattgcaaggataaatctgacgaagagaactgtgcggtcgccacgtgccggcccgatgagttccagtgttccgacgggaactgtattcacggctctaggcaatgcgacagggagtatgattgtaaagacatgtcggacgaagtgggctgtgtgaacgtgacgttgtgtgagggtccaaataagttcaaatgtcatagtggcgagtgtattaccttggataaagtttgcaacatggcccgtgattgcagggactggagtgacgaacccattaaggaatgcggaaccgccgagtgcttagacaataacggcggctgtagtcacgtttgtaacgatcttaagatcggatatgagtgcctttgccccgacgggtttcagctggttgcacagcgccggtgtgaagatatagatgaatgtcaggatcccgatacctgcagccagctttgtgtgaacttagaagggggttacaagtgtcagtgtgaggaaggtttccaactcgacccccatacaaaagcgtgcaaggctgtggggagtattgcttacttgttcttcacaaataggcatgaagttcgtaagatgaccctagataggtccgagtacacaagcttaatacctaatcttagaaacgttgttgctctggacaccgaggtggcatcaaatcgtatctattggagcgacctcagtcagcggatgatctgctctacccagttagatagagctcacggtgtgtccagctatgatactgtaatttctcgggatattcaagctccggacggcttggccgtggattggattcatagcaatatctactggactgacagtgtactgggcaccgtgtcggtagcagacaccaaaggggtgaagcggaagacactttttagggaaaacggttcaaagcccagagctattgtggtggaccctgtgcacggtttcatgtattggacagactggggaactcccgctaagatcaaaaaggggggcctcaatggggtggatatctacagcttggtgacagaaaacattcagtggcctaacgggattacgctggatctgctgagcgggagactatattgggtcgattcaaagctccattcaatctccagtatagacgtcaacggcgggaatcgcaagaccattctagaagacgaaaagcgattagctcaccctttcagcctggccgtttttgaagataaggtgttttggactgatattatcaacgaggcaattttttcagctaatcgcctgactggctccgacgtgaatctccttgccgaaaacctgctaagtcctgaggacatggtcctttttcacaaccttacccaaccaagaggcgtcaactggtgcgagagaactaccctgtcaaacggggggtgtcagtacctctgcctacctgcacctcagataaaccctcattcccctaaatttacctgcgcctgtcctgacgggatgctcctggcccgtgatatgcggagctgccttactgaggctgaagcagcggtggccacacaggagacaagtacagtccgcttaaaagtgagctccacagctgtacggacccagcacactaccacccgccccgtgccggacaccagtcgactgccaggtgccacaccagggctgacaactgtagagattgttactatgagccaccaggcccttggcgatgttgccgggcgtggaaatgagaaaaagccctcttccgttcgtgcgcttagcattgtcctgcctatcgtattgctggtatttttgtgtttgggggtcttcctcctctggaagaactggaggcttaaaaatatcaatagtataaacttcgacaatccagtgtaccagaaaactactgaggacgaggtccatatctgtcacaaccaggacgggtacagttatccctctcgacaaatggtcagtctggaggatgacgtggcc

SEQ ID NO: 458 - DNA, 2580 bp, Artificial Sequence
  Description of Artificial Sequence: Synthetic Transcript Sequence
atgggtccttggggctggaagcttcgctggaccgtcgcactgctgttggccgctgctggcactgccgtcggggatcgttgcgagagaaatgagttccaatgccaggacggtaagtgtatctcctataagtgggtttgtgatgggagcgcagagtgccaagacggtagcgatgagtctcaggaaacctgtctgagcgtcacctgcaagagcggagactttagctgcggcggtagggttaaccgctgcattccgcaattttggcggtgcgatggacaagtcgactgcgataacggctccgacgaacaaggctgccctccgaagacctgctctcaggacgaattcaggtgccatgatggaaaatgcatcagccggcagttcgtgtgtgattcggaccgcgattgccttgatggtagcgatgaagcctcttgccctgtcctgacctgcggaccagcgtcgtttcagtgtaatagctcgacttgtattccgcaactgtgggcctgcgacaacgacccagactgtgaggatggatccgacgaatggcctcagaggtgcaggggtctgtatgtgttccagggggactccagcccttgttctgcctttgaatttcactgcctgagcggggagtgtatccatagcagctggcgctgcgacggaggtccagattgcaaagataaaagcgacgaagagaactgtgcggtggcaacctgccgtcctgatgagtttcagtgtagcgacggtaattgtatccacggtagccgtcaatgcgaccgggaatacgactgtaaggatatgagcgacgaagtcggctgtgtgaatgtgactttatgcgagggccccaacaagtttaagtgccactccggagaatgcattactcttgataaagtgtgtaatatggcccgagactgtcgcgactggagcgacgaaccgattaaggagtgtgggaccaacgcatgcctcgacaacaacgggggttgtagccacgtatgcaacgatttaaaaattggctatgagtgtctgtgccctgatgggtttcaactggttgcgcagcgccgctgtgaggatatcgacgaatgccaggatcctgacacgtgttctcaactctgtgtgaacctcgagggaggttataaatgccagtgtgaggagggcttccaactggaccctcatacgaaggcgtgtaaagccgttggtagcattgcttacttgttcttcaccaaccgccatgaggtcaggaaaatgacactggatcgttctgaatacacctcgctgatccctaatttacgtaatgtagtggccctggacacagaagtcgcgtcaaacaggatctactggtcagatctgtctcagcgtatgatttgcagtacccagttggatagagcccatggcgtaagcagctatgataccgttatctcccgcgatatccaggcacctgatgggctggcggtcgactggatccattctaatatttattggacagactctgtgctgggaacggtcagtgtggccgatactaagggcgtgaagcgtaaaacgttgttccgtgagaatggctccaaacctcgtgcaattgtcgtcgaccctgttcacggttttatgtactggaccgactggggtaccccagctaagattaaaaagggtggcctgaatggcgtggacatctatagcctagttaccgagaacatccaatggcctaacggcattaccttggatctgctgtctggtcgcctgtattgggtcgattctaaattgcatagcataagcagtatcgatgttaatggcggcaatcggaagaccatcctggaggacgagaagcgtttggcccatccattttcattggcagtgtttgaagacaaagtgttctggaccgatatcattaacgaagctatcttcagcgccaataggttaaccggcagcgacgtgaacctgttggcagagaacctgctgagcccagaggacatggtgctgttccacaatctgacacaaccgcgcggcgtcaactggtgtgaacgcactacactgagcaatggcggctgccagtacctgtgcttgccggccccgcagataaacccacacagccctaagtttacatgtgcatgtccggatggaatgctcctggcgagggatatgcgctcatgtctgaccgaagcagaagcggcggtggcgacccaggaaacgtcaaccgttcgcctgaaggtttcttcaaccgcggtgcggactcagcatacgacgaccaggccggtaccggatacaagccgtctgccgggggcaacaccaggtttgaccaccgtggaaatcgtgacgatgagccaccaggctctgggcgacgtcgcgggaaggggtaatgagaaaaagcctagctccgtccgcgccttaagtattgtcttaccaatcgtgttacttgtgtttctttgcctgggcgtgtttctgctgtggaaaaattggaggctgaaaaacataaacagcatcaattttgataatccggtatatcagaaaactacggaagacgaggtgcacatttgtcacaaccaggacggatactcttacccaagtcgccagatggtgagtctggaagacgacgtggca

SEQ ID NO: 459 - DNA, 2580 bp, Artificial Sequence
  Description of Artificial Sequence: Synthetic Transcript Sequence
atgggcccatggggctggaaactgaggtggacagtggccctgcttttggccgcggccggtactgccgttggggaccgctgcgagcggaacgagttccaatgtcaggatggcaagtgtatttcctataagtgggtgtgcgacggttcagcagaatgccaggatggatccgatgaaagtcaggaaacgtgtctatctgtgacttgtaagagcggagacttctcatgtggaggacgtgtgaaccgatgcattcctcaattttggcggtgcgacggacaggtggattgcgataatggaagtgacgaacagggctgcccacccaaaacctgcagtcaggacgaattccggtgccatgacggaaaatgtatatccaggcagtttgtatgtgactcggatcgcgattgtctcgatggctcagacgaggcatcatgtccagtcttaacttgcgggccagcttcctttcagtgtaattcctccacgtgcatcccacagctctgggcgtgcgataacgatcctgactgcgaagatggctccgacgaatggccgcagcgctgccgcggcttgtacgtgtttcagggggatagctccccatgcagtgcgttcgaattccactgcctgtccggagaatgtattcactcatcctggcgctgcgatggcggccccgactgcaaagataagtcagatgaggaaaattgcgcggttgcgacctgcaggcccgacgagtttcaatgttctgacggaaattgcatccacggttcccgccaatgtgatcgtgagtacgactgcaaggatatgtccgacgaagtgggttgtgtgaacgtcaccctttgtgagggccctaataagttcaaatgtcattctggcgagtgcattactctggacaaagtgtgcaacatggcccgggactgcagagactggtctgacgagccaattaaagagtgcggtacgaacgcctgcctggacaataatggggggtgctcccacgtgtgcaacgacttaaagatcgggtatgagtgcctgtgtccggacgggtttcagcttgttgcacagcgcagatgcgaggatattgatgaatgtcaggaccccgacacctgctcacaattgtgtgtgaatcttgagggcgggtacaagtgtcaatgtgaagaaggctttcagttggatcctcacactaaagcatgtaaggcggttggcagcattgcctatctcttttttactaatcggcatgaggttcgaaagatgacgctcgacagatctgagtacacgagcctgattcctaacctgcgaaacgtggtggctctggatacagaggtcgcctctaacaggatctactggtccgacctctcccagcggatgatatgctcaactcagctcgacagggcccacggggtgtccagttacgacacggtcatctcgcgggacattcaggcacctgatgggctggccgtcgactggatccatagtaatatttactggacagatagcgtactgggcacagtgtccgtggcagacacaaaaggggtcaaaaggaaaaccctgttccgcgaaaatgggagcaagcctcgcgcaatcgtcgttgatcctgtacatggattcatgtattggaccgattggggaactccggcaaagatcaagaaaggagggttaaacggcgtcgatatttattcactggtcactgaaaatatccaatggcccaatggaatcaccttggacctactgtctggccggctttactgggtcgattccaagttgcattccatcagcagtatagacgtcaacggtggcaaccggaagacaatactggaagacgagaaaaggctggctcatcctttcagcttggctgtgtttgaggacaaagttttctggacagacatcataaatgaggcaatattctcagcaaaccgccttactggatccgatgtgaatctgctggccgagaacttactgtcccctgaagatatggtcctttttcacaacctgactcagcccaggggcgtcaactggtgtgagcgcaccactttgagtaacggaggttgccaatatctgtgtcttcctgcacctcagattaatccccattctccaaaatttacctgtgcatgcccagacgggatgctacttgcgcgcgacatgagaagttgcctgactgaggccgaggccgccgtagccacccaggagacgagcaccgtgcggctcaaagtgtcgtctacagctgtccggactcagcataccactacaagacctgtgcccgatacatcgcgcctgcctggcgcaacccccggcctgaccactgttgaaatcgtgaccatgagccatcaggctttgggagacgtggccgggcggggcaacgaaaagaagccctccagcgtgcgcgccttatccatcgtcttgccgatcgtcctgcttgtgtttctgtgcctgggtgtgtttttgttgtggaagaactggcggcttaagaatataaactcgataaacttcgacaaccctgtgtaccagaagactaccgaggacgaagtgcatatttgccacaatcaggacgggtactcctatccgtcccggcagatggtatccctggaggacgatgtggct

SEQ ID NO: 460 - DNA, 2580 bp, Artificial Sequence
  Description of Artificial Sequence: Synthetic Transcript Sequence
atgggcccctggggatggaaactgcgctggactgtggcattgctcctcgccgcggccggtaccgcggtcggagatagatgtgagaggaacgaatttcagtgtcaagatggaaagtgcatctcctacaagtgggtctgcgatgggtccgctgaatgtcaagacggaagcgatgaatcccaagaaacctgtcttagcgtgacttgtaagtcgggagacttctcctgtggcggaagagtgaaccggtgtatcccccagttttggagatgtgatggccaagtcgattgcgataacggatcggatgaacaaggatgccctccaaagacgtgttcacaagacgagttccgctgtcatgatggcaaatgtatttcgaggcaattcgtctgtgacagcgacagagactgtttggatggttcggatgaagcatcgtgtccagttctcacctgtggtccagcctcgtttcaatgcaactcatcgacctgtatccctcaattgtgggcatgcgataacgaccccgattgtgaagatggttccgacgaatggcctcagagatgtagaggactttacgtgttccagggtgattcctcgccatgctcagcatttgagttccattgcttgtcgggtgaatgtattcattcgtcttggcgatgtgatggaggaccagattgcaaagataagagcgatgaagaaaactgcgcagtcgccacctgccgacctgatgagtttcagtgttcagatggcaactgtattcatggatcgcgtcagtgtgatagagaatacgattgtaaggatatgagcgacgaggtgggctgtgtgaacgtgaccctgtgtgaaggacctaacaaattcaagtgccactccggtgaatgcatcacccttgataaggtgtgcaacatggctcgcgattgccgagattggtccgatgaacctatcaaagaatgtggaactaacgcgtgtctggacaataacggtggatgttcgcacgtgtgtaatgatcttaagattggatatgaatgcttgtgtcctgacgggtttcaacttgtggcgcagcgccgttgtgaagatattgatgagtgccaggatccggatacttgttcgcaactttgtgtgaacctggaaggtggttacaagtgccaatgcgaagagggctttcagttggatcctcatactaaagcatgcaaggccgtcggatccattgcttatctgtttttcaccaacagacatgaagtgagaaagatgactctggatcgcagcgaatatactagccttatccccaatcttcgaaacgtggtggccctcgataccgaagtggcatccaaccgcatttactggtccgatctgagccaacggatgatttgcagcacccaacttgaccgggcacatggagtgagctcctacgataccgtcatctcgcgtgacatacaggcccctgacgggcttgcggtggactggattcattccaacatatactggaccgactccgtccttggaaccgtttcagtggctgacactaagggggtgaagaggaaaaccctctttcgggagaatggctcgaagccacgcgcgattgtggtggatccagttcacggatttatgtactggactgactggggaactccggcaaagattaagaaaggcggtctgaatggtgtcgacatatactcgctggtgaccgagaatatacaatggcctaatggcattaccttggacctgctctcagggcggctgtactgggtcgactccaagctccatagcattagctcgatagacgtcaacggcggtaaccggaaaaccattcttgaagatgagaagcggctggcacacccattctccctggcagtgtttgaggataaagtcttttggacggacataatcaatgaagcgatctttagcgccaatcggctgacgggatcggacgtgaaccttctggctgagaatctgctttcgcctgaagatatggtgctgtttcataatctgactcaacctagaggtgtcaactggtgcgagagaactaccctttccaacggcggttgtcaatacctttgccttcctgcaccacagattaatccccatagccctaaattcacttgtgcttgtcctgatggtatgctgcttgcacgggacatgagatcgtgtcttaccgaggccgaggcagcagtggccactcaagaaaccagtaccgtcagactgaaagtgtcatcaaccgcagtgaggacccaacataccaccacgcgcccggtgcctgatactagcagattgcctggggcaacgcctggacttactaccgtcgaaatcgttactatgagccatcaagcgcttggagatgtggccgggagaggcaacgagaaaaagccatcatctgtccgcgcattgtccatcgtgctgcctatcgtgcttctcgtctttctgtgtcttggtgtctttctgctctggaagaactggcggctcaagaacattaactctatcaatttcgacaaccccgtgtaccaaaagaccaccgaagatgaggtccatatctgtcataatcaagacggatactcgtacccttcccggcaaatggtgtctctcgaagatgatgtggcg

SEQ ID NO: 461 - DNA, 2580 bp, Artificial Sequence; identical to SEQ ID NO: 459
  Description of Artificial Sequence: Synthetic Transcript Sequence

SEQ ID NO: 462 - DNA, 2580 bp, Artificial Sequence
  Description of Artificial Sequence: Synthetic Transcript Sequence
atgggaccctggggttggaagctgcggtggactgtggcactgctcttggccgcagcagggactgccgtgggagatcggtgtgaacggaatgagtttcagtgtcaagacggaaagtgcatctcctacaagtgggtgtgcgatggtagcgcagaatgtcaggatggttcggacgaatcacaggaaacgtgtctctccgtgacctgtaagtccggcgacttttcctgtggaggaagggtgaacagatgtatacctcagttttggcgatgtgacgggcaagtggattgcgataatggatcagacgaacaaggatgcccccctaaaacttgttcgcaggatgaatttaggtgtcatgatggaaaatgtatttcgcggcaattcgtgtgcgattcggatagggattgtctcgacggttccgatgaagcatcctgccctgtgcttacctgtggcccagcatccttccaatgcaatagctccacctgtattccacagctttgggcatgtgacaatgatccagactgcgaggacggctccgatgagtggccacaaagatgtcgggggctgtacgtgttccaaggagattcgtcgccctgtagcgcattcgaatttcattgcctgtcgggcgagtgtatccattcatcgtggcgctgtgatgggggaccagactgtaaagataaaagcgatgaggagaattgtgccgtggcaacttgccgacctgatgagttccaatgttcagatggaaactgtattcatggttcaagacagtgtgatcgtgaatacgattgtaaggatatgtctgatgaagtgggatgtgtgaacgtcactttgtgtgagggtccgaataagtttaagtgccattcaggagaatgcataaccctcgataaagtctgtaatatggcgcgtgattgcagagattggtccgacgaaccgatcaaggagtgtggcaccaacgcctgtctcgacaacaacggaggctgttcccatgtctgcaatgatcttaagattggatacgaatgtctgtgcccggacggatttcaactcgttgcccaacgcagatgcgaagatattgatgaatgtcaagatcctgacacttgctcgcagctgtgtgtcaacctggaaggcggttacaagtgccagtgtgaagagggatttcaacttgatccccataccaaggcatgtaaggcagtcggctcgattgcatacctcttctttaccaaccgccacgaggtcagaaagatgactctcgataggtcagaatacacgtccctgatccctaacctgagaaacgtcgtggctctcgatactgaggtggcgtcgaaccgcatatactggagcgatctgtctcaaagaatgatctgttctactcaacttgatcgcgcacatggagtgtcgtcgtacgataccgtgatttcgagggacattcaagcacctgacggacttgcagtggactggattcattctaacatatactggaccgactccgtgcttggtaccgtgtcagtcgctgacaccaagggtgtaaaaaggaaaaccctcttcagggagaatggttcgaagccaagagcaatagtcgtggatcctgtgcatggttttatgtactggactgattggggaacccctgcaaagattaagaagggaggtctgaacggagtggacatctattccctcgtcacggaaaacattcagtggcctaatgggatcacgcttgacctgctttcgggacgcctttactgggtggattcgaaactgcattcgatctcctcaatcgacgtgaacggcggaaacaggaaaactatattggaagatgaaaaacgactggcccaccctttttccctcgccgtgtttgaggataaggttttttggactgacatcattaacgaagcgatcttttccgcaaacagattgactggatcggacgtgaaccttctcgccgaaaatctgctgtccccagaagatatggtcctctttcacaaccttacccagccacgcggggtcaattggtgcgaacggaccactctctcgaatggggggtgccaatacctgtgtctgcctgcgccacagatcaaccctcatagccctaagttcacctgtgcatgtccagatggaatgctgctcgcccgtgatatgcggtcatgccttaccgaagcagaagcagcagtcgcaacccaggaaacctcgactgtccgccttaaggtcagctccactgctgtgaggacccagcatactaccactagacccgtgccagatacttcacgccttcctggagcaaccccaggtcttaccaccgtcgagatcgtgaccatgtcacatcaagcactcggagacgtggccgggagggggaatgagaagaagccttcaagcgtgagagccctgagcattgtccttccaatagtccttcttgtgtttctgtgtctgggtgtgttccttctgtggaagaattggcgtctgaagaacatcaattcaatcaattttgacaaccctgtgtaccaaaagacgactgaagatgaggtgcacatttgtcataatcaggatgggtactcctacccttccagacagatggtgtccctcgaggacgacgtggcg

SEQ ID NO: 463 - DNA, 2580 bp, Artificial Sequence
  Description of Artificial Sequence: Synthetic Transcript Sequence
atgggcccatgggggtggaagctgaggtggacggtagcattgctccttgcagccgccggcactgccgtgggcgatagatgcgagcgaaacgaattccagtgccaggatgggaaatgtatttcgtacaaatgggtctgtgacggatcagccgagtgccaagacgggtctgatgaatcacaagagacgtgcctgtcagtaacatgcaagagcggtgatttctcctgcggcggcagggtgaaccgctgtataccccagttctggaggtgtgacggacaagtggattgcgacaatggctctgacgaacaagggtgtcctcctaagacctgctcccaggacgaatttcgctgccatgatgggaagtgcattagccggcagttcgtttgtgattcggacagagattgtctggatggttcagacgaggcatcctgcccggtgctgacttgtggtccagctagtttccagtgcaattcctccacatgtatcccccaactctgggcgtgtgacaatgacccagattgtgaggacggaagcgacgaatggcctcaacgatgccggggcctgtacgtgttccaaggcgactcatccccgtgttcggcctttgagtttcattgtctatcaggcgagtgcatccacagttcgtggaggtgtgacggcggcccagactgtaaggataagagcgacgaagaaaactgcgccgtcgctacttgcaggccggatgaatttcagtgctctgatggaaactgcattcacgggtcgagacagtgcgacagagagtacgattgtaaggacatgtccgatgaagtgggctgcgtaaatgtcacattgtgcgagggaccaaataagttcaaatgccacagtggagaatgtattaccctggacaaggtttgtaatatggctagggattgtcgggactggtccgacgaacctattaaggagtgcgggacaaacgcttgcctcgacaataacggcggatgtagtcacgtctgcaacgacctcaaaattgggtacgagtgtttgtgcccagacgggtttcagctcgtggcccagaggcggtgtgaagatatcgacgaatgccaggatcctgacacctgtagccagctatgtgttaacctggaaggaggttacaagtgtcagtgtgaagagggctttcaactggaccctcacactaaggcctgcaaagccgtggggtctatagcctatctgttctttaccaatcggcacgaggttaggaagatgaccctcgataggtccgagtacacttctctgatcccaaaccttaggaacgtggtggcactggacactgaagtcgcaagcaataggatctactggagtgatcttagtcagcggatgatttgtagtacccagctggaccgggcgcatggcgtctccagctacgatactgtgattagtagggacatccaggctcccgacggactcgccgtggactggatccactcgaatatctactggacagatagcgtgcttggcactgtgagcgtcgccgatactaagggagtgaaacggaagaccttatttcgcgaaaacgggtctaaaccgcgtgctatagtggtcgatccagttcatggatttatgtattggacagactggggcaccccagccaagattaaaaagggcggtctgaatggcgttgacatctattctcttgtcaccgagaacatacaatggcctaatgggattacgttggatctgttgagtggaaggctttattgggttgattccaagttgcactctattagctcaatcgacgtaaacggagggaatcggaagaccatactcgaggacgagaaacgacttgcccatccttttagccttgcagtgttcgaggataaggtgttttggactgacatcataaacgaggccatcttctctgccaacaggttgactgggtccgatgttaacctgctggctgaaaacctgttgtctcccgaggatatggtcctgttccacaacctcacccagccgcgcggggtgaactggtgcgaacgtaccactctgtcaaatggcggatgtcaatatctgtgtctaccagcgccccagattaatccccactctcccaaattcacttgtgcgtgtcctgatggcatgctgctcgcgcgggatatgcgctcttgtctgacagaggccgaagccgcagttgctactcaagaaacatcgaccgtgagactgaaagtgagctccacagcagtgagaacgcagcacactaccacaagacccgtgcccgacacctcacgactcccgggggccacacccggcctcactacagttgagatagtcactatgagtcaccaagctctgggagacgtggcgggacgggggaatgagaaaaagccatccagtgttcgtgcactgtctatagtgctgccaatagtcctgctcgtgttcctgtgtctgggtgtcttcctcctttggaagaattggcgactcaaaaatattaactcaatcaattttgacaatcccgtctatcagaaaacaaccgaggacgaggttcatatctgtcataatcaggatggctactcctacccctccaggcagatggtttccctcgaagacgacgtcgcc

SEQ ID NO: 464 - DNA, 2580 bp, Artificial Sequence
  Description of Artificial Sequence: Synthetic Transcript Sequence
atgggaccatggggttggaagttgcgttggacggtggccctcctccttgcagcggcggggacggcggtgggtgaccgctgcgagagaaatgaattccagtgccaagatggtaagtgtatctcgtacaagtgggtctgtgatggatccgcagaatgccaggacggctcagacgaatcgcaagagacttgtctgagcgtcacttgcaaatctggagacttttcatgtgggggaagggtgaatcggtgcattccacagttttggcggtgtgacggtcaagtcgattgtgacaatggatccgatgaacaagggtgtccaccaaagacttgttcccaagatgaattcagatgccatgacggaaagtgtatttccagacagttcgtttgtgactctgaccgggattgtcttgatggcagcgacgaagcaagctgtcctgtgcttacgtgtggtcctgccagctttcagtgtaactcgtcgacctgtattccccagctctgggcttgtgataatgatcccgattgtgaagatggctcggatgagtggccacagcgctgtaggggcctttacgtgtttcagggtgactcgagcccatgttcagcattcgagttccattgcctttccggcgagtgtatacattcctcctggaggtgtgatggtggccctgactgtaaagataaatccgacgaggaaaactgcgcggtggccacttgcaggcctgacgaatttcaatgttcagacggcaattgtatccatggatcgcgtcaatgcgatagagaatatgattgtaaggatatgtccgatgaagttggatgtgtgaacgtgactttgtgcgaaggacctaacaagtttaagtgtcatagcggggagtgcataactttggacaaggtgtgcaatatggcaagagactgccgtgattggtccgatgagcccattaaagaatgcggtaccaatgcgtgtctcgacaacaacggtggatgttcgcatgtgtgcaatgacctgaaaattggatacgaatgcctgtgccccgacggatttcagcttgtggcgcagcggcgctgcgaggatatcgatgagtgtcaagatcctgatacgtgtagccagttgtgtgtgaacctcgagggtggatacaagtgtcagtgtgaggaaggattccaacttgacccgcatactaaggcttgtaaagcagtgggaagcattgcttacctctttttcacgaaccggcacgaagtccgcaagatgactctcgacagatcggaatacacgagccttattccgaatctccggaacgtggtggccctggataccgaagtcgcgtcgaacagaatctactggagcgatctgagccagcggatgatatgttcgacgcaactggacagagcacacggagtctcatcctacgacactgtgatcagccgagatattcaagcacccgatggattggcagtggactggattcactcgaatatctactggaccgacagcgtgcttggaactgtgtcggtggcagataccaagggcgtgaagcgaaagaccctttttagagaaaatggctccaaacctcgtgcgattgtcgtggaccccgtccatggtttcatgtactggactgactggggtactcctgcaaagatcaagaaggggggactgaacggtgtggatatctactcccttgtgactgaaaacattcagtggcccaatggtattaccttggacctgctcagcggccgcctgtactgggtggactccaagctccattcgatctcttcgatagacgtgaacggaggtaatcgtaaaactattctcgaggacgaaaagcgtctcgcacatccattttcactggcagtgttcgaagataaggtgttttggactgacattatcaacgaagcgatcttttctgcgaacaggctgactggaagcgatgtcaatttgcttgctgagaacctcctctcgccagaggatatggtattgtttcataacctcacccagcctaggggggtgaactggtgtgaaaggactaccctgtccaacgggggatgtcaatacctctgcctgccagcacctcagattaacccccatagcccaaaattcacttgcgcatgccctgatggaatgcttcttgcaagagatatgcggtcatgtcttaccgaagcagaggcagctgtggcgacccaagaaacctccactgtgcgcctgaaagtgtcatccaccgcagtgagaacgcagcacactacgacccggccagtgccagatacttcgcgcctgccaggagcgactccagggctgaccactgtggagatcgtgactatgtcacatcaggcactgggggacgtcgcgggtagggggaacgaaaagaagccttcgtccgtgagagcactctcgatcgttcttccaatagtgcttctggtgtttctgtgcctcggcgtctttctgctttggaagaactggcgactcaaaaacattaactccattaactttgataacccagtgtaccaaaaaaccaccgaggacgaggtccatatttgtcacaatcaggatggttacagttacccttccagacaaatggtgtcactggaggatgatgtggca

SEQ ID NO: 465 - DNA, 2580 bp, Artificial Sequence
  Description of Artificial Sequence: Synthetic Transcript Sequence
atgggcccctgggggtggaagcttcgttggacggtagctctgctgctggcagcagcaggcacagctgtcggggatcgctgcgagcggaatgagttccaatgtcaggatggcaagtgcatctcctacaagtgggtgtgcgacgggtccgcggagtgtcaggacggttctgatgagtctcaggaaacatgtctgagtgtgacatgtaagtcaggggacttttcttgcggtggcagagtaaatagatgcatacctcagttctggcgctgcgacggacaggtggattgtgacaacgggagtgatgaacaaggatgtccgccgaaaacatgttcccaggacgaatttcgatgtcacgatggcaagtgcatctctaggcagttcgtgtgcgattccgatcgcgattgcctggacggctccgacgaggcaagttgccctgtgcttacatgcggtccagcctcctttcagtgcaactccagtacttgcattccgcagctctgggcctgtgataatgatccagattgtgaggatggctccgacgagtggcctcagaggtgtagaggcctgtatgtcttccagggggattcttcaccatgttccgcttttgagtttcactgcctgtcaggcgagtgcatacattcatcttggcgatgcgacggcggcccggattgtaaggacaagtctgacgaggaaaattgcgctgttgccacctgtcgacccgatgagttccagtgttcagacggaaactgtatccacggctccagacagtgtgatcgggaatatgattgtaaagacatgagcgatgaagtcggatgcgtcaatgtcactctatgcgagggtcctaacaagtttaaatgccatagcggagaatgcatcaccctcgacaaggtctgcaatatggccagagattgccgggattggtccgatgagccgataaaggagtgtgggaccaacgcgtgcctggacaacaacggcggctgcagtcacgtctgcaacgacttgaaaatcgggtatgaatgtttgtgcccagacggctttcaactcgtcgcacagaggagatgtgaggacatagatgagtgccaggacccagacacctgcagccaactgtgcgtgaacctcgagggtggctataagtgccagtgcgaggaaggttttcagcttgacccccatacaaaagcctgcaaggcagtcggctcaatcgcctatcttttttttactaaccgtcatgaggtccgtaagatgaccctggatcggtcagagtatacctcactgataccaaacttacgcaatgttgtggcacttgacacggaggttgctagtaatcgcatatactggtcagatctgtctcaacgcatgatctgtagtactcagctggaccgtgctcatggagtgtccagctatgacacggtaatcagccgggatatccaggcccccgacgggcttgccgtggactggatccactctaatatctattggaccgactccgttctcggaacagtcagcgtggctgacacgaagggagtgaagaggaaaacactgtttcgggaaaatggctcaaagccacgggctatcgtggtggatcccgtgcatggcttcatgtactggactgactggggaacacctgctaagataaagaagggcgggctgaacggagtcgatatatatagcctagtcactgagaatattcagtggccgaacggaatcactctcgatctgcttagcggtagattgtattgggtggactccaaattgcactctatcagctccatcgacgttaacgggggcaacagaaagaccattttagaggacgaaaagcgactcgctcaccctttcagcctggcagtattcgaggacaaggtgttttggactgatattatcaacgaagcaattttctccgccaacaggttgacaggcagtgacgttaacctcctagccgagaaccttctctcccctgaagatatggtgctgtttcataacctgacccaacccaggggcgtaaactggtgtgaacgcactacgctgagcaatggcgggtgtcaatacctatgcctgccagccccccagataaaccctcattcaccaaaatttacatgcgcctgtcctgatggcatgctcctcgctagagacatgagatcgtgccttaccgaagccgaagcggcagtggctacgcaggagactagcacagttaggttgaaagtctctagcacagctgtcagaacacagcatacaactacccggcccgtccctgatacgtccagattgccaggggccacgccaggcttgaccaccgttgaaattgtgactatgagccaccaggcgctcggagatgtcgccggaagaggcaacgaaaagaaaccttcgtctgttcgagcactcagcatcgttctgcccatcgtgctgctggtgtttctatgcctgggcgtgttcttgttatggaagaattggagactgaagaacatcaactctatcaacttcgacaaccccgtgtatcagaaaacgaccgaagatgaagtccatatctgccataaccaggacggttactcgtacccttccaggcagatggtgagcctggaagatgacgtggca

SEQ ID NO: 466 - DNA, 2580 bp, Artificial Sequence
  Description of Artificial Sequence: Synthetic Transcript Sequence
atgggaccatggggctggaaactcagatggaccgtggcgcttctgcttgccgcggcaggaactgccgtcggcgaccgctgcgaacgcaacgagttccagtgtcaagacggtaagtgtatctcgtataagtgggtgtgcgatggtagcgctgaatgccaagatggatccgacgaatcccaggagacttgcctgtcggttacttgcaagtctggagatttcagctgcggaggccgcgtgaatcggtgtattccccagttctggagatgcgatggacaggtagactgcgacaacggctccgatgagcaggggtgcccacctaagacctgctcacaagacgagttcagatgccacgacggcaagtgtatctcccgacagtttgtgtgcgactcagaccgggattgcctggacggctcggacgaggcttcctgccccgtgcttacctgtggacctgcgagcttccaatgtaattcctcgacttgtataccccagctgtgggcttgcgacaatgacccggactgcgaagatggatcagacgaatggccgcagaggtgccggggactgtacgtgttccagggtgattcttcaccgtgctccgcttttgaatttcactgcctgtcaggggagtgtattcactcctcatggcgctgcgacggaggacctgactgcaaagataagtccgacgaagagaactgtgccgtggccacctgccggcccgatgaatttcaatgttccgacggaaattgcatccacggaagtcggcagtgcgaccgcgagtacgactgcaaggatatgagtgacgaggtgggctgcgtgaacgtgactctgtgcgaaggtccaaataagttcaaatgccacagcggcgaatgcattactctggataaggtgtgtaatatggcacgggactgccgcgactggtcggatgagccgattaaagaatgcggaactaatgcttgcctggacaacaatgggggctgcagccatgtctgcaacgatctgaaaatcggctatgaatgtttgtgtcctgatggatttcagctggtggctcagcggcgctgtgaagatatcgacgaatgtcaggatcccgatacctgtagccagctctgcgtgaacctcgaaggcggatacaaatgccagtgcgaagaggggtttcagctcgatccgcatactaaggcctgcaaggctgtgggatccatcgcctacctgttctttaccaaccggcatgaagtgcgcaaaatgactctcgacagatccgaatacaccagcctgatcccgaatctgaggaatgtcgtcgcattggacaccgaagtggcgtccaacagaatctactggtcggatttgtcccaaaggatgatctgtagcactcagttggatcgcgctcacggcgtgtcgtcatacgacaccgtgatctcgcgggacattcaagcccccgacggactggcggtggattggatccattcgaacatctactggaccgattcggtccttggaactgtgtcagtggcagataccaaaggcgtgaagagaaagacgctgttccgcgagaatggctcgaaaccaagggcgatcgtggtcgacccagtgcacggattcatgtactggaccgactgggggactcccgcaaagattaagaagggcggactcaatggcgttgatatctactcactggtcactgagaacattcagtggcctaacggtattactttggatctgctcagcgggcgtctctactgggtggactccaagctgcactcaatctcgagcatcgacgtgaacggaggcaaccggaaaactatactggaggacgaaaagcggttggcccatccattctctctcgccgtattcgaggataaggtgttctggactgatatcatcaacgaagccatcttttccgcgaaccgccttaccggaagcgacgtcaacctgctcgctgagaacctcctgtcgccagaggacatggtcctgttccacaatctcacccaacctcgcggggtcaactggtgtgaacgcaccacgctgtccaacggtggctgtcagtacctgtgcctcccggcacctcaaatcaacccgcactctccgaagtttacctgcgcctgtccggacggaatgttgttggcaagagatatgcgctcctgcctgactgaagcggaagccgccgtcgccactcaggagactagcacggtccgcttgaaagtgtcctcgactgcggtcagaactcaacacaccaccacgaggccggtgcctgatacgtcccgcttgcccggggcaactccgggattgaccactgtggaaattgtgactatgtcacatcaagcactcggcgacgtcgcaggacgggggaacgaaaagaagccatcctccgtgcgagccctgtccatcgtgctcccaatcgtcctgcttgtgttcctttgcttgggagtgtttttgctttggaaaaactggcgcctgaagaacatcaattccatcaattttgacaatcctgtctaccaaaaaactacggaggacgaagtccatatctgtcataaccaggacggatactcgtaccctagtcgccagatggttagcctggaggatgatgtggct

SEQ ID NO: 467 - DNA, 2580 bp, Artificial Sequence
  Description of Artificial Sequence: Synthetic Transcript Sequence
atgggaccctggggctggaaactacggtggacagtagccctgctcctagccgcagcaggaacagcagttggagatcgctgcgaaaggaacgaatttcagtgccaagatgggaagtgcatctcctacaagtgggtatgtgacgggtcagctgagtgtcaggatggaagtgacgaaagccaggagacatgtctgtcagtgacttgcaagtccggagatttctcatgtggcggccgagtcaacagatgtatcccacagttttggcggtgtgatggccaggttgactgcgataacggaagtgatgaacaaggatgtccaccaaaaacgtgttctcaggatgagtttcggtgtcacgacggcaaatgcatttcccgacaattcgtgtgcgactccgatcgagactgcttagacgggagtgatgaagccagttgtcctgtgcttacctgcgggcccgccagtttccagtgtaatagcagcacatgtattccccagttgtgggcgtgcgacaacgatcccgattgcgaagacggatccgacgagtggccccagcggtgccgcggcctatacgtctttcagggggattcatccccttgctcagcctttgagttccattgcctgagcggcgaatgtatccactcttcgtggcggtgtgatggtggacctgattgtaaggacaaaagtgatgaggagaattgtgcggttgccacctgcaggcctgatgaattccaatgctcagatggaaactgtattcacggatcgcggcaatgtgatagagagtatgattgcaaagatatgtctgacgaggtcgggtgtgtgaatgtcaccctgtgcgagggtcccaataagttcaagtgtcacagcggtgagtgcataaccctggataaagtgtgcaatatggcccgagattgcagagactggtccgatgaaccgatcaaggaatgcgggacaaatgcttgcctggacaataatggagggtgcagccatgtgtgcaatgatctgaagatcggctacgagtgcttatgtccagacggctttcagctggtcgctcaaagaaggtgtgaagatatcgacgaatgtcaggatcccgacacttgtagtcagctgtgcgtgaacctcgagggcggatataagtgccagtgtgaggaggggtttcaactcgatccccacactaaggcctgcaaagcagtcgggtccattgcctatctgttcttcacaaaccgacacgaggtcagaaagatgaccctggacaggtccgagtacacttctttaattcctaacctgcgtaacgtggtggccctggatacagaggttgcttctaatcggatttactggagtgacttatcacagaggatgatttgtagcactcaactggatcgagctcatggtgtttcttcttatgataccgtgatatcccgggacatccaggcccccgacgggcttgccgtggattggatccattctaatatttattggaccgactctgtgctcgggacagtgtccgtggctgacacaaagggtgtcaagagaaagaccttgttccgagaaaacggtagcaagccacgggccattgtcgtggatcccgttcacggcttcatgtactggaccgactgggggactcctgcaaagataaaaaagggcggcctgaacggagttgacatctacagtctggtcacagagaacatacaatggccaaacggaatcaccctggatttactgagcgggcggctgtattgggtcgactccaagcttcatagtatcagctccatagacgtgaacggtgggaaccgcaagaccatacttgaggacgaaaagcggttggcgcaccctttttccctggctgtattcgaggacaaagtcttctggaccgatattataaacgaggccattttcagcgccaatcggctgaccggaagcgacgtgaaccttttagccgagaacctgttgagcccagaggatatggttctcttccacaacctgacccagccaagaggggtgaactggtgcgaaagaactaccctgtcaaacggcgggtgtcagtacctgtgcctccctgctcctcagatcaacccgcattcgccgaagttcacttgtgcctgccccgatggcatgctgctcgcacgggacatgcggtcctgcttaactgaggccgaggccgcagtcgctacacaggagacctcaaccgtgcggttaaaagtcagttctactgcagtgcggacccagcatacaacgacacgcccagtgccagacaccagcagacttcccggagctactcctggactgaccaccgtagaaatagtgacaatgtcacaccaggcccttggggacgtggcgggccggggaaatgagaaaaagccttccagtgtccgggcactcagtatcgtcctgcctatcgtcctcctcgtctttttatgcctcggcgtgttcctgttgtggaagaactggcggctgaagaatatcaatagtataaatttcgataatcccgtgtaccagaaaaccacggaggatgaggttcatatctgtcacaaccaggatggatacagctaccctagtagacaaatggtctctctggaagacgatgtggcc

SEQ ID NO: 468 - DNA, 2580 bp, Artificial Sequence
  Description of Artificial Sequence: Synthetic Transcript Sequence
atgggaccgtggggatggaaactgcgatggaccgtcgcactgttgctggcagcggcaggtacggcggtgggcgaccggtgcgaaaggaacgagttccagtgtcaagatgggaagtgcattagttacaaatgggtctgcgacgggtccgcagaatgtcaggatggctccgatgagtcccaggaaacctgtctgtcggtcacctgcaaatccggagacttctcgtgcggtggacgcgtgaacagatgtatccctcagttctggagatgcgatgggcaagtggattgtgataacggaagcgacgaacaaggatgccctcccaagacttgtagccaagatgagttccgatgccatgacggcaagtgcatctcacggcagttcgtctgcgattcggatagagattgcctggacggatccgacgaagcctcctgcccggttctgacctgcggcccggcgtcgtttcagtgcaactccagcacctgcatcccgcagttgtgggcgtgtgacaatgatccggactgcgaggacggatctgacgaatggccgcagagatgtcggggactctacgtgtttcagggcgattcctccccctgcagcgctttcgagttccactgcctgtcaggggagtgcatccactcgagctggcgctgcgacggaggcccggactgtaaggacaagtctgatgaggaaaattgcgctgtggcaacctgccggccggacgaattccagtgcagcgacggaaattgcatacatggatcccgccaatgcgatcgggaatacgactgcaaggatatgagcgacgaagtcggatgcgtgaacgttactctttgcgagggacctaataagtttaaatgtcattcgggggaatgcatcaccctcgataaggtctgcaatatggcacgcgactgccgcgactggtcagacgaacccatcaaagagtgcggcaccaacgcttgcctcgacaataacggaggatgctcccacgtctgcaacgaccttaaaatcggttacgagtgtctgtgcccggacggattccagctggtcgcccaacgcaggtgcgaggacatcgacgagtgtcaggacccagacacctgctcacaactgtgtgtgaacctggagggcggttacaagtgtcaatgtgaggaagggttccaactcgatccacacactaaggcttgcaaggccgtgggatcgattgcatacttgtttttcactaatcggcacgaagtgcggaaaatgaccttggaccgcagtgaatacacctccctgattccgaatctccggaacgtcgtggctctggacactgaagtcgcctcgaacaggatctactggagcgatctgagccagcgcatgatctgctcgactcagctggatcgggcgcacggtgtgtccagctatgacaccgtcatcagccgggacatccaggcccccgatggactggccgtggattggattcattcgaatatttattggaccgatagcgtgctcggcaccgtatcagtggctgataccaagggagtgaagcgtaagacccttttccgcgaaaacggttccaagccacgggcgatcgtcgtcgacccagtgcatggctttatgtactggacggactggggaactcctgccaaaatcaagaagggaggcctgaacggcgtggatatctacagcctcgtgactgaaaacatccagtggccaaacggaatcactcttgacctcctctcaggcagactgtactgggtggattctaagttgcattcgatttcgtcaatcgacgtgaatggaggaaatcgcaagaccatcctggaggacgaaaaacggctcgcccatccgttctcgttggccgtgttcgaggacaaggtgttttggactgatatcatcaacgaagccatcttctcggcgaatagattgaccggatcggacgtcaacctgctggccgagaacctgctctcaccggaggacatggtcctgttccataatctgactcagccgaggggggtgaactggtgcgaacgcactacgctgtcgaacgggggttgccaatacctttgccttcctgccccacagatcaaccctcactcgccaaagttcacctgtgcttgtcccgatgggatgctgctcgccagagatatgagatcgtgtctcaccgaagccgaggcagccgtggctacgcaggaaacttccactgtgcgtctcaaggtatcaagcactgcagttagaactcagcacaccactactcgcccggtgccggacactagccgcctccctggtgcgactccaggcctgacgaccgtggagatcgtcacgatgtcccaccaggcgctgggagacgtcgccggccgcggaaatgaaaagaaaccaagctcggtgagggcgctgtcaatcgtgctgccgattgtgcttttggtgtttctctgcctgggagtgttcctgctctggaaaaactggcggctgaagaacatcaactccatcaacttcgataaccctgtttaccaaaagaccaccgaagatgaagtgcacatctgccacaatcaagacggctactcatacccatcacgccaaatggtgtccctcgaggacgacgtggcc

SEQ ID NO: 469 - DNA, 2580 bp, Artificial Sequence
  Description of Artificial Sequence: Synthetic Transcript Sequence
atggggccatggggatggaagctgcgatggaccgtggctctgttgctagccgccgcggggactgctgtgggagacagatgcgaacggaacgagtttcagtgccaggatggcaagtgcatctcctacaagtgggtgtgcgatggttcagctgagtgccaggatgggagcgacgaatcccaggaaacctgcctctccgtcacttgcaagtccggggatttctcctgtggtggcagagttaacagatgcatacctcaattttggcggtgtgacggacaagtggattgtgacaatggctctgatgagcagggttgcccccccaagacttgtagccaagatgaatttcgatgccacgacggcaaatgcatttcgcggcagttcgtttgtgattcggacagagactgcctggacgggtctgatgaagcgagctgtcctgtcctaacctgcggccccgcatcctttcagtgcaatagctccacctgcataccacaattgtgggcatgtgataatgatcccgactgtgaagacggatccgatgaatggccacagcgttgtagggggctgtatgtctttcagggtgacagtagcccgtgttcggcctttgagttccactgtctgtctggcgaatgtatccactcatcctggcggtgcgacggaggaccagattgtaaggacaaatccgacgaggagaattgtgctgtggccacctgccgcccggacgaattccaatgctcagacggcaactgcatccatggatcccgtcaatgtgatagggagtacgattgcaaagatatgagcgacgaagtgggatgcgtgaatgtaaccctttgcgaaggccccaacaaattcaagtgccatagcggagaatgcatcactctcgataaggtgtgcaacatggcccgggattgtagagactggagcgacgagccaatcaaggaatgtggaacaaatgcctgtctggataataacggaggatgctcacatgtctgcaatgatctgaaaattggctacgaatgcctctgcccagacggctttcaactggtggcgcagagaagatgcgaggatattgacgagtgccaagatcctgacacctgctcacagttgtgcgtcaaccttgagggcgggtataagtgtcaatgtgaagaggggtttcagctggatccccacactaaagcctgcaaagcggttgggtccatcgcatacctcttctttactaatcgacacgaagtccgcaaaatgacactcgaccggagtgaatatacaagcctgattcctaatctacgaaatgtggttgcactcgatacggaggttgcatctaaccgcatatattggtccgatttgtcccaaaggatgatctgcagcacgcaactggatcgggctcatggtgtgtcatcctacgacacagtcatctccagggacatccaagccccggatggccttgccgtggactggatacatagcaacatttattggactgattccgtactagggacggtgtctgttgcagacaccaagggggtaaagcgaaaaaccctattccgagagaatgggtctaagcctagggcgatcgtggtcgaccctgtacacgggttcatgtactggactgactggggtaccccagccaagatcaagaaggggggactcaacggcgtcgacatctatagcctagttaccgaaaacatacagtggcctaatgggataactcttgacctgttgtctggtagactgtactgggtggacagtaagctccattctataagctccatagatgtgaatggcggcaaccggaagactatcctcgaggacgaaaagcggttggcccatccctttagtctcgctgttttcgaggacaaggttttctggactgacatcattaacgaagcgattttttcagccaatcgcctgacggggtccgatgtgaaccttttggctgaaaacctcctttctcctgaagatatggtactctttcacaatctgacgcagcctagaggcgtcaattggtgtgaacgtaccaccttaagcaacgggggatgccagtatctgtgcttacctgcaccgcaaatcaacccacactcacccaagttcacctgcgcttgtccagacggaatgctgttggctcgagacatgcgtagttgcctgacggaggccgaagcggccgtggcaacccaggaaactagcactgtccgcctcaaggtcagcagcaccgcagtgagaacacagcatacgaccactcgaccagtgcccgatacgtcgcggttacctggggccacaccgggtctgaccacggtggagattgtgacaatgtcccaccaagccctcggtgatgtggctggtcgcggtaatgagaagaaaccatctagcgttagggccttgagcattgtactccctattgtactcctggtgttcctgtgtctcggggtttttctactttggaagaactggcggttgaagaatattaattccattaactttgacaatcccgtgtatcagaaaaccactgaagatgaagtccacatttgtcataaccaggacggttattcctacccatcccggcagatggtgtcgctggaggacgacgtcgct

SEQ ID NO: 470 - DNA, 2580 bp, Artificial Sequence
  Description of Artificial Sequence: Synthetic Transcript Sequence
atgggtccctggggttggaagctcaggtggaccgtggcactgctccttgccgccgcgggtactgccgtgggtgatcgctgtgaaagaaacgaatttcagtgccaggacggaaagtgtatctcatataagtgggtctgcgacggaagcgctgaatgtcaagatggttcagacgaatcacaggagacctgcctcagcgtgacttgcaaaagtggtgacttcagttgtggaggtagggtaaaccgctgtattccacagttttggagatgcgatggacaggtggattgcgacaatggatctgatgagcaaggttgcccccccaaaacgtgctcccaggatgaattccgctgccacgacggtaagtgtatcagtaggcagttcgtgtgtgactccgaccgcgactgtctcgacggctctgacgaggcctcttgtccggttctgacatgtggccctgcttctttccagtgtaattcatctacctgcattccccaactctgggcctgtgacaacgatccagactgtgaggatggcagcgatgagtggcctcagagatgcagaggactctacgtattccaaggagactcctccccgtgcagtgcatttgaatttcactgcctgtccggcgaatgtattcattcttcttggaggtgcgacggtggcccagattgcaaagacaaatccgacgaggaaaattgtgccgtcgcaacgtgccgccctgatgaatttcagtgctcagatggcaactgcatccacggaagtaggcagtgcgacagggaatacgactgcaaggacatgagcgatgaggtcggctgcgttaatgtaacattgtgtgaaggtcctaacaagtttaaatgccacagtggcgaatgtatcaccctggacaaagtttgtaacatggcgcgcgactgcagagattggtccgacgagcctataaaagagtgcggcaccaatgcctgcctggataataacggaggttgtagccatgtgtgtaatgacctgaagatcggatacgagtgcctgtgtcccgacggttttcagctcgtcgcccagcgccgctgtgaagacatcgatgaatgccaagaccctgatacgtgctcacaactctgtgtgaacttggagggtggttacaaatgccaatgtgaggaaggcttccagttggacccccacactaaagcctgtaaggccgtgggctcaatcgcttacttgttctttactaatagacatgaggtgaggaagatgacactcgaccgcagcgagtacacgtccttgatacccaatctgaggaatgtcgtcgctctcgacactgaagtggcatcaaaccgcatatactggtccgatctgagccaaagaatgatttgcagtacgcaactggaccgcgctcacggagtgtcaagctacgatacagtcattagccgcgatattcaagcacctgacggcctggccgtggactggattcattctaacatttattggaccgacagcgtgctcggcacggtcagtgtggccgatacaaagggtgtgaagagaaagacgcttttcagagagaacggctcaaagccacgcgctatcgttgtggaccccgtgcatggcttcatgtactggaccgactggggcacacccgccaagatcaaaaagggaggactcaatggcgtggacatttactctctggtgactgagaacatccaatggcctaatggcataaccctggatctcctttccggaagactgtattgggttgattctaaactgcactcaatcagcagcatcgacgtcaacggtggtaacaggaagactattctcgaggacgaaaaaagactcgcgcaccccttcagcctcgctgtcttcgaagataaggtattttggaccgatatcatcaacgaggctatcttttccgccaaccgcttgacaggttcagatgtgaacctgctggcagagaacctgctgtcccctgaggacatggtcctgttccacaacctgacccaacctagaggtgtgaattggtgcgaaaggaccacccttagcaatggaggctgtcagtacctgtgcctgcctgcccctcagatcaacccccattcacctaagtttacgtgcgcctgcccagacggtatgctgttggcaagggatatgagatcatgcctgactgaggctgaagcagccgtggccacgcaggagacctccaccgtacgcctgaaggtttctagcaccgcagtgaggacacagcataccactactaggcctgtcccagacaccagtagattgcctggagccacgcccggccttactactgtggagattgtgacaatgtcccatcaagccctgggagacgtggccggcagaggtaatgaaaagaagccttcttccgtgagggccctgagtattgtattgccgatcgttctgttggtgtttctgtgccttggcgtgttcctcttgtggaagaactggagactgaagaacatcaacagtattaacttcgataacccggtctaccagaaaaccaccgaggacgaagtgcacatttgccataaccaggatggatacagctacccctctagacaaatggtctcacttgaagacgatgtagcc

SEQ ID NO: 471 - DNA, 2580 bp, Artificial Sequence
  Description of Artificial Sequence: Synthetic Transcript Sequence
atgggtccttggggatggaaactgcggtggactgtggcactgctgctcgctgcggctgggacggcagtgggggatagatgtgagcgcaatgaatttcagtgccaggacggaaagtgtatctcatacaaatgggtctgtgatggctctgcggaatgccaagacggaagcgacgagtctcaggagacatgtctttctgtcacctgtaagagcggcgacttcagctgtggcggtagagtcaaccgctgtattccacagttttggcgatgtgatggccaggtagattgcgacaacggttctgacgaacaaggttgtccaccaaagacatgttcccaggacgaattcaggtgtcacgacggaaaatgtatttcacggcagttcgtatgtgatagtgatagggattgcctggacggcagtgacgaggctagctgtcctgtgctgacttgtggccccgccagctttcaatgtaattcatccacctgcatcccacagttgtgggcatgcgacaatgatcctgactgtgaggatggatccgatgagtggccacagagatgtcggggactgtacgtgtttcagggcgactccagcccttgttctgcattcgagtttcactgtctgtcaggagagtgcatacatagttcatggaggtgtgatggaggtccagactgcaaagataaatccgacgaggagaattgcgcagtagccacttgccgccccgacgaattccagtgtagtgacgggaactgtattcatggctcaagacagtgtgaccgcgagtatgattgcaaggatatgagtgatgaggtcggctgcgttaatgtcacactctgcgagggacccaacaaatttaagtgtcattccggcgagtgtatcacgctcgataaagtgtgtaatatggcccgagactgccgggattggagtgacgagcctattaaggagtgcggaactaatgcttgtctggacaataatggtggctgtagtcacgtatgtaatgatctgaaaatcggttatgagtgtctgtgccccgacggttttcagctggtggcacagcggaggtgcgaggacatcgacgagtgccaagatcctgatacatgcagccaattgtgcgtcaatctggaaggtggctacaagtgccaatgtgaagaggggttccagcttgacccccataccaaggcctgcaaagccgtgggctctatcgcctatctcttctttacaaatcggcacgaggtgcggaagatgactttggatcggtctgagtacactagcctgattcccaatctccgaaatgtggtagcacttgatactgaagtggcgagtaatcgcatctattggtctgacctgtcccaacgcatgatttgtagcacgcagttggatcgcgcgcacggcgtctcatcctatgataccgtgataagccgagatatccaagctcctgatggtctggcagtagactggatccatagcaacatttattggaccgactcagtcttggggaccgtgtcagtggctgataccaagggagtgaagaggaagactctgttccgagagaacggctcaaaaccaagagccatcgtcgtcgatcctgtgcacgggtttatgtactggacagattgggggaccccagcaaagattaagaagggggggctgaacggggtcgacatctatagcctcgtaacagaaaacatccagtggccaaacggaattaccctggatctcctgtctggtcgactttattgggtagattctaagttgcacagcatcagctcaatcgatgtcaacggcggtaacaggaagactatcctggaagatgagaaacgcctcgcacatcccttcagtcttgcagttttcgaagataaggtgttttggaccgacattataaacgaggccatcttcagtgcgaacagacttactggctcagacgtgaatctcttggccgagaacctgctgtctcctgaggacatggtgctcttccacaacctcactcagccgagaggtgtaaactggtgcgaaaggacaaccctgagcaacgggggctgtcaatatctgtgtctgccagctccccagatcaacccacattcccccaagttcacctgcgcctgccccgacggtatgctcctggctagagatatgaggtcttgcctgacagaggcagaagccgccgttgcaacgcaggagacctccaccgtgcggctgaaagtatcatccaccgccgtaagaactcagcacactactaccagaccggtccccgacacctccaggctgccaggagccacacctgggctgacaaccgtggaaatcgtgacaatgagccatcaagctctgggggacgtcgccgggagagggaacgagaaaaaaccctcctccgtgcgagccctgagcatagtgttgcccattgtgttgctggtgtttttgtgtctgggagtctttttgctctggaagaactggcggctgaagaatatcaatagtatcaacttcgacaaccccgtctaccagaagaccacagaagacgaggttcatatctgtcacaatcaggacggttatagctatccctctagacagatggtgagcttggaggacgatgtggct

SEQ ID NO: 472 - DNA, 2580 bp, Artificial Sequence
  Description of Artificial Sequence: Synthetic Transcript Sequence
atgggaccgtggggctggaaattgcggtggaccgtggccctgctgcttgcggcagcgggaaccgcggtgggcgaccggtgtgagaggaatgaattccaatgccaggatggaaaatgcatctcgtacaagtgggtgtgtgacggatccgccgaatgccaagatggaagcgacgaatcgcaggagacttgtttgtcggtgacttgtaagtcgggcgacttctcgtgcggcgggcgcgtcaaccggtgcatcccccagttttggcggtgcgacgggcaagtggactgtgataacggtagcgacgagcaaggctgcccacccaagacttgctcgcaagacgagtttaggtgccacgatggcaagtgcatctcgagacaattcgtgtgtgatagcgaccgcgactgcctggatggctcagacgaggcttcctgcccagtgcttacttgtggcccagccagcttccaatgcaattcctctacctgcatcccgcaactctgggcgtgcgacaacgacccggactgcgaagatggatccgatgaatggccccagcggtgcaggggtctgtacgtgttccaaggagactcctcgccatgctcggcattcgagttccattgtctttccggcgagtgtatccactcatcgtggcgctgtgacggaggaccggattgtaaggacaagagcgacgaggaaaactgcgccgttgcgacttgtcggccggatgaattccagtgttccgatgggaactgcatccacggctcgaggcaatgcgaccgcgagtacgattgtaaggatatgtcggatgaagtgggatgcgtgaatgtgaccctgtgcgaaggtcctaacaagttcaaatgtcattcaggagaatgtattacccttgataaagtgtgcaacatggctcgtgattgtcgggattggtcggacgaacccatcaaagaatgcggcaccaacgcctgtctcgacaacaacggaggatgttcacatgtgtgcaacgacctgaaaatcggctacgagtgcctgtgcccagacggattccaactggttgcccagcgccgctgcgaggatattgacgaatgtcaggacccggatacttgctcccaactgtgtgtcaatctcgagggcggttacaagtgtcagtgcgaggaaggcttccagctggaccctcataccaaagcctgcaaggctgtcggctccatcgcatacctcttctttactaaccggcacgaggtcagaaagatgacccttgataggtcagagtatacttccctgatcccaaacctcagaaacgtggtggcactggatactgaggtggcgagcaatagaatctattggagcgatctgtcccagcgcatgatctgttcgactcagctcgatcgcgcccacggagtgtcctcttacgacactgtgatttcccgtgatatccaggcgccagatggactcgccgtcgactggatacactccaacatctattggactgactccgtgctgggcactgtgagcgtggccgataccaagggagtgaagcgtaagaccctgttccgggaaaatggctccaagccacgggctatcgtggtcgacccggtgcacggattcatgtactggaccgactggggaacgccggcgaagatcaagaaaggagggcttaacggagtggacatctactcgcttgtcaccgagaacatccagtggccaaatggtattacgctggatctgctgtcaggacgcctgtactgggtagattcgaagctgcattcgatttcatccatcgacgtgaacgggggcaaccgcaagaccatcctggaggatgagaaaagactcgcacaccccttctcactggcagtgtttgaggataaggtgttctggaccgacatcatcaacgaagccatcttttctgcgaacaggttgactggtagcgatgtgaacctgctggccgaaaatctgctttcacccgaggacatggtgctgttccacaatctgactcaaccgaggggagtcaattggtgcgaacggacgaccttgagcaacggaggttgtcaatacctctgccttccggcaccgcagattaatcctcactcgccgaagttcacctgcgcttgtccggatggaatgctgcttgcaagggacatgcggagctgtctgaccgaggccgaagcagccgtggcgacgcaggaaacttcgactgtgcggctgaaggtgtcaagtaccgctgtgcgcactcaacataccacgacccgcccggttcctgacactagccggctccccggagctactccaggactcaccacggtggaaatcgtgaccatgtcccaccaggctctgggcgatgtggccggacgcggcaacgaaaagaaaccttcatcagtgagagccctgtccatcgtgcttccgatcgtcctcctcgtgttcctttgcctgggagtctttctcctctggaagaactggagactgaagaatatcaattcaattaactttgacaacccggtgtaccagaaaaccaccgaggacgaagtgcatatctgccacaaccaggatggctactcgtacccatcccgccaaatggtgtcactggaggacgatgtggcc

SEQ ID NO: 473 - DNA, 2580 bp, Artificial Sequence
  Description of Artificial Sequence: Synthetic Transcript Sequence
atggggccgtggggctggaaacttagatggacagttgctctcttgcttgctgccgcgggtacggctgtgggggataggtgtgaaaggaacgaattccaatgtcaggacggaaagtgcatcagttataagtgggtctgcgacggttcagctgaatgccaggacggaagtgacgaaagccaggaaacctgcctttccgttacttgcaagagcggagacttcagctgcggaggcagggtgaaccgctgcatcccacagttttggcgatgtgacggccaagtggactgcgacaacggcagcgacgagcagggctgccctcctaaaacttgttctcaggatgaatttagatgccacgatggcaagtgcatcagcagacagtttgtatgcgactccgatagagattgccttgatggctcagacgaagcaagttgcccggtgttgacctgtggtcctgccagcttccaatgcaactctagcacatgcatcccacagctgtgggcatgcgacaacgatcccgattgtgaggatggcagtgacgagtggccccagaggtgtaggggactatacgtgtttcagggagacagctctccatgtagcgctttcgaattccattgtttgtctggtgagtgtatccatagctcgtggagatgcgatggtggaccggattgcaaagataaaagcgatgaggagaactgtgctgttgccacatgcagaccagatgagtttcagtgctctgacggtaactgtatccacggttcaaggcagtgtgatcgcgagtatgattgtaaagatatgtctgatgaagtgggatgtgtcaacgttaccctgtgtgagggccccaataagtttaaatgccattcaggcgagtgtatcaccctggataaagtttgtaatatggcacgtgattgtagggactggtccgatgaacccattaaggagtgtggcaccaacgcatgcttggacaacaacggaggctgctctcacgtatgtaacgaccttaagatcggttatgaatgtctgtgccccgacggcttccagcttgtcgctcagaggaggtgtgaggacatcgatgagtgccaggatccagatacatgcagccagctgtgcgttaacttggagggagggtacaaatgtcagtgtgaggaaggatttcaactcgaccctcacacaaaggcttgcaaagctgtcggaagcatcgcctacctgttcttcactaataggcacgaagtcaggaaaatgacattggatagaagtgagtacaccagtctgatcccaaatctgaggaacgttgtggcactggacacagaggtcgcaagtaacagaatttactggagtgatctgagccaaaggatgatatgctctacccagctggatagggcccatggggtgtcatcatacgacacggttatatcccgcgacattcaagccccggatgggcttgcggtagactggatccactctaacatctactggactgatagcgttctgggcacagtaagcgtggccgatacaaagggagtgaagaggaagaccctgtttagagagaatggaagcaagcctcgggcgatcgtagtggacccggtgcatgggttcatgtactggaccgactggggcacaccagcgaagataaagaagggcggacttaacggcgtggacatttacagtctggtgaccgagaatattcaatggcccaacggcataacgctcgatctcctgagcggaaggttgtattgggtggacagtaagctgcattctatatccagcattgatgttaacggcggaaatcgcaagaccattctggaagacgagaaaaggctcgctcatccttttagcctcgctgtgtttgaagacaaggtgttttggacagacatcatcaacgaggcgatctttagcgcgaaccgactcaccggatccgacgtgaacctcttggccgagaatttgttgtctcctgaggatatggtcctgttccataacttgacccaaccacggggcgtcaattggtgtgagcgcacaaccctgagcaacgggggctgccagtatctgtgtcttcctgctcctcaaattaatccacactcacccaagttcacgtgtgcctgccccgatggcatgctcttggcaagggatatgaggagctgccttacagaggcagaagccgcagtagccacacaagagacaagcaccgtcaggctgaaggtgtcatcgaccgcggtgagaacccagcatactactactaggcctgtcccagacacaagcaggctccccggggctaccccggggttaacaacagtggagatcgtcaccatgtcacaccaagctttgggcgacgtggcgggaaggggcaacgaaaagaagccaagctccgttcgtgcactgagcatcgtgcttcctatcgtgctgttggtttttctttgcctgggcgttttcctgctgtggaagaactggagactgaagaacattaacagcatcaacttcgacaaccccgtgtatcaaaaaacaaccgaagatgaagtgcatatctgtcacaaccaggacggttactcataccccagcaggcaaatggtttccctggaggacgacgttgcc

SEQ ID NO: 474 - DNA, 2580 bp, Artificial Sequence
  Description of Artificial Sequence: Synthetic Transcript Sequence
atgggcccgtgggggtggaagctccggtggactgtggcactcttgcttgccgccgcaggaacggccgtgggagatcggtgtgaacgcaacgagttccaatgccaggatggaaagtgcatatcctacaaatgggtctgcgatggtagcgccgagtgccaagatggctcagatgagtcccaggaaacctgcctctcggtgacgtgcaagtcgggtgacttctcgtgcggcgggcgggttaacaggtgtattccgcagttttggcgctgtgacggccaggtggattgcgacaacggatcggacgaacagggttgcccaccaaagacctgttcccaggatgagttcagatgtcatgacggcaagtgcatttcccggcaatttgtctgcgactcggatcgtgactgcctggacggctcggatgaagccagctgtccggtactgacctgcggccctgcctcgttccagtgcaactcatccacctgtatcccccagctgtgggcctgcgataacgacccggactgcgaggacggatcagacgaatggcctcaacgctgcagaggactgtacgtgttccagggagattcctctccttgctccgcctttgaattccactgcctgtcgggggaatgcatccatagctcatggagatgcgacggcggcccggactgcaaagacaagtcagatgaagagaactgtgctgtggctacttgtaggccagacgaattccagtgttcggacggaaattgtatccacggctcccgacagtgcgatcgtgaatacgattgtaaggacatgtccgacgaggtgggttgtgtgaacgtgactctctgcgagggaccgaataagtttaagtgccatagcggagaatgcataaccctggacaaagtctgtaacatggcgcgcgactgtcgggattggtcagatgagccgatcaaggagtgcggcaccaacgcgtgcctggataacaacggaggctgtagccacgtgtgcaacgaccttaagatcgggtacgagtgcttgtgcccggatggattccaactggtggcgcaacgccgctgtgaagatattgatgagtgccaggatcctgatacttgctcgcagctgtgcgtgaatctcgaagggggctacaagtgtcaatgcgaggagggattccaactcgacccgcacactaaagcctgcaaagccgtgggatcgatcgcttacctgtttttcacgaacagacatgaggtccggaagatgactctggaccggtcggagtacacttccttgatcccgaacctgcgcaacgtggtcgcgctggacactgaagtggcgtccaacaggatctactggagcgatttgtcgcagcgcatgatctgttcaactcagctggacagagctcacggagtgtcctcgtacgatactgtgatctcgagagatattcaggccccagatggcctggccgtcgactggattcattccaatatctactggactgatagcgtgctgggaaccgtgtcggtggccgacactaagggagtgaagcgcaagactttgttcagagaaaatggatccaagccgagagcaatcgtcgtggatcccgtccatggatttatgtactggaccgactggggcactcccgcgaagatcaagaaaggaggcctcaatggtgttgacatctactcgctggtgaccgagaatatccagtggccgaatggaataaccctggatctgctgtcaggtcgtctgtactgggtggattcgaaactgcactccatttcgagcatcgacgtgaatggaggtaaccggaaaactatcctggaggacgaaaagcgtctcgctcatcctttctccctcgccgtgttcgaggataaagtgttctggaccgacatcatcaacgaggcgatcttctcagccaacagactgacgggctccgacgtcaacctgctggcagaaaacctcctctcgccggaggacatggtgctcttccacaatctgacgcaaccacggggagtgaattggtgcgaaagaacgaccctctcaaacgggggatgccagtacctctgcctcccggcacctcagatcaacccacactcgccgaagttcacttgcgcttgtccggatggaatgctcctcgcccgggacatgagaagctgtttgaccgaggctgaggctgcagttgcgacccaggaaaccagcactgtgcgcctgaaggtgtcatcaactgcagtccggactcagcacaccaccacgcgcccggtgcctgacactagccgcctgccaggggctactcctggactgaccacggtcgagatcgtcactatgtcgcatcaggccttgggagacgtggcgggaagaggaaacgagaagaaaccctcgtcagtcagagcgcttagcatcgtgctcccgatcgtgctgctggtgttcctgtgccttggcgtctttctgctctggaagaattggcggctgaaaaacatcaacagcatcaattttgacaatcccgtctatcaaaagactaccgaggatgaagtgcacatttgccacaatcaggatggatactcctatccatcacgacagatggtatcactggaagatgacgtggcc

SEQ ID NO: 475 - DNA, 2580 bp, Artificial Sequence
  Description of Artificial Sequence: Synthetic Transcript Sequence
atgggaccatggggatggaaactccgctggacggtggctctgctgctcgctgcggccggtacggccgtgggggaccggtgcgaaaggaacgaattccaatgccaggacggaaagtgcattagctacaagtgggtgtgcgacgggtcggccgagtgccaagacggatctgatgaatcacaggaaacctgtttgtcagtgacctgcaagtccggggatttcagctgcggagggcgagtgaacagatgtatcccgcagttctggagatgcgatggacaggtggactgcgacaatggatccgacgagcaaggctgcccacctaagacgtgttcacaagatgaatttaggtgccacgatggtaagtgcatcagccgccagtttgtttgcgactcggatcgagactgcctggatggatcagacgaagctagctgccctgtgctgacttgcggaccggccagcttccagtgcaactcgtccacctgcatcccgcagctgtgggcatgtgataatgacccagactgcgaggacggatccgatgagtggccacaacggtgccggggcctgtacgttttccagggcgactcgagtccgtgctcggccttcgaattccactgcctctctggagagtgcatccattcatcctggcgctgcgacggcggaccggattgcaaagacaagtccgatgaagaaaactgcgcggtcgcgacttgccgccccgatgaattccagtgctcagacggcaattgcatccatggatcgagacagtgcgaccgtgagtacgattgcaaggatatgtcagacgaagtggggtgcgtgaacgttactctgtgtgagggaccgaacaagttcaagtgccattccggagaatgtattactctcgacaaggtgtgcaatatggcccgcgattgcagagattggtcagacgaacctattaaggaatgcggaaccaacgcttgcctggataacaacggaggctgctcgcacgtttgcaacgacctgaagatcggatatgaatgtctgtgccctgatggcttccagctcgtggcacagcgccgctgcgaggacatcgacgagtgccaggatcccgacacctgttcgcaactgtgcgtgaatcttgaggggggatacaagtgccaatgcgaggagggattccagctggacccacacactaaggcttgcaaggctgtgggatcaatcgcttacctcttctttaccaaccgccatgaagtccgaaagatgaccctggatcggtctgaatacacctcgctcattccgaatctgcgcaatgtggtggccctggatactgaggtggcctcgaatcgcatctactggagcgacctctcgcagaggatgatctgcagcactcaactggatagagcccatggagtttcctcctacgatactgtcatctcacgggacatccaagcgcctgacggccttgcggtggactggatccactccaacatctactggactgattccgtgctcggtaccgtgtccgtggccgacaccaagggtgtgaagcgcaagactttgtttcgcgagaatggaagcaagccaagagccattgtagtcgatcctgtccatggattcatgtactggactgactgggggaccccggcaaaaatcaagaagggcggactcaacggcgtcgacatctactcgctcgtgactgaaaacatccaatggcccaacggaatcaccctggacctcctcagcggccgactttactgggtggactcaaagctccactcaatttcgagcatcgatgtgaacggtggaaaccgcaaaaccatcttggaagatgaaaagagacttgcccacccattcagcctggccgtgttcgaagataaggtgttctggaccgatatcatcaacgaagcaatcttctccgccaatcgcctgacgggatctgacgtcaatctgttggccgagaatttgctgtcgccggaggacatggtgttgtttcataatctgactcaaccaagaggggtgaactggtgcgaaagaaccactttgtcaaacggcggatgccagtacttgtgcctgcctgcgcctcaaatcaacccgcactcccctaagttcacctgcgcgtgtccagatggcatgctgctggcccgggacatgcggtcctgcctgacggaagcggaggctgccgtggccacccaagagactagcactgtgaggctgaaagtgagctccactgccgtgagaacgcaacacacgactactcggccggtccctgacacttcgagactgccgggagcaaccccaggcctgaccactgtggaaatcgtgaccatgtcccaccaggctctcggagacgtcgcaggacggggcaacgagaagaaaccgtcgagcgtgcgcgcactcagcatcgtcttgccaattgttctgctggtgttcctttgccttggagtgttcctgctctggaagaactggcgcctgaagaacatcaattcgattaacttcgacaatccagtctatcagaaaaccaccgaggacgaagtccatatctgtcataatcaagacggttactcgtatccgtcccggcagatggtgtcactggaggacgatgtggct

SEQ ID NO: 476 - DNA, 2580 bp, Artificial Sequence
  Description of Artificial Sequence: Synthetic Transcript Sequence
atgggcccttggggatggaagctgaggtggactgtggccttgctactggcggcagccggcacggctgtcggcgatagatgtgagaggaacgagttccagtgccaggatggtaaatgcatctcttacaaatgggtttgtgacggcagtgcagagtgtcaagacgggtctgatgagagtcaggagacgtgcctgtcggtgacatgtaagtccggagattttagctgtgggggccgcgtcaatcgctgtataccacagttctggagatgcgacgggcaagttgattgcgataacgggagcgacgagcagggctgtcccccaaagacttgtagccaggacgaatttagatgtcatgacggaaaatgtatctccagacaatttgtctgcgattcagaccgcgattgtcttgatggatcagatgaagctagctgccccgtgctgacttgcgggcccgcttctttccagtgcaattctagcacctgtatccctcagctgtgggcttgtgacaacgaccctgattgcgaggacggctccgatgagtggccgcagcggtgcaggggactgtacgtgttccagggagactcaagtccctgttctgctttcgaatttcactgcttgtccggggagtgcatccatagcagttggagatgtgatggcggacccgattgcaaggacaaatccgacgaggaaaattgcgctgtcgccacctgtagaccagatgagttccaatgctccgatgggaattgcatccatggttctaggcagtgtgatcgggaatatgattgcaaagatatgagcgatgaagttggatgcgtcaacgtgaccctctgtgaagggccaaacaaatttaagtgccattctggcgaatgcataactctcgataaagtatgcaatatggcaagagactgtagagattggtccgatgagccaatcaaggaatgtggaacgaacgcgtgccttgataataatggggggtgttctcacgtgtgtaacgacctcaagatcggatacgagtgtctctgtcctgacggttttcagttggtcgctcagcgccggtgcgaggatatcgacgagtgccaggatccggatacgtgtagtcaactttgcgttaatttagagggtggttacaagtgtcagtgcgaggaaggtttccagctcgatcctcatacaaaggcgtgtaaggcagttggatcaattgcatatctgttcttcaccaatcgtcacgaggtgcggaaaatgacactggaccgctcagaatacacatcccttattcccaacctgcggaacgtcgtggcactggacactgaagtagcgtctaatcgcatctattggagtgacttgtcacaacgaatgatctgcagtacccagctggatcgcgctcacggggtgtcttcctacgataccgtcatctcccgtgatattcaggcacctgacggcctggctgtcgactggatccactccaatatatactggaccgacagcgtgctgggcaccgtgtctgtagcggatacaaagggtgtcaaacgcaagacactgttcagggagaatggcagcaaacctagggctattgtggtggatccagtccacgggtttatgtattggactgactggggtacccctgcgaaaatcaagaagggcggactcaacggagtggatatatatagtctggtgactgagaatattcagtggcctaatgggatcaccctggacctgctgagcggtaggttgtactgggtagacagcaaacttcactccatctcatcaatcgacgtcaatggcggcaaccgaaagactatcctggaggacgagaagcggcttgcccatcccttctctcttgccgtgttcgaggacaaggtgttctggaccgacatcatcaacgaggcaatcttcagtgcaaacagattaacaggctccgacgtgaacttactcgccgagaacctgctctcgccggaggatatggtattgtttcataatctgactcagccgaggggcgtcaattggtgcgagcggactacactgtctaatggtggatgccagtatctgtgtttgcccgcccctcagataaatccccattcgcctaagtttacgtgtgcatgcccagacgggatgctattggcacgcgatatgcggtcgtgtctcaccgaggcggaagccgccgtggccacccaggaaactagcaccgtacggctgaaagtttcttctactgctgtaagaacacaacacaccaccacgagacctgttccagacacaagcaggctgccgggggcgactccaggcctgacaaccgttgagatcgtgactatgtcccatcaggcactcggcgatgtggctggaaggggcaatgagaagaaaccctcaagcgtaagagcactcagcattgtgcttccgatcgttttactggtgttcctatgcctgggggtttttttgctgtggaaaaattggcggctgaaaaatattaactccatcaacttcgataatcctgtataccagaagaccaccgaagatgaagtacatatctgccacaaccaagatggatatagctacccatctcgacaaatggtgagcctggaagatgatgtagct

SEQ ID NO: 477 - DNA, 2580 bp, Artificial Sequence
  Description of Artificial Sequence: Synthetic Transcript Sequence
atgggaccctggggctggaaacttagatggaccgtggcccttcttttggccgccgctggtaccgctgtcggagaccgctgcgaacgtaacgaattccagtgccaagacggtaagtgtatctcttataagtgggtgtgtgacgggtccgcagagtgtcaagacggtagcgatgagtctcaggaaacatgtctgtcggtcacgtgcaagtccggcgatttctcctgcggaggtcgtgtgaaccgctgcattccccagttctggcgctgtgacggtcaggtcgactgcgataacggaagtgatgagcagggttgtcctcccaagacatgctcccaggacgagttccggtgccatgatggtaagtgcatttcccgccagttcgtttgcgattcagaccgcgactgtctcgacggcagcgatgaggcctcgtgccccgtcctgacctgcggtccggcctcgtttcagtgcaactcttccacgtgcatccctcaactctgggcttgtgacaacgaccctgattgcgaggatggcagcgacgaatggccccaacgctgtcgtggactctacgtcttccagggtgacagttccccctgtagcgcgttcgaattccattgtctgtcaggcgaatgcattcatagtagttggcgctgcgacggaggacccgactgcaaggataagtccgacgaggagaactgcgcggtggccacgtgtaggccggatgagttccaatgcagtgacggaaattgtatccatgggtctagacagtgtgatagagagtacgactgcaaggacatgtctgacgaggttggctgcgtgaacgtcactctctgcgagggccccaacaagttcaagtgccacagtggcgagtgcatcacccttgataaggtgtgcaatatggcccgagattgccgtgactggtctgatgagcccatcaaggaatgcggaacgaacgcatgtttggacaacaacgggggctgttcgcacgtttgtaacgatctcaagatcggctatgagtgcctgtgtccggatggtttccagctggttgcgcagcgccggtgtgaagatatcgacgaatgccaggatcccgatacttgctcccagctttgcgtgaaccttgagggcggttataagtgtcagtgtgaggagggtttccagctcgatccccataccaaagcgtgcaaggctgtgggttcaattgcctacctgtttttcaccaatcgtcacgaggtccgcaagatgaccctcgaccgctccgagtatacctcgttgatccccaacttgcgcaacgtggtggcgcttgacaccgaggtcgcttctaaccgtatttactggagtgatctgagccagagaatgatctgctccacacagctggaccgtgctcacggtgtctcttcctacgacaccgttatctcgcgggacatccaggcacccgacggactagcggtcgactggatccattcaaatatctactggactgactcggtcctggggactgtgagcgtcgcggacaccaagggcgtgaaacgcaaaaccctgtttcgggagaacggttccaaaccgcgcgccatcgtggtcgaccccgtccacggattcatgtactggaccgattggggcacgcccgccaagatcaagaagggtgggctgaacggcgtggatatctactcactggtcacggagaacatccagtggcccaacggcatcacactcgacttgctcagcggcaggttgtactgggtcgattccaagctccattctatctccagcattgacgtcaacggcggcaatcggaagaccattctggaagacgagaagcgactcgcccacccttttagcctagcagtctttgaggacaaagttttctggaccgatattatcaatgaggccattttctccgccaatcgcctcacaggatccgacgttaacctgttagctgaaaacctgctgagtcccgaagatatggtccttttccacaacctcacgcaacctcgcggtgttaattggtgcgagcggaccactctgtcgaatggtgggtgccaatacctgtgtctccccgccccacaaatcaatccccactctcccaagttcacgtgcgcttgccccgatggaatgctgctcgcgcgcgatatgcgctcctgtctgacggaggcggaggcggcggttgccacccaggagacttcaactgttagactgaaggtttcgtcaacggctgtccgcacacaacacacaacaacgagacccgtgcctgacacgtcacgtctcccgggtgccacccctggactcactactgtcgagattgtcacgatgtcgcaccaggctcttggcgatgtggccggacgtggcaatgagaagaagccgagcagcgttcgagccctgtctatcgttctgcccatcgtactcctggtgttcctatgcctgggagtctttttgttgtggaaaaattggcgactcaagaacataaactccattaacttcgacaatcccgtctaccaaaagaccacagaagacgaagttcacatctgccacaatcaggacggctacagctacccgtcgcgccagatggtctctctcgaggatgatgtggcc

SEQ ID NO: 478 - DNA, 2580 bp, Artificial Sequence
  Description of Artificial Sequence: Synthetic Transcript Sequence
atgggtccttggggatggaagctccggtggaccgtcgcactcctgctcgcagccgccggtactgcagtaggggatcgctgcgaaagaaatgaattccaatgccaagatggtaagtgcattagctacaaatgggtctgtgatggatcggccgagtgccaagacgggtcagatgagtcccaggagacgtgcctgtcagtgacctgtaagtcgggtgatttttcctgtggggggcgggtgaatcgatgtattccacaattttggcggtgcgacgggcaggtggactgtgacaatggtagcgatgaacaggggtgtccacctaagacctgcagccaggacgaatttagatgtcacgacggaaaatgcatttcaagacaattcgtgtgtgattcggatcgggattgtctggatggctcggacgaggcttcctgccctgtgctcacctgtggtccagcctcctttcaatgtaattcgagcacttgtataccacaactgtgggcctgtgacaacgaccctgattgtgaggacggatcggatgagtggccacagcggtgtcggggtttgtacgtattccaaggagattcaagcccttgttccgcatttgagttccactgtctgtcgggggaatgcatccactcgagctggcgatgtgacggtggcccggactgtaaggacaagtctgacgaggaaaactgtgcagtcgccacctgtagaccggatgagtttcaatgctcggacggaaactgcatacacggatccaggcaatgtgacagagagtacgattgcaaggacatgtcggacgaagtggggtgcgttaatgtcaccctgtgcgaaggccctaacaaattcaagtgccattccggagaatgcatcacccttgataaggtgtgtaacatggcgagagattgtcgtgactggtcggatgagcctataaaggagtgtggaaccaacgcatgcctggataacaacgggggttgctcacatgtctgcaacgatctgaaaataggatacgagtgtctctgtccagatggattccagcttgtggcccaaaggcgatgtgaagatatcgatgaatgtcaagatccagatacttgttcccagttgtgcgtcaatctcgagggaggctataagtgtcaatgtgaagaaggatttcaactcgatcctcataccaaggcgtgtaaggccgtgggttccatcgcatacttgtttttcaccaatagacacgaagtccgtaagatgactcttgaccgctcagaatacacttccctgatccctaatcttcgtaatgtggtcgcgctcgatactgaagtcgcatccaacagaatctactggagcgacctttcccagcgtatgatttgtagtacccaattggatcgggcgcatggagtgtcctcctacgatactgtgatcagccgtgatattcaagcgccagatggtcttgccgtggactggattcactccaacatttactggactgactccgtgctcggcaccgtgtccgtggctgatactaaaggggtcaagagaaaaactctgttcagggaaaatggttccaaaccaagagccattgtggtcgaccccgtgcacggttttatgtactggaccgactggggaactccagcgaagatcaaaaagggtggactgaacggcgtcgacatttactcacttgtcaccgaaaacatccagtggccaaatgggataacgctggatctgctttcgggacggctttattgggtggatagcaagctgcattccatctcctcaatcgacgtgaatgggggcaacagaaagactatactcgaggacgagaaacggctcgcgcatccttttagcctggcggtttttgaggataaggtcttttggaccgacatcatcaacgaggcaatcttttcggcaaacagattgaccggcagcgatgtcaacctccttgctgaaaacttgctgtcacctgaggacatggtcctcttccataaccttactcagcctcgaggtgtgaactggtgtgaacgcaccactctgagcaatggtggttgccagtacctgtgcctccctgccccgcagatcaacccacattcgcctaagtttacctgtgcgtgcccggatggtatgcttctggctagagatatgcgctcatgtctgaccgaggcagaggcagccgtggcgactcaggaaacctcaacggtgcgtctcaaggtgtcgtctaccgcagtccgtacccagcatactacgactcgacctgtgccagacacttcccggcttcccggcgcaaccccaggacttacgaccgtcgaaattgtgaccatgagccaccaggcactcggtgatgtggcaggacggggaaatgaaaagaagccatcctccgtgcgtgcactcagcattgtgctgcccatagtccttcttgttttcctttgtcttggagtgtttctcctttggaaaaactggcgcctcaagaatatcaactcaataaacttcgataacccagtgtaccaaaagaccaccgaagatgaagtccatatctgtcataaccaagatggctactcgtacccttccagacaaatggtgtcactcgaagatgatgtggct

SEQ ID NO: 479 - DNA, 2580 bp, Artificial Sequence
  Description of Artificial Sequence: Synthetic Transcript Sequence
atgggcccctggggctggaagctgaggtggacagtggctctcctcctggccgccgccgggactgcagtaggcgaccgctgtgaaagaaatgagtttcagtgtcaggacggcaagtgcatatcttataaatgggtttgtgatggaagtgccgagtgtcaggacgggagtgatgaaagccaggagacttgcctgtctgtgacctgtaagtccggggatttctcttgcggcggccgggtgaatcgctgcatacctcaattctggcgctgcgacggccaagtggactgtgacaacgggagcgatgagcagggctgccctcccaaaacatgctcccaggacgagtttagatgtcatgacgggaaatgcatctccaggcagtttgtgtgcgactccgatcgcgactgcctggacgggtctgacgaagccagttgccccgtcctgacttgtggcccggctagtttccagtgcaactctagcacctgcattccacagctatgggcctgtgacaatgaccctgactgcgaggatggcagcgacgagtggcctcagcgctgccgcggattatacgtgtttcagggcgatagttctccttgcagtgcctttgaatttcactgcctctctggtgagtgtatacacagctcttggaggtgcgatggcggacccgactgcaaggacaaaagtgatgaagagaactgcgcagtggcaacatgcagacccgacgagttccagtgctccgatggcaactgcatccatgggtctcgccagtgcgatagagagtacgactgtaaggacatgtctgatgaagtcggctgcgtcaatgtcaccctgtgcgaggggcctaacaaatttaaatgtcatagcggagagtgtattacattggacaaagtttgcaacatggctcgggactgcagagattggtccgacgagcctataaaggagtgtggcaccaatgcctgtctagacaacaacggaggctgctcccatgtgtgtaacgatctgaagatcggatacgaatgcctatgcccagatgggtttcaactggtggcacagcggagatgtgaagacatagacgagtgccaggacccagacacttgtagccagctgtgcgtcaacctggagggcggttataaatgtcaatgcgaggaaggatttcagttagatcctcacaccaaggcatgtaaagcagtgggctctatcgcctacctttttttcaccaataggcatgaagtacggaagatgaccctggaccgcagcgagtatactagtctcatacctaacctgcgcaatgtggtggctctggacaccgaagtggctagcaatagaatttattggagtgacctgtcacagaggatgatttgctctactcagctggaccgtgcccacggagtgagtagttacgacacagtcatcagtcgggacatccaggcccctgacggtttggccgttgattggattcatagcaacatttattggaccgacagtgtcctgggaaccgtctctgttgccgataccaaaggtgtgaagcggaagactctgtttagagagaatggcagcaaaccacgcgccatagtggtcgaccccgttcatggttttatgtactggactgactggggtactcctgccaaaattaaaaagggggggctgaatggggtcgacatatatagcctggttactgagaacattcaatggccaaacggcatcacacttgatctcctctctggaaggctatattgggtggacagcaagttacactccataagcagcattgatgtcaacggcggcaaccggaaaaccatcctggaagacgagaagcggcttgctcacccttttagtttagccgtgtttgaggataaagtgttttggactgacatcataaatgaggctatcttcagcgccaaccgcctcactggcagcgacgttaatctgttagctgagaacctccttagtccagaagacatggtgctctttcacaatcttactcaaccaaggggggtcaactggtgcgagcggaccaccctgtcaaacggcggctgccagtacctgtgcctgcctgcacctcagattaacccacactctccaaagttcacctgcgcatgtcctgacggtatgctactggccagggatatgagatcctgtctcacagaggccgaggccgctgtggcaacacaagaaacttccaccgtccgcctcaaagtgtctagtactgcagttagaacccagcataccacaacccggcctgttccagacaccagcagactaccaggcgcaacacccggcctgacaactgtcgaaatagttaccatgagccaccaggctctcggcgatgttgctgggagaggaaatgaaaagaaaccctcctccgttcgtgctctgtctatcgtgctcccaattgtgctgctcgtgttcctgtgcctgggtgtgtttctgttgtggaagaactggagactgaaaaatataaatagcatcaatttcgataaccctgtctatcaaaaaactacagaggacgaagtccacatctgtcacaaccaggacggttatagctatccctccagacagatggtctccctcgaagatgacgtggcc

SEQ ID NO: 480 - DNA, 2580 bp, Artificial Sequence
  Description of Artificial Sequence: Synthetic Transcript Sequence
atgggaccttggggatggaagctgcggtggactgtggctctgctgctggctgcggccggaactgctgtgggagatagatgtgagcgcaacgaattccagtgtcaggatgggaagtgcatttcctacaaatgggtttgcgacggctcagcggaatgccaagacggaagcgacgaaagccaggaaacgtgcttgagcgtgacctgcaaatccggagacttcagttgtgggggaagggtgaaccgctgcatcccgcagttctggcgttgcgacggccaagttgactgtgataatggatcagatgagcaaggatgtccgccgaaaacgtgctcacaagatgaatttcgatgccacgacggcaagtgtatttcccgccagttcgtgtgcgattccgatagagactgccttgacggatcggacgaggcttcatgcccggtcttgacttgcggtccagcatcattccagtgcaattcatccacctgcatccctcaactctgggcctgcgataatgacccggactgtgaggatggctcggacgagtggccgcaaagatgcaggggactgtacgtgttccaaggcgactcatccccgtgcagcgccttcgaatttcattgcctgtcgggcgaatgcatccattcctcttggcgctgcgacggcggacctgactgcaaggacaagtctgacgaggagaactgcgcagtggcgacctgccgacccgatgaatttcaatgctccgacggaaactgcatccacggttcgcgccagtgcgaccgcgagtacgactgtaaggatatgtcggatgaggtgggatgcgtcaacgtcaccctctgcgaaggccccaacaagtttaagtgccactccggagaatgcattactctcgacaaagtttgcaatatggctcgcgactgtcgcgattggtctgacgagccgattaaagagtgcggaactaacgcctgcctggacaataacgggggatgcagccacgtctgcaatgacctcaagatcggatacgagtgcctgtgcccggacggatttcaactcgtggcgcagcgtagatgcgaggatatcgatgaatgtcaggacccagatacttgctcccagctgtgcgtgaaccttgaagggggatacaaatgtcagtgcgaggaagggttccaactggacccgcacaccaaggcttgcaaggcggtcggatcaatcgcctatctgttctttactaaccgccacgaagtgcggaagatgaccctggaccggtccgaatacactagcctgatccccaacttgcggaacgtcgtggctcttgacaccgaagtggcctctaaccgcatctattggtccgatctgtcccaacgcatgatttgctcgacccagctggaccgcgcccacggggtgtcgtcgtacgacaccgtcatctcgcgggacatccaggccccggacggcctcgcggtggattggatacattccaacatctactggactgattccgtcctgggaacggtgtccgtcgcagataccaaaggagtcaagagaaagaccctctttcgagagaacggctcaaagccccgggccatcgtggttgacccggtgcatggatttatgtactggactgactggggcaccccggccaaaatcaaaaagggtggcctgaacggagtggacatctacagcctggtgaccgaaaacatacaatggccgaatggtatcactctcgatctgttgtcaggccggctgtattgggtggactcgaagctgcactcgatttcgtccatcgatgtcaatggcggtaatcggaaaactatcctggaggatgagaagagactggcccatccattctcccttgcggtgttcgaggacaaggtgttttggaccgacatcattaacgaggccatcttttcggccaatagactgactggctcggacgtgaacctcttggcggaaaatctgctttctccggaggacatggtcctgtttcacaatctcacccagcctaggggagtgaactggtgtgagagaaccactctgagcaacggaggatgccagtacctctgcctgccggctcctcaaatcaaccctcatagcccgaagttcacttgcgcatgcccagacggaatgctgctggctagggacatgcgtagctgtctgactgaagcggaagcggcggttgccacccaggagacttcaaccgtcagactgaaagtgagctcaaccgccgtgagaacccagcatacgactactcggcctgtgccggataccagcaggcttccgggagccaccccggggctgaccaccgtggagatcgtcacgatgtcacaccaagccctgggagatgtcgccggccggggcaacgagaaaaagccgagctccgtgcgcgcgctgtcgattgtgctcccgatcgtgttgctcgtctttctgtgcttgggcgtgttcctcttgtggaagaactggcggctcaagaatatcaactcgatcaacttcgataacccagtgtaccaaaagactaccgaggacgaggtgcatatctgtcataatcaggacggatacagctatccgtcgcgccagatggtgtccctggaggacgatgtcgct

SEQ ID NO: 481 - DNA, 2580 bp, Artificial Sequence
  Description of Artificial Sequence: Synthetic Transcript Sequence
atggggccttggggctggaaacttcgttggaccgtggcacttctgcttgccgcagcaggcaccgccgtcggtgataggtgtgagcgcaacgaattccagtgtcaggatggaaagtgtatttcgtacaaatgggtctgcgatgggagcgcagaatgtcaagatggctcggatgaatcccaggaaacttgcctttccgtcacgtgtaaatcgggtgatttctcatgtggagggcgagtgaacagatgtattccacaattttggagatgtgacggacaagtggattgcgacaacggttcagatgaacagggctgtccccccaagacttgttcacaagatgaatttaggtgccatgatggtaagtgtatctcaaggcaatttgtgtgtgatagcgacagagattgtctggatggttcagatgaggctagctgcccagtcctgacttgtgggccggcatccttccagtgcaatagctcgacttgtatcccacagctttgggcatgtgataacgatccagattgtgaagatggatcggatgaatggccacagcgctgtaggggactttacgtgtttcagggagactcatcaccctgtagcgccttcgagtttcattgtttgtcgggagaatgcattcacagcagctggcggtgtgatggaggtcccgattgtaaggataaatcggacgaggagaactgcgccgtcgcaacttgtaggcctgatgaattccagtgcagcgatggaaactgcattcatggatcccgccaatgcgatcgcgagtacgattgtaaagatatgtccgatgaagtgggctgtgtgaacgtgaccctgtgtgagggtccaaacaaattcaagtgccattcgggcgagtgcatcaccctcgataaggtgtgtaacatggcgcgcgactgccgcgactggtcggatgagccaattaaggagtgtggtactaatgcctgtttggacaacaacggaggttgcagccatgtgtgtaatgatttgaagatcggctacgagtgtctctgtcctgatggctttcaactggtggcacagaggagatgcgaagatattgacgagtgccaggatcccgacacgtgctcgcagctgtgtgtgaatctggaaggagggtacaagtgtcaatgtgaggagggatttcaacttgatcctcacacgaaggcctgcaaggcggtgggatcaattgcatatctgtttttcactaatcgacacgaggtccgtaaaatgacccttgaccggagcgagtacacttccctgatccctaatcttagaaatgtcgtggcactcgataccgaagtcgcatctaatcggatttactggtccgatctctctcaaagaatgatctgctcaacccagctggatagggcacatggtgtttcatcgtacgataccgtgattagccgggatattcaagcacctgacggccttgcagtcgattggatccactcaaacatttactggactgactccgtgctcggaaccgtgtccgtcgcagatactaagggtgtcaaaaggaaaaccctctttcgtgaaaacggctctaagccaagagcaattgtcgtggacccagtgcatgggttcatgtactggaccgactggggaactcctgccaaaatcaagaagggagggctcaatggagtggacatttacagcctcgttaccgaaaacattcagtggccgaacggtataaccctggacctgctctcgggcagattgtactgggtggattccaagttgcatagcatttcatccattgatgtcaacggcggcaaccgaaaaacgattctggaagatgaaaagcgtctggctcatcctttttctctggcagtctttgaagataaagtgttttggactgacatcataaatgaggcaatctttagcgcaaaccgactcaccgggagcgacgtgaatcttctcgcagaaaacctgctttcccccgaggatatggtgcttttccacaatctcacgcaacccagaggtgttaactggtgcgagagaacgactctgtccaacggtggatgtcaatacctttgtctgccagcaccacaaatcaacccgcacagcccaaagtttacctgtgcatgtccggatggtatgttgctcgcacgggatatgagatcctgtcttaccgaggccgaagcagcagtggcgacccaagagacttccactgtgaggctgaaagtgtccagcactgccgttcggactcagcatactaccaccagacctgtgcctgacacttcccgtctcccaggagcaactcctggtctgacgaccgtggaaattgttaccatgtcccatcaggcactgggtgatgtggcaggacgcggaaacgagaaaaagccttcgagcgtgcgtgcactgtccatagtgcttccaattgtcctcctggtgtttctttgtctcggggtgtttctcctttggaagaactggcgtcttaagaacataaacagcattaacttcgataatcccgtctaccagaaaaccactgaagatgaagtgcatatctgccataaccaggatggctactcgtacccatcccggcaaatggtgtcactcgaagatgacgtggcg

SEQ ID NO: 482 - DNA, 2580 bp, Artificial Sequence
  Description of Artificial Sequence: Synthetic Transcript Sequence
atgggtccttgggggtggaaacttcgctggaccgtggcattgctcctggcagcggcaggcaccgcagtcggtgatcgctgtgaacgtaacgaattccaatgccaagacggcaagtgcatctcttacaagtgggtgtgtgatggaagcgcggaatgtcaagatggatcggacgaatcacaagaaacctgtttgtcagtgacgtgtaagagcggggacttctcatgcggaggacgtgtgaacagatgtatccctcagttttggagatgtgatggacaggtggactgcgacaacggatcggatgaacaggggtgtccgcccaagacctgctcccaagatgagtttcggtgccatgacggcaaatgtatctctcggcagttcgtctgtgattccgatagagactgtctggacggttctgacgaagcatcgtgccccgtccttacttgcggacccgcatcgttccagtgtaattcctccacttgtattcctcagctttgggcctgcgataatgatccggactgtgaggacggatcagatgagtggccgcagaggtgccgtggcctttacgtgttccaaggtgattcgtcgccgtgttcggcttttgagtttcactgccttagcggcgaatgtattcactcgtcatggcgctgtgacggcgggcctgattgtaaggataagagcgatgaggaaaattgtgcagtggcaacctgtcgaccagatgaatttcagtgctcggatggcaactgcattcatggatcgcgccagtgtgatagagaatacgattgtaaagacatgtcagatgaggtgggctgtgtcaacgttactctctgcgaaggaccaaataagtttaagtgccatagcggagagtgcataaccctcgataaagtgtgcaacatggccagagattgtcgcgattggtcagacgaacctattaaggaatgtggtactaacgcctgcctcgataacaacggtggatgctcgcatgtgtgtaatgatttgaaaattggttacgaatgtctgtgccccgacggatttcaactggtggcacagagacggtgcgaggatattgatgagtgtcaagaccccgatacctgttcacaactctgtgtgaatctcgaaggcggttacaaatgccagtgtgaagaaggttttcagctcgatccccatacgaaggcgtgtaaggccgtgggtagcatcgcatacctgttcttcacgaatagacatgaggtgcggaagatgactctggatcgatccgaatacaccagcctcataccgaatctgcgcaacgtggtcgcccttgatactgaggtcgcttctaacaggatctactggtccgatctttcgcagaggatgatatgttccacccagcttgacagagcgcatggagtgtcgagctacgataccgtgatctcacgggatatacaggcaccagatggtctggccgttgattggatacacagcaatatctactggactgactcggtgcttggaactgtgtcagtggctgacaccaagggagtgaagaggaaaaccctcttccgagaaaacggttcgaaaccccgcgcaatcgtggtggatccagtccacgggtttatgtattggaccgactggggaactccagccaagattaagaaaggaggtttgaacggggtggacatttactctcttgttactgagaacattcaatggcctaatggcataactctcgaccttctcagcggaaggctgtattgggtggattcgaagctccactcgatttcttccatcgacgtgaatggcgggaatagaaagactattcttgaggacgaaaaacgtctggcgcatccgtttagcctcgcagtctttgaggacaaagtcttttggacggatatcattaatgaggcgatcttttcggcaaacagacttactggtagcgatgtgaaccttcttgcggagaacctgctttccccggaggacatggttctctttcacaacctgactcagccacgcggggtgaactggtgcgaaagaaccactctttcgaatggaggatgtcaatacctttgtctgcctgcaccacagattaacccacatagccctaagtttacctgtgcctgtcctgatggtatgctgctggcacgtgatatgcgttcctgtttgactgaggccgaagcggcagtcgcaactcaggaaactagcactgtcagactgaaggtgtcgagcactgcagtcagaacccagcacactacgacccgaccagtccccgacacgtcacggttgccaggtgctaccccaggtctgaccactgtggaaatcgtgactatgagccaccaagctcttggagatgtggcaggccgcgggaacgaaaagaaacctagcagcgtccgcgccctctccatcgtgctccctatcgtcctgcttgtctttctctgcttgggagtgttcttgttgtggaagaattggcgtctgaagaacatcaacagcattaacttcgacaaccctgtgtaccaaaagaccactgaagatgaagtgcatatctgtcacaaccaagatgggtactcctacccatcacggcagatggtgtcccttgaggacgatgtggcc

SEQ ID NO: 483 - DNA, 2580 bp, Artificial Sequence
  Description of Artificial Sequence: Synthetic Transcript Sequence
atgggtccttggggatggaagctgcggtggaccgtggccctcctgcttgccgccgcgggtactgcggtgggagatagatgtgagagaaacgaatttcagtgtcaagatggaaagtgcatcagctacaagtgggtctgcgacggatcggccgaatgccaagacggatccgatgagtcgcaggaaacttgcctgtcagttacttgcaagtcgggcgatttctcgtgtggaggaagagtgaatcgctgcattccgcagttctggagatgcgacgggcaggtggactgcgataacggaagcgatgagcagggctgcccgccaaaaacttgttcgcaagatgagttccgctgtcatgacgggaagtgcatctctcgccaattcgtctgcgactcagatcgcgattgtctggatggctcagacgaagccagctgccccgtgctcacttgtggaccagcatcattccagtgcaattcctcaacgtgcatcccccagctttgggcgtgtgacaatgatccagattgcgaggatggttcggatgaatggcctcaacggtgcaggggcctctacgtgttccagggggattcctcgccgtgttccgcattcgagttccattgcctcagcggagaatgcatccatagctcttggcgctgtgatggaggtcccgattgcaaggataaatcggacgaagaaaactgcgccgtggcaacttgccgccctgatgaattccaatgttcggacggaaattgcatccacggatcccgccagtgcgacagggaatatgactgcaaggacatgtcagatgaggtcggttgcgtcaacgtgactctgtgcgagggtcctaataagttcaagtgtcattccggcgaatgcatcaccctggataaggtgtgtaacatggctagagactgcagagattggtcggatgaaccgattaaggaatgcggaactaacgcatgcctcgacaacaacggcggatgctcccacgtgtgtaatgacctcaaaattggatacgagtgcctgtgcccggacggattccagttggtcgcccagagacgctgcgaggacatcgacgagtgtcaggacccggatacttgctcgcagctgtgtgtgaatctcgagggcgggtataagtgccagtgcgaggaaggcttccagctcgacccacatactaaggcttgcaaggcggtgggctccatcgcatacttgtttttcactaacagacacgaggtccggaagatgaccttggaccggtcagagtacacctctctgatccccaacctgcgcaatgtggttgcacttgatacggaggtggcgagcaataggatctactggtcagatctgtcacagcgcatgatttgcagcactcagctggaccgggcacacggagtgagctcctacgataccgtcattagcagggatatccaagcacccgacggactggctgtggattggatccactcgaacatctattggacggattcggtcctcggtaccgtgtcggtggccgacaccaaaggtgtcaagcgcaagaccttgttccgggagaacggaagcaagccgagggcgatcgtcgtggacccagtgcacggattcatgtactggacggactggggcaccccagccaagatcaagaagggcggattgaacggagtcgacatatactcacttgtgactgaaaacattcaatggccaaacgggatcactctggacctcttgtcaggacggctttactgggtggattcaaaattgcactcgatctcctcaattgacgtcaacggaggaaacagaaagaccatcctcgaggacgaaaagagactggcacatccatttagcctcgcggtgttcgaggacaaagtgttctggactgacatcatcaacgaggcgattttctcggcgaaccgtctcactgggtcagatgtcaacttgctggccgagaatctgctgagcccggaggacatggtgctgtttcataatctgacccagccgcggggggtcaactggtgcgaacgcactacgctctcaaacggaggctgtcagtacctgtgtctcccagccccgcagatcaatcctcattcgccaaaattcacctgcgcctgccctgacggcatgctccttgcccgagatatgaggtcctgcctgaccgaggccgaggccgctgtggcaactcaggaaacctcgaccgtgcgactgaaagtctcctcaactgccgtgcgcacccagcacactactaccaggccggtgccggacacttcccgcctgcccggagctacgccgggactgactaccgtggagatcgtgactatgtctcaccaggcactcggtgatgtcgctggtcggggtaacgaaaagaagccgtcaagcgtgcgggcgcttagcatcgtgctcccgatcgttctgctggtgttcctgtgcttgggggtctttctgctgtggaaaaactggcggttgaagaacatcaattccatcaatttcgataatcctgtgtaccagaaaaccaccgaggacgaagtccatatctgtcacaatcaggatgggtattcgtacccatctaggcaaatggtgtcccttgaggatgacgtcgcg

SEQ ID NO: 484 - DNA, 2580 bp, Artificial Sequence
  Description of Artificial Sequence: Synthetic Transcript Sequence
atggggccctggggctggaaactgcgctggacagtggccctcttgcttgcagcggcagggacagccgtcggggatcggtgtgagcgaaatgagtttcagtgccaggatggaaagtgcatcagctataaatgggtgtgtgacggaagtgctgagtgtcaggacggctccgacgagtcccaggaaacttgcttgtcagtgacctgtaagtcgggggatttctcttgcggggggcgggtcaatcggtgcatcccccagttttggaggtgcgacggccaggttgattgcgacaacggaagcgatgagcagggctgcccacccaaaacatgttcacaggatgaatttcggtgtcacgacggaaagtgtatctcccggcagttcgtatgtgatagcgatagggattgcctagacgggtcagatgaggcctcttgccctgttctgacatgcggacccgcctcattccagtgcaacagtagtacctgtattccccagctgtgggcctgtgataatgatccagactgtgaggacgggtctgacgagtggccgcagcgctgtcggggattatatgtgtttcagggagacagtagcccctgcagcgcgttcgagtttcactgcctcagtggcgaatgcattcacagtagttggagatgcgacgggggacccgactgcaaggacaagagcgatgaagagaactgcgcggtcgcaacatgccgtccagacgagttccagtgctcagacggcaactgtatccatgggtctaggcagtgtgatcgtgagtacgactgcaaggacatgtcagacgaagttgggtgtgtcaatgtgaccttatgcgagggaccaaacaagtttaaatgtcatagcggggagtgcatcaccctggacaaggtctgcaacatggcacgtgactgtagagattggtctgacgagccaatcaaggaatgcggaacaaacgcttgtttggataataatggtggctgctcccacgtgtgtaacgatttaaaaatcggttacgaatgcctgtgtcccgatggctttcagctcgtagcccagcggaggtgcgaagatattgacgagtgccaggacccagatacctgttcccagctatgcgttaacctggaaggaggttacaaatgccagtgcgaggaagggttccagctggatccgcatacgaaggcgtgcaaagccgtggggagcatcgcatatctgttcttcacaaacaggcatgaggtcagaaaaatgactttggatcgctctgagtacacgagtttgatccccaacctgcgaaatgtcgtcgcactagatacagaggttgcaagcaatagaatctactggagtgatctgtcacagaggatgatttgtagcacccagcttgaccgagcccacggcgttagttcttatgatacggtgatatctagggacatacaggcgccggacgggctggcagtggattggatccatagcaacatatattggacagactcggttctcggcacagtctccgtcgccgacaccaagggcgtgaagagaaaaactcttttccgcgaaaatggaagtaagccccgtgctatagttgtggatcccgtacatggttttatgtactggactgattgggggacccccgccaagatcaaaaaaggcggactgaatggagtagacatttattccctcgtgacagagaacatccagtggcccaatggtatcactctcgacctgctgtctggccgactgtactgggtagatagcaagctgcacagcatttcctccatcgatgtcaacggcgggaacagaaagacgattttggaagacgagaagaggcttgcccacccgttttccctggcagtgtttgaagataaagtgttttggaccgatatcatcaatgaagccatcttttctgccaacagactaaccggtagcgacgtaaacctgctcgccgaaaacctgctgtcacccgaggacatggtcttgttccacaatttaacgcagccccgcggcgtcaattggtgcgagcggactacattgagtaacggaggatgccagtatttgtgcctcccggcaccgcagattaacccccatagtccgaagtttacatgcgcttgccctgatggtatgctactggcacgggacatgcgttcttgtctgaccgaagccgaggcagccgtggccacacaggagacctctacagtgagactgaaggtgtcgtccaccgcggtgcggacacagcacacaaccacacgccctgtccccgacacctcaaggctgccaggggccacaccagggctcacaaccgtcgagatagtcaccatgtctcatcaggccctgggcgacgtagcagggaggggtaatgagaagaaaccctcaagcgtcagagcactgtcaattgtcctgccaattgttctgctggtttttctgtgcttgggcgtgtttctgctgtggaagaattggcgcctgaagaacatcaattcaatcaatttcgataatccagtgtatcagaaaaccaccgaggacgaggttcatatctgccacaaccaggacggttactcctacccgtcccgccagatggttagcttagaggatgacgtggct

SEQ ID NO: 485 - DNA, 2580 bp, Artificial Sequence
  Description of Artificial Sequence: Synthetic Transcript Sequence
atggggccatggggatggaaacttcgctggaccgtggcactccttcttgccgctgcaggaaccgcagtcggagatcgatgtgagagaaacgagttccagtgtcaggatggaaagtgtatttcgtataagtgggtgtgtgatggctcagctgaatgtcaagatggttcggatgaatctcaagaaacgtgtctgtcagttacctgtaaatctggagatttctcgtgcggtggaagagtaaacagatgcatcccacaattttggagatgcgacggacaggtggactgtgataacggatccgacgagcaaggttgccctcccaaaacctgctcccaggacgagtttagatgccacgacggaaagtgtatctcgagacagtttgtgtgtgacagcgatcgggattgtctcgacggctcagatgaagcaagctgccctgtgcttacctgcggtcctgcatcctttcaatgcaacagctcgacctgtattccacagctttgggcctgtgataacgaccccgactgtgaagatggatcagacgaatggccgcagcgttgccggggactctacgtgttccaaggcgattcatcaccctgcagcgctttcgagttccattgtttgagcggtgaatgcatccattcctcctggaggtgcgatggcggtcctgactgtaaagataaatcggacgaagagaattgtgcagtggccacctgccgacctgacgaattccagtgcagcgatggcaattgtatacatggatcgagacagtgcgaccgtgaatacgattgcaaggatatgtccgacgaagtcggatgcgtgaacgtgactctctgtgaaggcccgaataagttcaagtgtcatagcggggaatgcatcactctggataaggtgtgtaatatggcaagagactgccgcgactggtctgatgagcctataaaggaatgtggaaccaacgcctgtctcgataacaacggtgggtgctcccatgtgtgtaacgacctcaaaattggctacgaatgcctctgtcctgatggatttcagctggtggcgcagcgaagatgtgaggatattgatgagtgccaggaccctgacacctgttcccaactttgtgtgaacctggaaggaggctacaaatgtcaatgtgaggaaggattccaacttgatcctcataccaaggcatgtaaggcagtgggcagcatcgcctacctgtttttcactaacagacatgaggtgagaaagatgactcttgatcggtcagaatacacttcgcttataccaaatctgagaaacgtcgtggctctggatactgaagtggcatccaataggatttactggtcggaccttagccagcggatgatttgctccacccaactcgatagagcccatggcgtgtcgagctacgacaccgttatttcacgggatattcaagcccctgatgggcttgccgtggactggatccattctaacatatactggactgattcggtcctgggtaccgtgtcagtggccgataccaaaggcgtcaagcgtaagaccctttttcgcgagaacggatccaagccacgagcaattgtggtggatcctgtgcacggattcatgtactggacggattggggcacccccgcgaagatcaagaaaggtggtcttaatggtgtggacatctattcgctcgtcaccgaaaacatccagtggccgaacggtattacgttggatctgctgtcgggacgcctgtactgggtggatagcaaacttcactcaatttccagcatcgatgtgaacgggggaaaccgcaagaccattcttgaagatgagaagcgtctggcacaccctttttccctcgcagtgtttgaagataaagtgttttggaccgacattatcaacgaagccattttctcggcaaaccgcctcacgggcagcgatgtgaatttgttggccgagaatctgctcagtccggaagatatggtcctgtttcacaatctgactcagcccagaggtgttaactggtgtgagcgcaccaccctttccaacggcggctgccagtacttgtgccttcctgccccccaaatcaatccgcacagcccgaaattcacctgtgcatgtccagatggtatgctgctggcacgtgatatgaggtcctgccttaccgaagcggaagcagccgtggccacccaggaaacctcgactgtcagactgaaagtctcctccaccgcggtgcggactcaacacaccaccacgaggcctgtccctgatacttcccggcttcccggagcaactcctggattgactactgtcgaaattgtgaccatgagccaccaggcactcggtgacgtggcaggacggggtaacgaaaagaagccctctagcgtgagagccttgtctatcgtactcccaattgtgcttcttgtgtttttgtgcctgggcgtgttccttctgtggaaaaactggcgacttaagaacataaactcgatcaattttgacaacccggtttaccaaaaaacgactgaagatgaggtgcatatttgccataatcaagatggatacagctacccttcacgacagatggtcagcctcgaagatgatgtcgca

SEQ ID NO: 486 - DNA, 2580 bp, Artificial Sequence
  Description of Artificial Sequence: Synthetic Transcript Sequence
atggggccatgggggtggaagctcaggtggaccgtggcactgctattagctgccgccggaactgctgtgggagatcggtgtgaacgcaatgagttccaatgccaggacggcaaatgcatctcctacaaatgggtttgcgacggttctgccgaatgtcaggatggaagcgacgaaagccaggagacttgcctttccgttacatgtaaaagtggcgacttttcctgcggcggccgcgtgaacagatgcataccccagttctggcgttgcgacgggcaggttgactgtgataacggatctgatgaacagggctgtccacctaagacctgctctcaggacgaattcaggtgtcacgatggcaaatgcatttcgcggcagtttgtctgcgattctgaccgcgactgcttagacggttctgacgaggcatcctgtccagtcttgacttgtggcccagcaagttttcagtgcaactcatcgacatgcattcctcagctctgggcatgtgataacgacccagactgcgaggacggttccgatgagtggccacagaggtgtagagggctgtacgtgttccagggggactcttctccatgctccgcattcgagttccattgcctttccggagagtgtatacactcaagttggcggtgtgatgggggccccgattgtaaggacaagtctgacgaggaaaactgcgctgtggcgacctgcagaccggatgaatttcagtgcagcgacggtaattgtatccacggaagtcgccagtgcgatagagagtacgactgtaaagacatgtccgatgaggttggctgcgtgaatgttacactgtgtgaaggacctaacaagttcaaatgtcactctggagaatgtataaccctcgacaaggtttgcaacatggccagagactgtcgggattggtctgacgaacctatcaaggagtgcggaacgaatgcttgcttggataacaatggcggatgttcccatgtgtgcaatgatctcaaaatcgggtacgagtgtctgtgccccgacgggtttcagctagtggcccagcgcagatgtgaggatatcgatgaatgtcaggaccctgatacctgttcccagctgtgtgtgaacctcgagggcgggtataagtgccagtgcgaagaggggttccagctggatccccacaccaaggcatgtaaggcagtgggctctatagcctatctgttcttcacaaatcgccacgaggtgagaaagatgactctggaccggtccgagtacacctccttaataccgaacttgcggaacgtggtggcgctcgataccgaagtcgcttcaaacaggatctactggagcgatctttctcagaggatgatttgcagtacgcagcttgatcgtgctcatggcgttagctcgtatgataccgtcatctcgagggacatccaggccccagacggattggcggtggactggatccattcaaatatttattggaccgatagcgttttggggaccgtgtcagtggccgatactaagggcgtaaagcggaagaccctatttagggaaaatggctcaaaaccccgcgccatcgtggtggaccccgtccacggattcatgtattggacggactgggggacacccgccaagatcaaaaagggagggttgaatggcgttgacatttattctctggtgacagagaatatacagtggccaaacggaatcacccttgaccttcttagcggcaggctctattgggtggattccaaattacacagtatctcatcaatagacgtcaacgggggaaatagaaagacaatcctcgaagacgagaagcgcttggctcaccccttttcgctcgcagtcttcgaagataaagttttttggacagatataataaacgaagccattttttctgccaaccgattaaccggaagcgatgttaatcttctggccgagaacctgctgtcccctgaagacatggtcttgttccataatctgactcagcctaggggggtcaattggtgcgagaggacaacccttagcaacgggggctgtcagtacctgtgtttgccagccccgcagatcaatcctcactcccctaaatttacttgcgcctgccccgacggcatgctgctggctagagatatgagatcctgcctgaccgaagcggaggcggcggtcgcgacccaggaaacatcaactgtgaggctgaaagtttcatccaccgcagtgcggacccaacacacaaccacgagaccagtcccagatacatctcggctgccaggggccacacccgggctgacaacagtcgaaatagtcaccatgagccaccaggccctgggggacgtcgccggcagaggaaacgagaagaagccttcctctgtgcgggccctgtctatcgtgctgcctatcgtactgctggtgttcttgtgtttgggagtctttctcttgtggaaaaattggcgactcaagaatattaacagcattaactttgataatcccgtatatcagaagactactgaggacgaggtacacatttgtcataatcaggatggctattcatatccctcacgccagatggtgtccctggaggacgatgtcgca

SEQ ID NO: 487 - DNA, 2580 bp, Artificial Sequence
  Description of Artificial Sequence: Synthetic Transcript Sequence
atgggaccttggggctggaaacttcgctggaccgtggcccttcttttggctgcagctggaaccgcagtgggcgatcgttgcgaaagaaatgagtttcaatgtcaggatggtaaatgtattagctacaagtgggtgtgcgatggatccgcggaatgtcaagatgggtcggatgaatcccaggagacttgtctgagcgtcacgtgtaagtcaggagatttttcgtgtggaggaagagtgaaccgatgcattcctcagttttggcgctgcgatggacaggtcgattgtgacaacggttcggatgagcagggttgtcctcctaagacctgtagccaagatgagttccgatgccacgatggtaagtgcatatcgagacaatttgtgtgtgactcagatcgggactgtcttgatggaagcgatgaagcgtcatgccctgtcctgacctgcggaccagcatcctttcaatgtaattcgagcacctgcatcccacaactctgggcatgtgacaacgatcccgattgtgaagatggtagcgatgaatggccacagcgctgtcgcggtctttacgtctttcagggagattcctcaccatgttcggcatttgagtttcactgtcttagcggagaatgcatccactcgtcgtggcggtgcgacggaggaccggattgtaaggacaaatccgatgaagaaaattgcgcggtcgctacttgtcgaccggatgaattccagtgtagcgatggaaactgcatccatggttcaaggcagtgtgacagagaatacgattgcaaggatatgagcgatgaggtgggctgtgtgaatgtaaccctttgtgaaggacctaacaagtttaagtgccattcgggcgaatgcattactcttgacaaggtttgcaatatggcacgtgattgtcgtgactggtcggacgaaccaattaaggagtgcggaaccaacgcatgcctggataacaacggagggtgctcacacgtctgcaacgatcttaagattggatacgaatgtttgtgccccgacggattccaactggtggcgcagcggcgatgtgaagatatcgatgagtgtcaagaccctgacacttgctcccagctgtgcgtcaacctcgaaggaggatacaagtgtcagtgcgaggaaggctttcaactcgatcctcatactaaggcatgtaaagcagtgggttcaatagcatacttgtttttcaccaaccgacatgaagtgagaaaaatgacccttgatcgatcggaatatacctcgctgatcccaaaccttaggaacgtggtggcactcgatactgaagtggcttccaacaggatttactggtcagatctgtcgcagcgcatgatttgctccactcaactggaccgcgcacatggagtgtcctcgtacgatactgtgatctcccgcgacatccaggcccctgacggtcttgcggtcgactggatccattcgaatatctactggaccgattccgtgctggggactgtgtcggtggccgatactaagggcgtgaagagaaagaccctttttagggaaaacggttcgaaaccgagagcgattgtggtcgacccagtgcatggctttatgtactggaccgactgggggaccccagccaagataaagaaaggtggactgaatggagtggacatctactcactcgtcacggagaacattcaatggccaaacgggatcactcttgacctgctttcgggcagactgtactgggtggatagcaagctccattccattagttcaattgacgtaaacgggggtaatcgaaaaactatacttgaagatgagaagcgactcgcacatccctttagcctggcagtgtttgaggataaggtgttttggactgacataatcaacgaagccattttctccgcaaacagactgaccgggagcgacgtgaatttgcttgctgaaaacttgctgtcaccagaggatatggtgctgtttcataacctgacccagccccgtggtgttaactggtgtgagcgaactaccctgtcgaatggaggttgccaatacttgtgcctgcctgcgccacagatcaaccctcattccccaaagttcacttgcgcttgcccggatggaatgctgctcgcacgggatatgcgcagctgtctgaccgaggccgaagcagctgtggctacccaagaaaccagcactgtgcgccttaaggtcagctccacggccgtgaggactcagcatacgactaccagaccagtccccgatacttcgagactgccaggtgccacccccggtctgactaccgtcgagattgtgacgatgagccaccaagcacttggagacgtggcaggaagagggaacgaaaagaagccatcgagtgtgcgtgcattgtccatagtcctccctattgtcctgctggtgtttctttgtctcggagtgtttctgctctggaagaattggcggctcaagaacattaactccatcaacttcgacaatccggtctaccagaaaactactgaggatgaggtccatatctgtcataaccaggacgggtattcatacccgtcccgtcaaatggttagcctggaggacgatgtggca

SEQ ID NO: 488 - DNA, 2580 bp, Artificial Sequence
  Description of Artificial Sequence: Synthetic Transcript Sequence
atggggccttggggatggaagcttagatggacagtggctctcctattggctgccgctggaaccgctgttggagaccgttgcgaacggaacgagtttcagtgtcaggatggcaagtgtatctcttataagtgggtatgtgacggcagcgccgagtgtcaggacgggagcgatgagagccaggaaacatgcctatccgtcacctgcaaatcgggcgatttttcttgtggtggacgagtgaaccgctgtattccacagttctggcggtgcgacggtcaagtggactgtgataatggaagcgacgagcaggggtgtccccccaagacttgctctcaagacgagttccgctgccatgacgggaagtgcatttcccgtcaattcgtatgcgattcagacagggactgtctggatggatccgatgaggccagttgccctgtgctgacctgcggacccgcatccttccagtgcaactcaagcacttgcatccctcagctgtgggcctgcgacaacgaccccgattgtgaagatggttccgatgagtggccgcagcgctgtcgaggactgtatgtctttcagggtgattccagcccgtgttccgctttcgaatttcattgcctgtcaggcgaatgtattcactcctcctggcgctgtgacggcggccccgattgtaaagataagtcagatgaagagaactgcgccgttgccacttgccgcccagacgaatttcaatgttcagacggaaactgtattcacggcagcagacagtgcgatcgcgagtatgattgtaaagacatgtctgacgaggtgggttgtgttaatgtcactctctgtgagggccctaataagttcaaatgccactctggagaatgtataacactcgataaggtatgtaacatggcgcgagattgtagggattggagcgacgagccaattaaagaatgtgggaccaatgcctgtttagataacaacggggggtgttcccacgtctgcaatgatcttaaaataggatatgaatgtctgtgccctgacgggtttcagctggttgcccagaggaggtgcgaagacatcgatgaatgccaggatcctgatacctgttctcagctgtgtgtcaatctggaagggggatacaaatgtcagtgcgaagaaggcttccaattggatcctcataccaaagcgtgcaaggctgtgggatccatcgcctacttatttttcacaaaccgccatgaggttcgcaagatgacactagatcgttccgaatatacctctctgatccccaacctccgcaatgtcgtcgcgctggataccgaggttgcaagtaatcgcatatactggtctgatctaagccagaggatgatttgttcaacgcagctagaccgggcacatggcgtgagttcctacgacaccgtgatcagtagagacattcaagcaccagacggcctggccgttgattggattcatagcaacatctattggacagattctgttctcggaaccgtttcagtagcagatacaaagggcgtcaaacggaaaactctgttccgtgaaaatggatcaaaaccacgcgccatcgtggtggaccccgtgcacgggttcatgtactggaccgactggggcactcccgccaagatcaagaaaggcgggctgaacggggtggacatctattcactcgtgaccgaaaacatacagtggccaaatggaatcaccctggatttgctgtcgggtcggttgtattgggtggattccaagctgcatagcatttccagtattgatgtgaacggtgggaatagaaagacaattcttgaggacgagaagcggctggcacacccttttagcctcgccgtgttcgaggataaggttttttggaccgatatcatcaatgaggccatcttcagcgctaacagactgactggaagtgatgtgaatctccttgcagaaaatttgctgagccctgaagatatggttctctttcataacttgacccaaccaagaggcgtgaattggtgtgagcggaccaccttgagtaacggagggtgtcagtacctgtgccttcccgccccacagatcaatccgcactcacccaagttcacttgcgcatgccctgacggcatgctcctggcgcgtgacatgagatcctgtctcactgaagccgaggctgccgtagctacccaggagacatcaacagttcgactgaaggtgtctagcacggccgtgcggactcagcataccaccaccaggccagttcccgacacttctcggttgcccggcgccacacccggactgaccacagtggaaatcgtcacaatgagtcaccaggcactgggagacgtggctggcagagggaacgagaagaagccttcttctgtccgggccctatccattgtgctgcctattgtcctgctggtgttcctttgtctgggggttttcctcctgtggaagaattggagactaaaaaatataaactccattaattttgataacccagtatatcaaaaaaccactgaggacgaggttcatatttgtcataatcaggacggatactcatacccatctcggcaaatggtgagcctagaggatgatgtggct

SEQ ID NO: 489 - DNA, 2580 bp, Artificial Sequence
  Description of Artificial Sequence: Synthetic Transcript Sequence
atgggtccttggggctggaaactgagatggactgtggcattgcttttggctgccgccggaactgccgttggcgaccggtgtgaacgtaatgagttccaatgtcaggacgggaagtgcattagctataagtgggtttgtgacggcagtgctgaatgtcaggatggctctgacgagagtcaagaaacctgtctctctgtgacttgcaaatccggagacttcagttgtgggggcagagtgaaccggtgtattccacagttttggagatgtgacggccaggtagattgcgataacggcagcgacgagcaggggtgtccaccaaagacgtgttcccaagacgagttcaggtgccatgacgggaagtgcattagccgacagttcgtctgtgactcagatagggactgtctagacggctccgacgaggcatcctgccctgtactgacatgtgggcctgccagctttcagtgcaacagtagcacctgcatcccacagctttgggcctgcgacaacgatcccgattgcgaggatgggagtgacgaatggccccaaagatgcagaggactgtacgtcttccagggcgacagtagtccttgctcagcctttgagttccactgtctgagcggcgaatgtatccactcctcatggagatgcgacggcggtccggactgtaaggacaaaagcgatgaggagaattgtgcagtcgcaacttgtaggcctgatgagttccagtgtagcgacggaaactgcattcacggttcccgacagtgcgatagggagtatgactgcaaggatatgtccgatgaggttggttgcgtgaacgttacactgtgcgagggcccgaataagtttaaatgccattcaggagagtgtataaccctggataaggtgtgcaatatggcccgtgactgccgtgattggagtgatgaacctattaaggaatgcggtaccaacgcctgtctggacaacaacggagggtgtagtcatgtctgcaacgatttgaagattggttatgagtgcctgtgccccgacgggtttcagctggttgctcaacgccggtgtgaggatatcgatgaatgccaggatcccgatacttgtagccagctttgtgtcaatcttgagggcggatacaagtgtcagtgcgaggaaggttttcaactcgatccgcacaccaaagcctgtaaggcggtgggcagcattgcttacctgttcttcaccaaccgacacgaggtacgcaaaatgaccctcgaccgaagtgagtacacctccctgatcccaaatctgagaaacgttgttgcactcgacacggaggtggctagcaatcggatttattggagcgacctctcacaacgcatgatatgtagtacccagttggacagagcccatggcgtcagttcgtacgacactgtgatatcccgcgacatccaggctccagatgggctggccgttgactggatacattcgaacatatattggactgatagcgtgctcggtacagtctccgtagccgacacgaagggcgtcaaacggaagaccctatttagagagaacggctctaaaccacgcgcgattgttgttgatccggtgcatgggttcatgtattggacggattggggaacccccgccaagatcaaaaaggggggcttgaatggagtcgatatttactctctagtgacagaaaacatacaatggcctaacgggattacactcgacctgctctccggccggctgtattgggtcgactccaaacttcacagcatctcttctatcgacgtcaacggtggtaataggaagactatcctggaggacgagaagcgtctagcacacccattttcccttgctgtgtttgaagataaagtattctggactgatataattaacgaggccatttttagcgccaacaggctgaccgggtccgacgtgaatttgctggccgagaacttgttgagtccagaagatatggtgcttttccataatttgacccagcctagaggggtcaactggtgcgagcgcaccacgctgtcaaatggtggctgccagtatctgtgtttgcctgccccacagatcaatcctcactcccctaaatttacctgtgcttgccctgacggaatgctcctggcgcgagatatgcggagctgcctaactgaggccgaagccgctgtggccacccaggagacctcaacagtgaggctgaaagtgtcatccaccgccgtgcgcacacagcacactaccaccagacccgtgcccgacaccagcagattacctggcgctactcctggcttgaccacagtggagatagtaacaatgagccaccaggccctgggcgatgtagccggcagagggaatgagaaaaagccttcctcagtgcgggccctctctattgtactcccaatagtcctgctcgtttttctctgtttaggggtgttcttgctgtggaagaactggaggctcaagaatattaattccatcaacttcgataacccagtgtaccaaaagaccacagaggatgaggtgcatatttgccacaaccaagacggttattcctatccttcgagacagatggttagccttgaggatgacgtggcc

SEQ ID NO: 490 - DNA, 2580 bp, Artificial Sequence
  Description of Artificial Sequence: Synthetic Transcript Sequence
atggggccgtgggggtggaagttgagatggacggtagccctgctgctggctgctgcaggaacagctgtaggagataggtgcgaaaggaatgagtttcagtgccaggatggcaagtgcatttcctataagtgggtgtgcgatggcagtgccgagtgtcaggacggcagtgacgaatctcaggagacttgtctctctgttacttgcaaaagcggagacttcagttgtggcggacgagttaatagatgcataccacagttctggagatgtgacggccaggtggactgcgacaatggaagcgacgaacagggctgcccaccaaaaacgtgcagccaggacgagtttcgttgccacgacggcaagtgtatcagcagacagtttgtgtgcgattccgaccgggactgtcttgacgggagcgacgaggcttcctgccctgtgctaacatgtggccctgctagcttccagtgtaactcctccacatgcatcccacaattatgggcctgtgacaatgaccctgactgcgaggatgggtccgatgagtggcctcagcggtgccgcggattatacgtgttccagggcgactcatccccctgttccgccttcgaatttcactgcttaagcggggagtgcattcactcaagctggcgctgtgacggggggccggattgcaaggacaaatccgacgaggaaaactgtgcagttgctacttgccggcctgacgaattccagtgctccgatgggaactgtatccatggttcgagacaatgtgatagagaatacgattgcaaggacatgtcagatgaggtgggatgcgtgaacgtcaccttatgcgaaggaccaaataaatttaagtgtcacagcggggagtgcatcactttggacaaagtctgcaatatggcgagggactgccgggattggagcgacgaacctataaaagagtgcggcacgaatgcatgtctcgataacaatggggggtgtagccacgtctgcaatgatttaaagataggttacgaatgtttgtgtcctgatggattccagctggtggcacagcgtcggtgtgaggacatcgacgagtgtcaggatccggacacatgctcacagctgtgtgtaaacctggagggagggtataagtgccagtgcgaggagggattccaattagatccgcataccaaggcctgcaaagctgttgggtctattgcctaccttttttttacgaaccgccacgaagttcgcaagatgacattggatcgatccgaatatacaagccttattcccaacttacgcaacgtagtggctctggacacagaagtagcctcgaataggatctactggtccgacctcagccaacgaatgatttgcagtacacaacttgaccgcgcccacggggtaagctcttacgacacagtgatatcacgggatatacaggcacctgatggactagcggtagattggatccatagcaacatttattggaccgattctgttctggggacagtttcggttgccgacaccaaaggagttaagagaaagactttgttccgtgaaaatggatccaagccccgggcgatcgtcgtggatcctgtgcacggatttatgtattggacagattggggcacccctgccaagatcaaaaagggaggtctgaacggtgtggacatatactcactggttaccgaaaatattcaatggcctaatggcatcacgctcgacctattaagcggtcgcctatactgggttgattccaagctccactcgatcagctccatcgatgtaaacggcggaaatcggaaaaccattctagaagacgagaaacgcttagcccacccattcagtctggctgtgttcgaagataaagtgttttggaccgatatcatcaatgaagcgatcttcagtgcaaataggctcacggggtctgacgtcaacctgcttgccgaaaaccttctgagtccagaggacatggtcctgttccacaacctaactcagccccggggagtcaattggtgcgaacgtactacattgtctaatggcgggtgtcagtatctgtgtctgccagcgcctcagattaatcctcactctccaaagttcacatgcgcctgccccgatggtatgctgttggcccgtgacatgcgctcttgtcttacagaggccgaggccgctgtggccacacaggagacctccacagtccggcttaaggtctccagtacagctgtgagaactcagcacacaacaaccagaccggtgccagacacctctaggctccccggagctactccaggactaactacagtggaaattgtgacgatgagccatcaagctcttggagacgtggctgggcgtggaaatgagaagaaaccatcgtcggttagagccctctctattgtactacctatcgtcctgctcgtcttcttgtgcctcggagtgttcttactttggaagaactggaggcttaaaaacattaacagcattaactttgacaatcccgtctaccagaaaaccactgaagacgaagtgcatatctgtcacaaccaggatgggtattcctacccctccaggcaaatggtgtccctggaagacgacgttgct

SEQ ID NO: 491 - DNA, 2580 bp, Artificial Sequence
  Description of Artificial Sequence: Synthetic Transcript Sequence
atgggaccgtggggatggaaacttaggtggacagttgcacttctgttagccgcagcaggaactgctgttggagatcgttgcgaacgaaatgaatttcaatgtcaagatggaaagtgtatttcatataaatgggtgtgtgacggatcagccgaatgccaggatggctccgatgagtcacaggaaacatgtttgagtgtgacctgtaagtcaggagatttctcttgcggaggaagagttaacaggtgcatcccccaattttggagatgcgatggacaagtcgattgtgataatggatctgacgagcaaggatgtccaccaaagacttgctcccaggacgaatttcggtgtcatgacggaaaatgtattagtcgccaatttgtttgcgattcggaccgtgattgcctcgacggaagtgacgaggcatcatgtcccgttttgacgtgtggaccagcgagtttccagtgcaatagttccacatgtattcctcaattgtgggcttgcgataacgatccggactgcgaggatggttctgatgaatggccgcagcgatgtcgaggactatacgtattccagggtgatagctcgccatgctcagccttcgaatttcactgtttaagtggagaatgtattcatagttcatggcgatgcgatggaggaccagattgcaaagacaagtccgatgaggagaactgcgccgttgcaacgtgtcgaccggacgaatttcagtgttcagacggaaactgtatccatggatcacgacaatgtgaccgagaatacgattgcaaagatatgtccgatgaggtgggctgtgtgaatgttaccctctgtgaaggaccaaacaagttcaaatgccatagtggggaatgtattacgttggacaaggtttgcaacatggcaagagattgccgagattggtctgatgaaccgatcaaagagtgtggcacaaacgcttgtctggataacaacggaggttgttcgcatgtttgcaacgacttgaagataggctatgaatgcctctgtcctgatggatttcaacttgtcgctcaaagacgttgcgaggatatcgacgagtgccaggacccagatacatgttcacaactttgtgtcaacttggaaggaggatataagtgtcagtgtgaggaaggattccagttggacccacatacaaaagcttgtaaggcagtcggtagtattgcatacctattttttaccaatcgtcatgaagtgcgaaagatgacgctggatagaagtgaatacacatcccttattccgaatttgcgtaatgtagttgctcttgatactgaggtggcttcaaaccgcatctattggtcagacctctcacaacggatgatctgtagtacacaattggaccgtgctcatggtgttagctcatacgatactgttattagccgggatattcaggctccagacggattggcagtagactggatccattctaatatttattggaccgattccgttctaggaacagttagcgtcgcagatacaaaaggagtcaagagaaagactctttttcgagagaatggctcaaagccccgagctattgtagttgatccagtgcatggatttatgtactggactgattggggcacaccagctaaaatcaagaagggaggcttgaatggagttgacatttacagtttggttacagagaacattcaatggcctaatggaataactctggatcttctttcaggaaggctgtattgggtggattcgaaactccatagtatttcttctatcgacgttaatggaggaaatcgaaaaactattctcgaagatgaaaaaagacttgctcacccattctcccttgctgtgtttgaagacaaggttttttggacagatattattaacgaagcaatcttttcagcgaatcgcttgactggctctgatgtgaatttactggcggaaaatctgctttcgccagaagatatggtactttttcacaatctcacccagccacgtggagtcaattggtgcgagcgaacaacactgtcaaatggtgggtgtcaatatttgtgcttgcccgcccctcaaattaatcctcactctccgaagtttacatgtgcctgtccagatggaatgctcctggcccgtgatatgaggagttgccttactgaagcagaagctgcggtggcaacacaagagacgtcaactgtcagattaaaagtttcaagcacagctgttcgaacccagcatactactacgaggccagttccagatacttcacgtttgccgggagcgaccccaggtcttacgactgtcgagatagttacgatgtcccatcaggctttaggagatgtcgccggacgcggaaatgaaaaaaaaccatcatcagtgcgtgccctgagtatcgtgctgccaattgtcctactggttttcctgtgtctaggtgtatttttattgtggaaaaattggcgtctcaaaaatattaattcgattaattttgataatcctgtttaccaaaaaacgacggaggatgaggtgcatatctgccacaatcaagacggctactcatacccatcgaggcaaatggtttctttagaagacgatgtcgct

SEQ ID NO: 492 - DNA, 2580 bp, Artificial Sequence
  Description of Artificial Sequence: Synthetic Transcript Sequence
atgggaccttggggatggaagctgagatggaccgttgccctgctgctcgccgcagctgggactgctgtgggcgataggtgtgagagaaatgaatttcaatgtcaggacggtaagtgcatttcatacaagtgggtgtgtgacggaagcgccgaatgccaagatggtagcgatgagtcccaggaaacttgtcttagcgtcacttgtaagtctggagattttagctgtggaggacgggtcaatcggtgtatccctcaattctggcgatgtgacggtcaggtcgattgcgataacggttccgacgaacaggggtgccctcctaagacctgctcgcaagatgagttccgatgccacgatggtaaatgtatctcgagacagtttgtctgcgatagcgacagagattgtttggacggatcagatgaggccagctgccccgtcttgacttgtggaccagcttcctttcaatgtaacagcagcacttgtataccacaactgtgggcatgtgataacgatcctgattgtgaggatggatccgatgaatggccccaacgctgccgcggactctacgtgtttcagggcgattcgtcaccttgttccgcattcgaattccattgcctctccggcgaatgtattcactcttcctggcgttgcgacggtggcccagactgtaaggataaatcggacgaggaaaactgcgcagtggcaacttgtcgacccgatgagtttcagtgtagcgatggtaactgtattcacgggtcacgccagtgcgaccgggagtacgactgtaaggacatgtccgatgaggtggggtgcgtgaatgtcaccctgtgtgaagggcctaacaagtttaagtgtcattcgggagaatgtattacgctggataaagtgtgtaacatggcccgggactgccgcgattggtccgatgaaccgatcaaggaatgtggaactaatgcatgcctggataacaatggggggtgtagccatgtgtgtaacgatctgaaaattggatacgaatgtctctgccctgatggatttcagcttgtggcgcagagacggtgtgaggacattgatgaatgtcaggatccagatacttgctcgcagctgtgcgtgaacctggaaggcggttataagtgccaatgcgaagaaggttttcaactggatcctcataccaaggcatgtaaggcagtggggtcgatcgcctaccttttctttaccaaccgccacgaagtgagaaagatgactcttgacagatcagaatacacctcactgatccctaacttgcggaacgtggttgcgctcgatactgaagtggcatccaaccgcatctactggagcgacctgtcgcaacgaatgatctgctcgacgcaactggacagagcccatggggtatcgtcctacgacacggttatatctagggatattcaagcaccagatggactggcagtcgattggattcattcgaacatttactggactgattccgtcctgggaactgtgtccgtggccgacactaaaggagtgaagagaaaaaccctgttcagagagaatgggtcgaagcctcgggcaatcgtggtggatccagtccatgggtttatgtactggacggactggggcactccagccaagattaagaagggtggactcaacggcgtggatatctactcccttgttactgagaacattcagtggcctaacggtatcaccctggacctgctttccggaaggctctattgggtcgactcaaagctgcattcgatcagctcgattgacgtgaacgggggcaataggaaaacgatactggaagatgaaaagagacttgcacaccccttttcccttgcggtgttcgaagataaggtgttctggactgacattatcaacgaggccattttctcggcaaatcgcctgaccggctccgatgtcaacctgcttgcagagaacttgttgtcccccgaggatatggtgctgttccataacctgacccagccacgtggggtgaactggtgtgaaaggactactctctcaaacggtggctgtcagtacttgtgtctgccagcacctcagattaatcctcattcgcccaagttcacctgtgcgtgcccagatggaatgcttctcgccagagatatgcgctcttgtcttactgaagcagaagcagcggtggccactcaggaaacctctaccgtgcgcctgaaagtttcgtcgactgccgtgcggacgcaacacactaccaccagaccggtgcctgatactagccggctgcctggtgctactcctgggctgacgaccgtggagatcgttactatgtcacaccaggcactcggtgacgtggcaggtaggggaaatgaaaagaagccttcctcggttcgtgcactctcgatcgtgcttcccattgtccttcttgtttttctgtgtctgggcgtgttcctcctttggaagaactggaggttgaagaacattaactcgattaacttcgacaacccagtgtaccaaaagacgaccgaggacgaagttcacatctgtcataatcaggatggttactcctacccctcgcggcaaatggtcagcctggaggacgatgtggca

SEQ ID NO: 493 - DNA, 2580 bp, Artificial Sequence
  Description of Artificial Sequence: Synthetic Transcript Sequence
atgggcccctgggggtggaagctgcggtggaccgtggccttattgcttgcagctgctggaacagcagtgggagatagatgcgagcgaaacgagttccagtgccaggacggtaaatgcatttcctataagtgggtgtgcgatggaagtgccgaatgccaggatgggtctgacgagagccaggagacatgtctgtccgtgacctgtaaatccggtgatttctcctgcggcggaagagtgaatcggtgcattccgcagttctggcgttgcgacggtcaagtggactgtgataatggtagtgatgagcaaggctgcccccccaaaacctgctcccaagacgaatttcgctgccatgatggaaaatgtatctcaaggcaattcgtgtgtgacagtgatagggactgccttgacgggtccgacgaagccagctgccctgtgttgacctgcggccccgcatctttccaatgcaactccagcacctgtatcccacaactgtgggcttgtgacaatgaccctgattgcgaagatggatcagatgaatggccacagaggtgtcgtgggctgtatgtgtttcaaggagatagcagcccttgctccgctttcgaatttcattgcctgagcggcgaatgtatccacagcagttggcgatgtgatggaggacctgactgtaaagataagtcagacgaggaaaactgcgctgtcgcaacatgtagaccagacgagttccaatgctccgatggaaactgtatccacgggagccgccagtgtgacagggaatacgactgcaaagacatgtcagatgaagtgggatgtgtcaacgtcaccctgtgcgaggggcccaataaattcaagtgccacagtggagagtgcatcacacttgacaaggtgtgcaatatggctagggattgtagggactggagcgacgaaccgataaaagagtgcgggactaatgcatgccttgacaacaacggtggatgttcccatgtgtgtaacgatctcaaaattgggtacgagtgcctgtgtcccgacggatttcaactggtggcccagcgcaggtgcgaagacatagacgagtgccaggatcctgacacttgtagccaactctgcgtgaacctggagggaggctataagtgccagtgcgaggagggatttcagcttgacccacatacaaaggcttgtaaagcagtcggctccatcgcatatctgttttttaccaaccgccacgaggtcagaaaaatgacactagataggtcagaatatacctctttgattcccaacctccggaacgtggtcgcactggacaccgaggtcgcctcaaacaggatttattggagcgacctgtcacaaaggatgatttgttctacgcagctggacagagcccacggcgtaagttcttacgacacagtcattagcagagatatccaagcaccggacggtctggcagttgactggatccatagcaacatttactggactgacagcgtgctgggaacggtgtcagtcgcagacaccaagggggtgaaacggaaaaccttgttccgcgagaacggatctaaacccagggcgatcgtggtggatccggtacacggatttatgtattggacagattggggcacccccgccaagatcaaaaaaggcgggcttaacggcgtggacatatatagtttggtaaccgagaacatccagtggccgaatggcatcacattggacctcctcagcgggaggctttactgggtggactctaagctgcatagcatctcttctattgatgtgaatggcgggaaccggaaaactattctggaggacgagaagagactcgcacacccattcagcctggccgtcttcgaagataaggttttttggaccgatattattaacgaagccatcttttctgctaataggctcaccggatcagatgtcaatctcctggctgagaacctgctgagtccagaagacatggtgctgttccataatcttacacaacctaggggcgtcaactggtgcgagagaacaacacttagcaacggaggctgccaatacctgtgtctccccgctccccagataaacccccactcgccaaaatttacttgcgcttgtccagatggaatgctgctggcaagggatatgagatcgtgcctaactgaggcagaagcggctgtggctacacaggagactagcacagtgcggttgaaggtgtcctcaaccgctgttaggactcagcacaccactacaaggccagttccggatacctcacgtctacccggagccactccaggtctgaccaccgttgagatcgtaactatgagccatcaggctcttggcgatgttgccggccgaggtaacgaaaaaaaacccagctcagtgagagcattgagcattgtgttaccaatcgtcctgttagtctttctttgtttgggcgtctttcttttgtggaagaactggagactcaaaaatatcaattccatcaactttgacaatcccgtttatcaaaaaaccaccgaggacgaagtccatatctgccacaatcaagacggatactcctacccaagcagacagatggtgagcttggaagatgacgttgcg

SEQ ID NO: 494 - DNA, 2580 bp, Artificial Sequence
  Description of Artificial Sequence: Synthetic Transcript Sequence
atgggcccttggggatggaaactgaggtggaccgttgccttgcttcttgccgcagccgggaccgccgtgggagaccgttgcgagcgtaacgaattccagtgccaggatgggaaatgtatatcttataaatgggtgtgcgatggcagcgcagaatgccaggacgggagtgatgaatcacaggaaacttgtctgtccgtcacctgtaagtcgggcgatttttcctgtggtgggagggtgaaccggtgtattccccagttctggcgctgcgatggccaggtggactgtgataacggctctgacgagcagggctgtcctcctaagacctgttcccaggacgagtttagatgtcacgatgggaagtgcattagcaggcagttcgtctgcgattctgaccgtgattgcctggatgggtcagatgaggccagctgtcctgtattgacttgtggtccagcctcctttcagtgtaatagttctacctgtattccccagctgtgggcttgtgacaacgatcctgactgcgaggacggttctgatgagtggccccaacgatgtagaggcctgtatgttttccagggtgacagctctccctgctcagcctttgagttccactgcctatccggggaatgtatccactcttcatggagatgcgacggggggccagactgcaaagacaagagcgacgaggagaactgcgctgtggccacttgcaggccagatgaattccaatgctcagatggcaactgcattcacggtagccggcagtgcgaccgcgagtatgactgtaaggacatgagtgatgaggttgggtgtgtcaatgtaactttgtgcgagggtccgaacaagttcaagtgtcatagtggagagtgtatcacactggataaggtctgcaatatggcccgagactgtagggattggtcagatgaacccatcaaagagtgtggtacgaatgcgtgcctggataacaacggagggtgcagtcacgtgtgtaacgacctcaaaatcggatatgaatgcctttgtcccgatgggttccaactggtggcccagaggaggtgtgaagacattgacgagtgccaggaccctgatacttgcagtcagctgtgtgtgaacctggagggaggttataagtgccagtgtgaggaaggattccaattggacccacatacaaaagcatgcaaggcggtaggatcgatagcttatctgttcttcacgaaccgccacgaggtgcggaaaatgacactagatcggagcgagtatacatccctaatcccgaacctgaggaatgtcgtagcattagacacagaagtcgctagtaatcggatctattggtccgatctgtctcagcggatgatctgcagcacgcagctcgatcgggctcacggggtgtcttcctacgataccgtgatctctcgcgacatccaggccccggacggactggccgtcgactggattcactcgaatatctattggaccgacagcgtgctaggtacagtcagcgtggctgacaccaagggcgtgaaaagaaaaacactatttcgggagaacggatctaagcccagagctattgtcgttgatccagtccatggcttcatgtattggactgactggggcaccccagccaaaatcaagaaaggggggctcaatggtgttgatatatatagcttggtgactgaaaacattcaatggccaaacggaatcacactcgacctgctatccggaagactgtattgggtggactcaaaactgcatagcataagtagcatcgatgtcaacgggggcaacagaaaaactatattggaagatgagaaacgcttggcccaccctttcagcctggcggtctttgaggataaggtgttttggactgacattataaacgaggctatcttctccgcaaatagactcactggatctgacgtgaacctgctagccgaaaacctcctttcacccgaagatatggtcctctttcataacttaacacagccccgaggtgtgaattggtgtgagcggaccaccctgtccaacggcggatgccagtacctgtgtctgcccgcaccccaaattaacccacatagtcccaagtttacttgtgcatgccctgacgggatgcttctggccagagatatgagaagctgtcttactgaggcagaggccgccgttgcgacccaggagacttccactgtgcgtctgaaggtcagttctacagccgtgcggacccaacataccactacccgaccagtacctgatacatctcggttgccaggcgcgacccccggcctaaccactgtggaaatcgtcactatgtcacaccaggctcttggagatgtggctggtagaggaaacgagaaaaagccctcgagtgtgagggctctgtctattgtgcttcctatagtcttgctggtcttcttatgcttgggcgtgttcctgctgtggaagaattggaggctgaaaaatatcaactctattaacttcgacaatcctgtgtatcagaagacaacagaagacgaggtgcacatatgccacaaccaggacggttatagttatcctagtcgccagatggtgtcgttagaggatgatgtcgcc

SEQ ID NO: 495 - DNA, 2580 bp, Artificial Sequence
  Description of Artificial Sequence: Synthetic Transcript Sequence
atgggcccttggggatggaaacttcggtggacggtggcactgctgctcgcagccgcgggaactgccgtcggggaccggtgcgaacgcaatgaattccaatgccaagatggaaagtgtatcagttacaagtgggtgtgcgacgggagcgcggaatgtcaggatggaagtgacgagagccaggaaacttgcctttcagtcacgtgtaaatcaggcgacttcagctgcggtggccgagtcaacaggtgcatcccgcagttctggcggtgcgacgggcaggtggattgtgacaacggcagcgacgagcagggttgtcctcctaagacgtgctcgcaggacgaattcaggtgccatgatggaaaatgcatcagccggcagttcgtctgtgactccgaccgggattgcctggacggctccgacgaggcaagctgcccagtgttgacttgtggaccggcctccttccaatgcaacagctccacttgcatcccccagctgtgggcgtgcgacaacgatcctgactgcgaggatggttcagatgagtggccgcagcgctgccgcggactgtatgtgttccagggggatagttcgccatgttccgccttcgaattccattgcttgtccggagaatgtattcactcgtcctggcgctgcgacggaggaccagattgcaaggacaaatcggacgaggaaaattgcgctgtggctacctgccggcccgacgaattccagtgctccgacggaaattgcatccacggatcgcgccaatgcgatagagaatacgactgcaaggatatgtctgacgaagtgggatgcgtgaacgtgactctgtgcgagggtccgaataagttcaagtgtcactccggagagtgcatcacgctggacaaggtgtgtaacatggcgagagattgtagagactggagcgacgaacctatcaaagagtgcggcactaacgcatgcttggacaataatggcggatgttctcacgtctgcaatgatctgaaaatcggttacgagtgtctctgcccagacggcttccagctggtcgcgcagcgccgctgcgaggatatagacgaatgtcaggacccagacacctgttcgcaactctgtgtgaacctcgaaggaggctacaagtgccaatgcgaagagggctttcagctcgatccgcataccaaggcgtgcaaggcagtgggtagtatcgcctacctgtttttcactaaccggcatgaagtgcgcaaaatgactctggacagaagcgagtacacctccctgatcccgaacctgcggaacgtggtcgccctggacaccgaggttgcatccaataggatctactggtcggacctgagccagagaatgatctgctccacccaattggatagagcgcatggagtctcctcctacgatactgtgatctcgagggatatccaagctccagacggactcgctgtcgactggattcactcgaacatctactggactgattcggtgcttggcaccgtgtccgtggcagataccaagggcgtaaagcggaaaactctcttccgcgaaaacgggtcgaagccgcgcgccattgttgtggacccagtccacgggttcatgtactggaccgactggggaaccccagccaagatcaaaaaaggcggattgaatggagtggacatctacagccttgtcaccgaaaacatccaatggccgaatggaatcactctggatcttctctcagggcgcctgtactgggtggactcgaaactccactcgatttcctcaatcgacgtgaacggtggcaaccgcaagaccatcctcgaggacgaaaagcgcctggcacatccgtttagccttgccgtgtttgaggataaggtgttctggaccgacatcattaacgaggccatctttagcgccaataggctgactggatcggatgttaatcttctggcggaaaaccttctgtcacctgaggacatggtcctctttcataatcttacccagccgcgcggtgtgaactggtgcgaacgaaccactctctcgaatgggggatgccagtacctctgcctgccggcgccacagatcaacccgcatagcccaaagtttacttgcgcttgcccggacggtatgctgttggctcgggatatgcgctcttgcctgactgaagccgaggccgcggtggcgactcaagaaacctccacggtgcggctgaaggtatcatcaaccgccgttagaactcaacacactaccacccgccccgtgccggacacctcacggttgccaggagccacccccggactgaccaccgtggaaattgtgactatgtcacaccaggcactcggagatgtggccgggcggggaaacgaaaagaagccgtcatccgtcagggctctgagcattgtgctccctatagtgctgctggttttcttgtgcctgggagtgttcctgctgtggaagaactggcgactgaagaacatcaactcgatcaacttcgacaaccccgtctatcagaaaaccacggaggacgaagttcacatctgccacaatcaagacggctactcgtaccctagtagacagatggtatcgctcgaggatgatgtcgcc

SEQ ID NO: 496 - DNA, 2580 bp, Artificial Sequence
  Description of Artificial Sequence: Synthetic Transcript Sequence
atgggaccttgggggtggaagttgaggtggacggtagcacttctcttagcagctgctggaaccgctgtgggggatagatgcgagcgtaatgagtttcagtgtcaggacggcaagtgcatctcatacaagtgggtctgtgacgggagcgcagagtgccaagatggctcagacgagtcccaggagacgtgtttatctgtgacttgtaagagtggtgacttttcctgcggcgggcgcgtcaatcgatgtattcctcagttctggaggtgcgacggtcaggttgactgcgataacgggtcggacgagcagggatgtcccccaaaaacttgttcacaggatgaattccggtgccacgatggaaagtgcatcagccgtcagttcgtgtgtgactcagaccgcgactgtctggatgggtcagacgaagcatcatgccccgtcttgacttgtggaccagctagtttccagtgcaactccagcacatgtattccccagctatgggcctgcgataacgatccagattgcgaggatggatccgatgagtggccccaaaggtgcaggggcctgtatgtgttccaaggagactctagcccttgtagtgcattcgagttccattgcttgagtggggagtgcattcatagcagctggcgatgcgacggcggtcctgactgtaaggacaaatccgatgaggagaactgcgcagtagccacgtgccggccagatgagtttcagtgctccgatggaaactgtatacatggaagccggcaatgtgatcgggaatacgattgtaaggatatgtctgacgaggtgggttgtgtgaatgtgactctctgcgaaggcccaaataagttcaaatgccatagcggcgaatgcatcacattggacaaagtctgtaatatggcccgagactgccgagactggagtgatgagcccattaaggaatgcggcaccaacgcatgcctggacaacaacggagggtgttctcatgtgtgtaacgacttaaagatcggttatgaatgtttgtgccccgatggcttccagttggtggcccagcgccgatgtgaggatatcgatgaatgtcaggaccctgatacctgcagccagctgtgcgttaatctagaaggtggatacaaatgccagtgtgaggaaggctttcaattggacccacacacgaaagcatgcaaagcagttgggtcaattgcgtatctgtttttcacgaatcggcatgaggttagaaagatgacgctggaccgaagcgagtacacaagcttaatcccgaatttgcgcaacgttgtcgcgctggatacagaggtcgcatccaataggatttactggtctgacctgagtcagaggatgatctgcagcacacagttggaccgcgctcacggagtttccagctacgacacggtgatctcgagagacatacaagctcctgatggcctagctgtcgattggatccattctaatatttactggactgacagtgtgctcggaacagtctcggtggctgacaccaagggggtcaaacgcaaaaccctcttccgcgaaaacggctctaagccaagggctatcgtggtggaccccgtccatggcttcatgtactggaccgattggggcacccctgccaaaattaagaaggggggcctgaacggggtggacatttactccttagtgactgagaatattcagtggcctaatggcattacgttggacctgctgtctgggcggctatactgggtggacagcaagctgcatagcatcagcagcatcgatgtgaatggtggaaatcggaaaacaatcttggaggatgaaaagcgcttggcacacccgttcagtctcgccgtgtttgaagacaaggtgttttggacggacattatcaatgaggccattttctcagccaacaggttgactggtagtgacgtgaatctcctcgccgagaacttgctttcacctgaagacatggtccttttccacaatcttacccagccccgcggagtgaactggtgcgagagaactaccctcagtaatggtggctgtcagtatctttgcctacccgcaccacaaataaaccctcatagtcccaaatttacctgcgcttgccctgacgggatgttattggctagggacatgcgcagctgtttgacagaagctgaggcagccgtcgctacacaggagactagtactgtgcggctgaaagtcagcagcactgcggtgagaacccagcacaccacaacacggccagtaccagatacaagtaggctccccggcgccactcctggtctgaccaccgtggaaatcgtcaccatgtcccaccaggcactgggagatgtggcaggccgcggtaacgagaagaaacccagtagcgttagggccctgagcatagtgctgcccatcgttttactggtgtttctgtgtttgggcgtttttctcctgtggaaaaattggaggctcaaaaatatcaattctatcaatttcgataaccccgtgtatcagaagacaacagaggacgaggtccacatttgtcacaatcaagatgggtactcatacccctcacgacagatggtctccttagaagacgacgtggct

SEQ ID NO: 497 - DNA, 2580 bp, Artificial Sequence
  Description of Artificial Sequence: Synthetic Transcript Sequence
atgggcccatggggatggaaactgagatggacggtcgccctcctgctagctgccgccggcactgctgtgggggaccggtgtgagcggaacgaattccagtgccaggatggcaaatgtatatcctataagtgggtgtgcgacggcagtgctgagtgccaagacgggagcgacgagtctcaagagacctgtctaagtgtcacctgcaagagcggcgatttcagctgtggcggccgagtgaaccgctgcataccacaattctggcggtgcgatgggcaggtcgactgcgacaacggatccgatgaacagggatgcccaccaaagacctgttcccaggatgaattcaggtgtcatgatggtaaatgcatttcgagacagtttgtgtgtgactctgatcgagactgcctcgatggctccgacgaggcatcctgccccgtgctgacatgtgggcccgcatcctttcaatgcaatagtagcacttgtatacctcagctgtgggcatgcgataacgacccagattgtgaggacgggagcgatgaatggccgcagaggtgtaggggactgtacgtgttccaaggagatagctccccctgctccgccttcgagttccactgtctcagtggggagtgtatccactcgagctggaggtgcgacggcggtcccgactgtaaggacaaatcggatgaggagaattgcgcggtggccacctgtagacccgacgaattccagtgctccgatgggaactgtatacacgggtcgcgacagtgtgaccgggagtatgactgcaaggacatgtctgacgaagtggggtgcgttaacgtgactctgtgcgagggtcctaacaagttcaagtgccacagcggcgaatgcattacgctggacaaagtatgcaatatggcgagagattgtcgagactggtccgacgagcccatcaaggagtgcggcactaatgcctgtctagataataatggcgggtgttcccatgtctgcaatgatctcaaaattggctatgaatgtttgtgtcccgatggatttcagttggtggcccaaagaaggtgtgaagacattgatgagtgtcaggatccagacacatgttcccaactctgtgtgaatttggagggcgggtataagtgtcagtgtgaggagggcttccagctcgacccccacacgaaggcttgcaaagccgtcggcagtatcgcctacctgttttttacgaaccgtcacgaagttagaaagatgacactagaccgctcagagtacacttccctgattcctaatttacgtaacgtagtagctctggacacggaagttgcttccaacaggatctattggagtgacctgtcccagaggatgatatgttccacccagctcgaccgtgcccacggggtgtcctcatatgacacagtaatatcccgggacattcaggccccagatggcctggccgtcgattggattcactcaaacatatactggactgactcggtgcttggcaccgtgtctgtggcagataccaagggagtgaagcgaaaaaccctgtttagggagaatggatcaaaacccagggccatcgtcgttgaccctgtgcatgggttcatgtactggacagactggggcacacccgctaaaatcaaaaaagggggcttaaacggagtggacatctactccctcgtgaccgagaacatacagtggcctaacggtataacacttgacctattatctgggaggctctattgggtggattctaaactgcactctatttccagcatcgatgtcaacgggggaaacaggaaaaccatcctggaagatgaaaagcggttggcccaccctttttctctcgctgtgttcgaggacaaggtattctggactgatattatcaacgaggccatctttagcgcaaatcgcctgaccggatctgatgtgaatcttctggcagagaatctgctctcccccgaggatatggtgctctttcataacttaacacagccgcgcggtgttaactggtgcgagcggacaactctgtctaacgggggctgtcagtatctttgtctgccggcaccacagatcaacccgcactcccctaagttcacgtgcgcatgtcccgatgggatgttgctcgcccgggacatgcgctcctgcctcaccgaggccgaagctgcagttgctactcaggagacctcgacagtgagacttaaagtcagcagcacagccgtgcgcacccagcacacaacaactagacccgtgcctgacacttctcgactcccaggtgcaacgcccggcctgacaactgtcgagatagtgaccatgagtcaccaggcccttggggacgtcgccggacgggggaacgaaaagaagccctctagcgtcagggcactgtcaatcgttctgccaatcgtgctgctggtgtttctgtgcctgggcgtcttcctattatggaagaactggcgcctgaagaacatcaactctataaattttgacaaccccgtctaccagaagacgacagaggacgaggttcatatctgccacaatcaggatggctattcttatccctctaggcagatggtgagcctcgaggacgacgtggcc

SEQ ID NO: 498 - DNA, 2580 bp, Artificial Sequence
  Description of Artificial Sequence: Synthetic Transcript Sequence
atgggaccctgggggtggaagctgcgctggacagttgctcttctactggctgctgctggaactgcagtgggagaccggtgtgaacgaaacgagtttcaatgccaagacggcaaatgcatatcctacaaatgggtttgtgacggctccgccgagtgccaagacgggtcagacgaaagtcaggaaacatgcctaagcgtgacatgcaagtcaggggatttcagctgcgggggccgagtaaaccgctgtattccacaattctggaggtgcgacgggcaggtggattgcgacaacggatccgatgagcaaggatgtccccccaaaacatgctctcaggacgagttcaggtgccatgacggcaagtgcatctcgcgacagtttgtctgcgactccgatagggactgcttggatgggtcagacgaggcttcctgtcctgttttgacttgtggaccagcctcgtttcagtgcaacagttcaacttgtataccccagctatgggcctgtgacaacgatccggattgcgaagatggcagcgacgaatggccccagaggtgcagaggcctatatgttttccaaggagactcctccccttgctccgcttttgagtttcactgcctgagcggggaatgtatccattccagctggagatgcgacggtggtcctgactgtaaggacaaaagcgatgaagaaaactgtgccgttgctacgtgccgccccgacgaatttcaatgcagtgatggaaattgtatccatggctcacgccagtgcgatcgagagtatgattgcaaggatatgtctgatgaggtggggtgcgtgaacgtaactctgtgcgagggccccaacaagtttaagtgccatagcggggagtgtatcacgcttgataaggtatgtaacatggcccgagactgccgagactggagcgatgaacctattaaagaatgcggtactaacgcctgcctcgacaacaacggaggctgtagccatgtgtgtaatgacctgaagatcggctacgagtgtctgtgtcctgacggattccagttggtggctcagcgacgatgcgaagatatagatgagtgccaagaccccgacacttgtagccagctctgcgtcaatttggaaggggggtataagtgccagtgtgaagaaggctttcagctggatccccacacaaaagcttgtaaggccgtgggatccatcgcgtatctgttcttcaccaacaggcacgaagtcaggaagatgaccctcgatcggtctgagtacacctcacttattccaaacctgaggaacgtggtagccttagataccgaggttgcctcaaatcggatatattggagtgacctgtctcagagaatgatctgctcaactcagctcgacagagcacacggtgtttccagttatgacaccgtgatctcgagagacatccaagcccccgatggcctggccgtggactggattcactcgaatatctactggacagactcggtgctggggacggttagtgtggccgacaccaagggtgtgaaacgaaagaccttgtttagggagaatggctcaaaaccacgggccatagttgtcgatcctgttcatggattcatgtactggaccgactgggggacgccggcgaagataaaaaagggcgggctgaacggcgtggacatctactctctggtcactgaaaatatacagtggccaaacggaatcaccctggatctgttgagcggccgactctattgggtggatagtaaactccattccattagttcaattgacgtcaatggaggaaacaggaaaaccatcctggaggatgagaagcgactagcccatcccttcagcctagcggtgtttgaagataaggtgttttggactgacatcattaatgaggctattttttccgccaaccgactgaccgggagcgatgtcaatttgctggccgaaaacttgctgagtcccgaagatatggtactgttccacaacctcacccagcctcgtggagttaactggtgtgaaaggactaccctgtccaacggtggttgccagtatctgtgcctccccgcaccccagataaacccccactctcccaaatttacttgcgcatgcccagacggtatgcttctggcaagggacatgaggtcttgtctgaccgaggccgaggcggccgttgccacacaagaaacctctaccgtgcgactgaaagtctcctccacggcagtgcgaactcagcatactacaacaaggcctgtccccgacacaagccgactgccaggcgcaacccccgggttgacgactgttgagattgtcaccatgtctcaccaggccttgggggacgttgccggaagaggcaacgaaaagaaaccaagctccgtccgagctctgtcgattgtgttaccaatagtgctcctggtgtttttgtgcttgggcgtttttctgctgtggaagaattggcggctgaaaaacataaatagcataaacttcgacaatccggtgtaccagaagaccacagaagacgaagttcacatctgccacaatcaagacggatattcctaccctagccggcagatggtctcgttggaggacgacgtggca

SEQ ID NO: 499 - DNA, 2580 bp, Artificial Sequence
  Description of Artificial Sequence: Synthetic Transcript Sequence
atgggcccttggggctggaagctgcgctggacggtggcgctgctgttggcggcagccggtacggctgtgggggacagatgtgagcgcaacgagttccagtgtcaggacggaaagtgtatctcgtacaaatgggtctgcgacggaagcgctgaatgccaggatggcagtgatgaatcacaggaaacctgcctcagtgtcacttgtaagagcggcgacttcagctgcgggggacgcgtgaacagatgcattcctcagttttggcgttgcgacggacaggtggattgcgataacggcagcgatgagcaaggatgcccgccgaaaacgtgtagccaggatgagttcagatgccacgacgggaaatgcatctcaaggcagttcgtgtgcgactcggaccgcgactgtctcgatggctccgatgaagcaagctgccctgtattgacctgcggaccagcatcctttcaatgcaactcgtccacctgcatccctcaactgtgggcctgcgacaacgatccggattgtgaggacggatccgacgaatggccccagcggtgtaggggactttacgtgttccagggggactcgtccccgtgctcagcattcgaattccactgcttgtcaggagagtgcatccacagttcatggcgctgcgatggaggtccggactgcaaggataagtcggatgaagagaattgcgccgtggccacctgcagaccggacgagtttcaatgctccgacggcaattgcatccacggttcccggcagtgcgatcgagagtacgattgcaaggacatgtccgacgaggtgggatgtgtcaatgtcaccctctgtgagggtccgaataagttcaaatgccattcgggtgaatgtatcactctcgataaagtttgcaacatggcccgcgactgccgcgattggtcagacgaacctatcaaggaatgcggaaccaacgcttgcctggataacaacggagggtgttcccatgtctgcaacgacctgaagattggatatgaatgtttgtgccccgacggattccagctcgtcgcccaacgcaggtgtgaggatatcgacgagtgccaggacccagacacctgttcccagctctgcgtgaacttggaaggaggatacaagtgccaatgtgaagaaggatttcaactcgacccgcacaccaaagcctgtaaggcggtggggtccatcgcttatctctttttcactaaccggcatgaggtccggaagatgaccctggatcgcagcgaatacaccagcctcattccgaacctcaggaacgtcgtggcactggataccgaggtggcttccaaccggatctactggtcggacctctctcaacggatgatctgttctacccaattggaccgcgcgcatggcgtgtcgtcgtatgacacggtgatcagccgtgatattcaggcacctgacgggctggcggtggactggatccactcgaacatttactggaccgatagtgtgttgggaactgtctcggtagccgatactaagggagttaaacgtaagactctcttccgggaaaatgggtcgaaaccgcgggccatcgtggttgatcccgtgcatgggtttatgtactggactgactggggcacccccgccaagatcaaaaagggagggctgaatggagtcgacatttactctctcgtcactgagaatatccagtggccaaacggcattactctcgacctgctgtcgggtcggctgtactgggtggattccaaactgcattctatttcgagcatcgacgtgaacggtgggaatcgcaagactatcctggaagatgagaaacggcttgcccacccgttcagtctggccgtgtttgaggacaaagtcttttggactgacataatcaacgaagccatcttctcagccaatagacttaccggaagcgacgtgaatcttctggccgaaaatcttctgtccccggaagatatggtgttgttccacaatctcacccagccgcgaggcgtcaactggtgtgaacgcactaccctgagcaacggaggctgccaatacctgtgcctgcctgcgccgcaaatcaacccacacagcccaaagttcacttgcgcatgcccagatggaatgctgctggcccgggacatgcggtcctgcctgaccgaagctgaagcggccgtggcgacccaggaaacttctaccgtcagactgaaggtgtcctccactgcggtgcggacgcagcatactaccactagaccagtgcctgacacttcgcggctgccaggagccaccccgggtctgacgactgtggaaatcgttactatgtcacaccaggctctgggcgacgtggcaggtagaggaaatgagaagaagccctcctcagttcgcgcgctgtccatcgtgctgccgatcgtgctgcttgttttcctctgcttgggagtgttcctcctctggaagaactggcgcctgaagaacatcaactccatcaatttcgacaacccagtgtaccaaaagacgactgaggacgaggtacacatctgtcataatcaggacggttactcctacccatcgcgccaaatggtgagcctggaggatgatgtcgca

SEQ ID NO: 500 - DNA, 2580 bp, Artificial Sequence
  Description of Artificial Sequence: Synthetic Transcript Sequence
atgggaccgtggggctggaagctgcgctggactgtggccctccttttggcggctgctggaactgccgtgggggaccggtgcgaaagaaacgaatttcaatgccaagacggaaaatgcatctcgtacaaatgggtgtgcgatggatccgcagaatgccaggacggctcagatgagtcacaagaaacctgcctgagcgtgacctgcaagtcgggagacttctcgtgcggcggtcgcgttaataggtgcatcccgcaattctggcggtgtgatggacaggtcgattgcgacaacggctcggacgaacagggttgcccgccaaagacgtgttcacaagacgaatttcgctgccatgacggcaagtgcatctcgcggcagtttgtctgcgatagcgacagagattgtcttgacgggtccgacgaagcatcgtgcccggttctgacctgcgggccagcctcattccagtgcaattccagcacctgtattccgcaactgtgggcttgcgataacgaccccgattgtgaagatggaagcgacgaatggcctcagagatgcaggggcctgtacgtctttcagggcgactcctccccgtgctcggcgttcgaatttcactgcctttcgggagagtgtattcattcctcgtggcggtgcgacggaggacctgattgtaaggataagtcggacgaggaaaattgcgcggtggcgacctgccggcctgatgaattccagtgcagcgatggaaactgcatccacggatcgcgccagtgtgacagggagtacgactgcaaggatatgtctgatgaagtgggatgcgtgaatgtgaccttgtgcgaaggcccaaataagttcaaatgccattccggagaatgtatcaccctcgacaaggtgtgcaacatggccagggactgtcgggattggagcgatgagccgatcaaagagtgcggaaccaatgcttgtctggacaataacggaggatgctcgcacgtgtgcaacgacttgaaaatcggctacgagtgcttgtgcccggacggatttcagctcgtggcccagcggcgctgcgaggatatcgacgaatgccaagacccggacacctgcagccaactgtgcgtgaacctggaaggcggttacaagtgccaatgcgaagaaggatttcaactggacccacatactaaggcctgtaaggccgtgggctcaattgcgtacctgttcttcactaaccggcacgaagtgagaaaaatgaccttggatcgctcagagtacaccagcctcatcccgaacctgcgcaatgtcgtggccctcgacaccgaagtggcatcgaataggatctactggtccgacttgtcgcagagaatgatttgtagcacgcagctggatagagcacacggagtctcatcatacgacactgtgatttcccgggacatccaggccccggatggccttgctgtagactggatccactccaacatctattggactgactcagttctgggaactgtgtcggtggctgacaccaagggcgtcaaacgcaagaccctgttcagagagaacgggagcaagccacgggcgatcgtggtggatccagtgcacggtttcatgtactggactgattggggaactccggcgaagatcaaaaagggaggcctgaatggagtggatatctactcactcgtgactgagaacatccagtggccaaacggcatcaccttggacctgctgtccggtaggctctactgggtggactccaagctgcactcaatcagctcgatcgacgtgaacggaggtaaccgaaagacgatcttggaggacgaaaagaggctcgcccacccattcagcctcgccgttttcgaagataaagtgttctggaccgacatcattaatgaggccatcttctcagccaacaggctcacgggatctgatgtgaacctgcttgctgagaatttgctgtcacccgaggatatggtgctgtttcacaatctgacccagcctcggggagtgaattggtgcgaacggactactctctccaatggcggatgccagtacctgtgcctgccggctccccagatcaatccccatagccctaagttcacgtgcgcgtgtccggacggaatgctgcttgccagggatatgcgctcgtgcctcactgaagcggaggcagccgtggctactcaggagacgtcgaccgtcagattgaaagtatcttcaactgcagtgcggacccagcacaccaccacccggccggtgccagatacctcccggctgccgggtgcaaccccgggactgactacggtggaaatcgtgactatgtcgcaccaagcactcggggatgttgccgggaggggaaacgaaaagaaacctagctccgtgcgggcactgtcgatcgtgcttccaattgtgctgctggtgttcctgtgcctgggggtgttcttgctttggaagaattggcgcctgaaaaacattaactcgatcaattttgacaatccagtgtatcaaaagaccaccgaggatgaagtgcacatctgccacaaccaggacggctactcctacccttcgagacagatggtgtcccttgaggatgatgtggcc

SEQ ID NO: 501 - DNA, 2580 bp, Artificial Sequence
  Description of Artificial Sequence: Synthetic Transcript Sequence
atgggcccgtggggatggaagctgagatggaccgtggcactgctcttagctgcggccggaacagccgtcggagataggtgtgagagaaatgaattccaatgccaagatggaaaatgcatttcgtacaagtgggtgtgcgatggatcagcggaatgccaagatgggtccgacgaatctcaggaaacttgccttagtgtcacatgtaagtctggcgacttttcctgcggaggccgcgtgaaccggtgcataccccagttctggcgctgtgacggacaggtggactgcgataacggaagtgacgaacagggatgtccgcctaaaacctgtagccaggacgaattcagatgtcacgacggcaaatgcataagcagacagttcgtatgcgactcggaccgcgactgtctggatggatcggatgaagcatcctgccctgtgctgacatgcggccctgcaagtttccaatgcaattcaagcacctgcattccccaattgtgggcatgtgacaatgacccagactgtgaggacgggtcggatgagtggccgcagcgatgtcgtggcctgtatgtgtttcagggcgattcatcgccatgctccgcctttgagtttcactgtctttcaggcgagtgcattcattcttcatggaggtgcgacggaggacccgactgtaaggacaagtccgacgaggagaactgcgcagtggcaacctgtaggcctgatgaatttcaatgtagcgacggcaattgtattcatggcagtaggcaatgtgatagggaatacgactgcaaggacatgtctgacgaggtcgggtgtgtcaatgtaacactctgtgagggccccaataagtttaaatgtcactcaggcgagtgcatcacactggacaaggtgtgcaacatggcgcgcgactgccgggactggagtgacgaacctatcaaggaatgtgggactaacgcatgcctggacaataacggcggatgttcacacgtctgcaacgatttgaagatcgggtatgaatgtctctgccccgacgggttccagcttgtggctcagagacggtgtgaggacatcgacgagtgtcaggatccggatacgtgctcccagctttgcgtcaatctagagggcggctataaatgtcagtgtgaggaggggttccagctcgaccctcataccaaggcttgtaaagctgtgggtagcatagcttacctgttcttcactaacagacatgaggtaagaaagatgactctggacagatctgagtacaccagcttgataccgaacttgcgaaacgtcgtggctctggacaccgaggtggcctctaatcgcatttactggtcagacctgagccagagaatgatttgttcaacccagctcgaccgggcccatggcgtgtcatcctacgacactgtgatatcaagggacatacaagcgccagatggattggccgtggactggatccactcaaacatttattggaccgatagtgttctgggcacagtttccgtggcagacaccaagggagtgaagcgaaagacactgttccgggagaacgggagcaagccacgagccattgtggtggaccccgtgcatgggttcatgtactggacagattggggaactcctgctaagattaagaagggaggcttgaatggcgtagatatttactccctggtgaccgagaatatccagtggccaaacggaatcaccttggacctgctgtccggtagactttactgggtggattcgaagcttcatagtatttctagcattgatgtgaacggaggcaatagaaagaccattctggaagacgaaaaacgccttgctcatcctttttctctcgccgtcttcgaggataaggtattctggacagatataattaatgaggccatattctcagccaaccgtttgaccggaagtgatgtcaacctgcttgctgaaaatctgctatccccggaggacatggtgctgttccacaatctgactcagccacgaggagtgaactggtgcgagcgcaccaccctgtccaacggtgggtgccagtacctctgtctgcccgctcctcaaatcaacccccatagccctaagttcacttgcgcctgccctgacgggatgctcctggcacgggatatgaggagttgtctgacagaagccgaggccgcggtcgccactcaagagacgtctaccgtgaggctcaaggtcagctcaaccgccgtccggacgcagcacactacaacccggcctgtgccggatacatctagacttcctggtgcgacccccggcctgacaacagtcgagattgtgactatgagtcaccaagctctcggtgatgtggccggaagaggaaatgagaaaaaaccctcttccgttagagccctaagcattgtgttgccgatagtgctgctagtctttttgtgcctgggtgtattcttattatggaagaattggcgcctgaaaaatattaattccatcaactttgacaacccagtataccaaaaaaccactgaagatgaggtccacatttgtcataaccaggacgggtatagctacccctcaagacaaatggtgtctctggaagatgacgttgcc

SEQ ID NO: 502 - DNA, 2580 bp, Artificial Sequence
  Description of Artificial Sequence: Synthetic Transcript Sequence
atgggaccttggggatggaaattaagatggactgttgcattattactcgcagcagcaggaacagctgtcggggatagatgtgaaagaaatgaatttcaatgtcaggacggaaaatgtatttcatataaatgggtttgtgatggatcagcagaatgtcaggatggaagtgacgaaagtcaggaaacatgcttgtctgtaacgtgtaaatcaggagattttagttgtggagggagagttaatcgttgtattcctcaattttggagatgtgatggacaagtagattgtgacaatggatctgatgaacaaggatgtccaccaaaaacttgttctcaagatgaatttagatgtcatgatggaaaatgtatttctagacaatttgtttgtgatagtgatagagattgtttagatggatcagatgaagcatcttgtccagttttaacatgtggaccagcatctttccaatgtaattcttcaacttgtattccacaattatgggcttgtgataacgatcctgattgtgaagatggttcagatgaatggccacaaagatgtagaggtttatatgttttccaaggagattcatcaccatgttcagccttcgaattccattgtctttcaggagaatgtatacattcatcatggcgttgtgacggaggacctgactgtaaggataaatcagatgaagaaaattgtgctgttgcaacttgtagaccagacgagtttcaatgttcagatggaaactgtattcatggatcaagacaatgtgatcgtgaatatgattgtaaggatatgagtgatgaagttggatgtgttaatgtaacattatgtgaaggtcctaataaatttaagtgtcattcaggagaatgtattacattagataaagtttgtaatatggctagagattgtagagattggtcagacgaaccaataaaggaatgtgggacaaatgcatgtttagataataatggaggttgtagtcatgtatgtaatgatttaaaaattggatatgaatgtttatgtccagatggatttcaacttgtagctcaaagaagatgtgaagatatagatgaatgtcaagatcctgatacctgttcacaattatgcgttaatttagaaggtggatataaatgtcaatgtgaagaaggttttcaattagatccacatactaaagcatgtaaagcagtaggatcaattgcttatttattctttacaaacagacatgaagttagaaaaatgacattagatagatcagaatatactagtcttatcccaaatttgagaaatgtagttgctcttgatacagaagtcgcttctaatagaatatattggtcagatctttcacaaagaatgatttgttcaacacaattagatagagctcatggagttagtagttatgatactgttatttctagagatatacaagcaccagatggattagcagttgattggattcattctaatatctattggacagatagcgttcttggaactgtatcagttgcagacacaaaaggagttaaaagaaaaacacttttcagagaaaacggaagtaaaccaagagctattgtagttgatcctgttcatggatttatgtattggacagattggggaacacctgcaaaaattaaaaaaggaggattaaatggagttgatatttattccttagttacagaaaacattcaatggccaaatggaattacattagatttattgagtggtagactttattgggttgattctaaattgcattctatttcatcaattgatgtaaatggtggaaatcgaaaaactattcttgaagatgaaaagcgtctcgcacatccattttcattggcagtatttgaagataaagttttttggactgatattattaacgaagcaattttctctgccaatagacttacaggtagtgatgttaatttattagctgaaaatcttcttagtccagaagacatggtattatttcataatttaactcaaccaagaggagttaattggtgtgaaagaacaacacttagtaatggaggttgtcaatatctttgcttaccagcaccacaaattaatccacattctccaaagtttacatgcgcatgtccagatggaatgttattagctagagatatgagaagttgtcttactgaggctgaagctgcagtagccacacaagaaacttcaactgttagattaaaagtttcatcaacagcagttagaacacaacacacaacaacaagaccagtaccagatacttcacgtctaccaggagcaacaccaggattaaccactgttgaaattgttactatgagtcatcaagctttgggagatgtcgctggaagaggaaatgaaaaaaaaccatctagtgttagagctttatccattgttttacctattgtattattggtttttttatgtttaggagtttttcttttatggaagaattggagattaaaaaatataaattctataaatttcgataatccagtctatcaaaaaacaacagaagatgaagttcatatatgtcataatcaagatggatattcttatcctagtagacaaatggttagtcttgaagatgatgttgca

SEQ ID NO: 503 - DNA, 2580 bp, Artificial Sequence
  Description of Artificial Sequence: Synthetic Transcript Sequence
atgggtccctggggatggaagttaagatggaccgtggcccttctgctcgccgctgccgggaccgctgtgggagacaggtgtgagagaaacgagttccagtgtcaagatgggaagtgtatatcgtataagtgggtatgcgacgggtctgcggagtgccaggacggttcggacgagagccaggaaacttgcttgtccgttacatgtaaatctggagacttctcctgcggcggccgggtgaatcggtgcataccccaattttggcggtgcgacggccaggtggactgtgacaatggctcggacgaacaggggtgtccgccaaagacttgttcacaggacgaattcaggtgtcacgatggtaagtgtatcagccgccagttcgtgtgcgattctgatcgggactgcctggatgggagtgatgaggcctcgtgccccgtattaacttgcggaccggccagcttccagtgtaatagttccacctgcattccacagctctgggcatgtgataacgacccggattgcgaggacgggtcagatgaatggccccaaagatgccggggactgtacgtgtttcagggcgacagtagtccatgtagtgcatttgagtttcactgtctgagtggagagtgcatccatagctcgtggcgctgcgacggcgggccggactgtaaagataaaagcgacgaagagaactgcgctgttgccacgtgccgccctgatgagttccagtgcagcgatgggaactgtattcacggctcgcgtcagtgcgatcgagagtatgactgtaaagacatgtctgatgaggtagggtgcgtgaatgtaacactgtgtgagggaccgaataaatttaaatgtcattctggggaatgcatcaccctggataaggtatgtaacatggcacgggattgtagggattggtccgatgagcccatcaaggagtgtggcacaaatgcttgcctcgacaataatggcgggtgcagccatgtgtgtaatgatcttaagattgggtatgagtgtttgtgcccggacggcttccagctggtcgctcagaggcggtgcgaggatatagatgaatgccaggatcccgacacttgttcgcaactgtgcgtgaatctagaggggggatacaagtgtcaatgtgaggagggctttcagctggacccccacaccaaggcttgtaaagccgtgggtagtatagcctatctgttcttcaccaaccggcacgaggtccggaaaatgacactggataggagtgaatacacgagcctcatcccaaatcttcgcaatgtggttgcgctagatacggaagttgccagcaacaggatatattggtctgatctgtctcagcggatgatctgttcaacccagcttgaccgcgcacacggcgttagttcatatgataccgttattagccgagacatccaagcccctgacggtcttgccgtagactggatccacagtaacatttactggacggactccgtactgggaaccgtttcagtggctgataccaagggcgtcaagcggaaaacactttttcgcgagaatggaagcaaaccaagggcaattgtggtagatccggtgcatgggtttatgtactggacagactggggaaccccagcgaaaatcaaaaagggcggcctgaatggtgtggatatatatagcctcgttaccgagaatatccagtggccaaacggcatcactcttgatctgctttcgggacggttgtattgggtggactctaagctccactccatatcctcaatcgacgtaaatggggggaatcgcaagactattctagaagatgagaaacgtctagcccatcccttctctctggctgtcttcgaagataaagtcttctggaccgatattatcaatgaggccatctttagcgccaacagactcaccgggtcagacgtgaacctgctcgctgagaacttgctgagtcctgaggatatggttctctttcacaacttgacccagcctcgaggagtaaattggtgtgaaagaaccacgctttccaatggtggctgccagtacctctgtctcccagctccacaaattaatccccatagtcctaagttcacctgcgcttgtcccgacgggatgctgctagctcgggatatgaggtcatgcctaaccgaggctgaggccgccgtagccacccaggagacatcaaccgtgcggctgaaagtgagttctaccgcagtccgaacacagcacactactaccagacccgtgccagacacctctagactgccgggggctacaccaggtctgacaaccgtggaaattgtgacaatgtcccatcaagcgttaggggatgttgccggacggggcaatgagaagaaaccctcatccgtgcgcgccctctccattgtcttgcccattgtcttattagtattcctgtgtctaggcgtttttctgttatggaaaaattggagactaaaaaacatcaacagtattaattttgacaacccggtttatcagaagacaaccgaggacgaggtccatatctgccataatcaagatggttactcataccctagccgccagatggtgtcactggaggacgatgtggcc

SEQ ID NO: 504 - DNA, 2580 bp, Artificial Sequence
  Description of Artificial Sequence: Synthetic Transcript Sequence
atgggcccgtggggatggaaacttcggtggacagtcgctcttttgctcgcagctgcaggcacggccgtaggagacaggtgcgagagaaatgaattccagtgtcaggacgggaaatgcatttcatataagtgggtgtgcgacggctccgctgagtgtcaagacggatcggacgagagccaggagacgtgcctgagcgttacttgcaagtcgggagacttttcatgtgggggacgcgtgaaccggtgcattccccagttctggcggtgcgacggtcaggtggattgcgataatggttctgatgagcagggttgcccgccgaagacctgttcccaggatgagttccggtgccatgatggaaaatgtataagcaggcagttcgtttgcgactcagatcgggattgtcttgacgggtccgatgaagccagctgccccgtgttgacatgcggcccggccagtttccagtgcaattcctcaacatgcattccccagttgtgggcctgtgacaacgaccccgactgcgaagacgggtcagacgaatggccccagaggtgtaggggcctttacgtgttccagggtgattcttctccttgctccgccttcgagttccactgcctgtctggcgaatgcatacattcttcctggcgttgcgacggcggccctgactgcaaagacaaatctgacgaggagaactgcgccgttgcaacttgcagaccggacgaattccaatgttccgatggcaactgtattcacggtagcagacaatgtgaccgcgaatacgactgtaaggacatgtcggacgaagtcggctgcgtcaacgtgactctgtgtgagggcccaaataagtttaagtgccacagtggggagtgtatcacgctggataaagtgtgtaatatggccagggattgtcgcgattggtcagatgagcccataaaggaatgtggaacgaatgcttgcctggataacaatggcggatgtagtcatgtgtgtaacgatttgaaaattgggtacgagtgtctgtgtcctgacgggtttcagcttgtggcccagcggaggtgcgaggacatagatgagtgtcaggaccctgatacttgctcgcaactgtgcgtgaatctagaaggcgggtataagtgtcaatgtgaagagggctttcaattggaccctcatacaaaggcctgcaaggcggtgggaagcatcgcttacctgttttttactaaccggcacgaggtgagaaagatgacactggaccggagcgagtacaccagtcttattccgaacctgaggaacgtggtcgcccttgatacggaggtggcctctaatcggatctattggtccgatctatctcaacgcatgatttgcagtacccagttggatcgcgcacacggcgtgagttcgtacgacacggtgatctcgagagacatacaggccccagatggactagccgtggattggatacacagcaacatctactggacagatagcgttctggggaccgtgtctgtcgccgatacaaaaggcgtgaagagaaagacgcttttccgggagaatggctctaaaccacgggctatagttgtggacccagtccatggcttcatgtactggaccgattggggaacacccgcgaagatcaagaagggaggcctcaacggggtggatatatactccctggtgactgaaaatatacagtggccaaatggcattaccctggacctcttatcaggtagactgtattgggtcgactcaaagctgcactccatttctagcattgatgtgaatggtggcaaccgtaagactattctcgaagacgagaagagactggcacatcctttctcacttgcggttttcgaggacaaagtcttctggacagacatcatcaatgaagctattttctccgctaatagattaacaggttccgacgttaacctgttggccgaaaatctgctgtcacctgaggacatggtgcttttccacaaccttacccagcctcgcggtgtcaactggtgcgagcggaccaccttgtcgaatggaggatgtcaatatctctgtttaccagccccacagatcaatccacacagccctaagtttacgtgcgcatgtccagatgggatgctactcgcacgagatatgagatcttgtttgacggaagctgaggctgctgtggcgacccaagaaacaagcaccgtgcgtctgaaagtgtccagtacggccgtgcgcacacaacatacaactacacgtcctgttcctgacacaagcagactccctggggccacacctggactgaccaccgtagaaatcgtgacaatgagccatcaggcgctgggcgatgttgccggacgtgggaacgaaaagaaacctagctccgtccgtgccttgagcatcgtgttacctatagttctgctggtgtttctatgtttgggcgtattcctgctttggaagaattggcgcctgaagaacattaactctattaactttgacaacccagtgtaccagaaaactactgaggacgaagtccacatttgtcacaatcaggacggatacagctacccatcgcgccagatggtgtctctggaagacgacgtggct

SEQ ID NO: 505 - DNA, 2580 bp, Artificial Sequence
  Description of Artificial Sequence: Synthetic Transcript Sequence
atggggccctggggatggaagttgcggtggacagttgccctgcttctggctgcggcggggacggccgtgggcgaccggtgtgaacgaaatgagttccagtgccaggacggaaaatgtattagctataagtgggtatgcgatgggagtgctgaatgccaggacgggagtgacgagtctcaggagacatgtcttagtgtgacctgtaaaagtggcgatttcagctgtgggggccgcgtgaataggtgcatccctcagttctggcgatgcgatggacaggttgattgcgataatggatccgacgagcaggggtgtcctcccaaaacatgcagccaagacgagtttagatgccatgacggcaagtgtattagtcgccaattcgtgtgtgactcagatagggattgtcttgatggctctgatgaagcctcctgccctgtgttgacatgtggaccggcgtcattccagtgcaactcctctacctgcatacctcagctgtgggcttgtgataacgatcctgattgtgaggacggatcagacgagtggccgcagcggtgtcgcgggctgtatgtctttcagggagactcctcaccgtgctccgctttcgaattccactgtttgtctggcgagtgtatccactcatcatggcgatgcgatggaggccctgattgtaaagataagagcgacgaagagaactgcgccgtggccacctgtagacctgatgaattccaatgttccgacggcaattgtattcatggtagtcggcagtgcgacagggaatacgactgcaaggacatgtcagacgaggtgggatgtgttaacgtaaccctgtgcgagggccctaataagtttaaatgtcactcaggagaatgtatcactctggataaagtgtgtaacatggctagagactgcagagactggagtgacgaaccgataaaggagtgcggcacgaatgcgtgtctggacaacaatggtggctgttctcacgtgtgtaacgacctgaagatcgggtacgagtgtctgtgtcctgatggctttcagttggtagcacagcggcggtgtgaggacatcgacgagtgccaggaccccgacacttgctctcaattgtgcgtaaaccttgagggggggtacaagtgccagtgtgaggaaggcttccagctcgatccccacactaaggcttgtaaggccgtgggcagtattgcttacctgttttttaccaaccgacatgaggtccgcaagatgaccctggaccgaagcgagtatacatccttgatcccaaatctccggaacgtggtggctttggatacagaagtggcttccaaccgaatctattggagtgatctcagtcagagaatgatttgctcaactcagcttgatagagcccatggggtgtcttcctatgataccgtcatttccagggacatccaagccccagatggcttggccgtcgattggatccatagtaacatatactggacagattccgtgctcggaacagtatctgtggcggacacaaaaggtgtgaaacggaaaaccctgttccgggaaaacggatccaagcctcgcgcaattgttgtcgatccagtgcatggctttatgtactggaccgattggggtacccccgccaagattaagaaggggggactgaacggagtcgacatttatagcctggttaccgagaatatccagtggcccaatgggattaccctcgacctgctgagcggacggctctactgggtagactcaaaactgcatagcattagtagcatcgatgtgaacggagggaaccggaaaaccattcttgaagacgagaaacgactcgcccacccgtttagtcttgccgtgtttgaagataaggtcttctggaccgatatcattaatgaagctattttcagcgctaacagacttactggaagcgacgtgaatctgttggcagagaatctgctgtctcccgaggacatggtcctctttcacaatctcacacagccccgaggagtgaactggtgtgaaaggaccactctcagtaatggtggttgccagtacctctgcctgccagccccacagattaacccccattcccctaaattcacctgcgcttgccccgatggtatgttgctggcccgggatatgaggagctgtctgaccgaggcagaagccgcagtggctactcaggagacaagcaccgtacggcttaaggttagttccaccgcggtcaggacccaacacacaactactaggcctgtaccagataccagtcggcttccaggagccacacccggccttactacagtagagatcgttacaatgagtcaccaggcgcttggtgacgttgccggaagggggaatgagaaaaaaccctcctccgtgcgcgcactcagtatcgtcctccctatagtgctcctggtgttcctgtgtctgggagtcttccttctgtggaaaaattggcgcctgaagaatatcaactccatcaactttgataacccagtgtatcagaagactacggaggatgaggtgcacatctgccacaatcaggacgggtatagttacccatccagacagatggtgagcctggaggacgatgtagct

SEQ ID NO: 506 - DNA, 2580 bp, Artificial Sequence
  Description of Artificial Sequence: Synthetic Transcript Sequence
atgggtccctggggctggaagctccgctggaccgtggcactcctcctggcagctgccggaacagcagtcggagaccgctgtgagagaaacgagttccagtgccaggacggtaagtgtatctcctacaagtgggtgtgcgatggaagtgctgaatgtcaggacggtagcgacgagagccaggagacttgcctgagtgtgacctgtaaatctggagacttctcctgcggcggccgcgtcaataggtgcataccacaattctggaggtgcgacggacaggtcgattgcgacaatggatcagatgaacagggatgtccacctaagacttgtagtcaagacgaattcagatgtcatgacggtaagtgtatttccagacaattcgtctgcgatagcgacagagattgtctggacggctctgacgaagcttcctgtccagtacttacctgcggcccagcatcttttcaatgtaactcttcaacttgcatccctcagctgtgggcctgcgataacgatcctgattgcgaggatggtagcgatgagtggcctcaaaggtgccgcggtctgtacgtatttcagggagactctagcccctgctcagcctttgaattccactgtctctccggcgagtgtattcatagctcctggaggtgcgatggaggtcccgactgtaaggacaagtcagacgaggagaattgcgccgtagctacctgccgccctgatgaattccagtgttccgacggcaactgcattcatggttccaggcagtgtgatagagagtacgactgcaaggacatgagcgatgaggtcggttgcgtcaatgtgaccctgtgcgaaggcccaaacaagttcaaatgtcacagcggcgagtgtatcacactcgataaggtctgtaatatggccagagactgcagagactggtcagacgagcctattaaggagtgcggcacaaacgcctgcctggacaacaacggcggttgcagccacgtgtgtaatgatctgaaaattggttatgagtgcctctgtcctgacggattccaattggttgctcagaggcgttgcgaagacattgacgagtgtcaagatccagacacatgctctcagttgtgcgtgaacttggagggcggctataagtgtcaatgcgaagagggttttcaacttgatcctcataccaaggcatgcaaggctgtcggcagtattgcatacctgttcttcacaaaccgccacgaggttcgcaagatgaccctcgaccgttctgagtacaccagtttgatccccaacctgagaaatgtggtggctctcgataccgaggtagctagtaacaggatctactggagtgacctgtctcagcgtatgatttgttccactcaactcgatcgcgcccacggcgttagtagctatgataccgtcatctctcgtgacattcaggcccctgacggcctggccgtcgactggatccactcaaacatctactggaccgattcagttctgggtaccgtaagtgtcgccgacaccaaaggtgtgaaacgcaagactctttttagggagaatggaagcaagccccgtgcaatcgtcgtggatcccgtacacggtttcatgtattggactgactggggaactcccgcaaagatcaaaaaaggcggtctgaacggagtcgatatctacagtctcgtgacagagaatattcaatggcccaacggtatcacactcgatctgctgagtggacgcctgtactgggtggactccaagctgcacagtatcagcagtattgacgtgaacggcggcaaccgtaaaacaattctcgaagatgaaaagcgcttggctcacccattcagcctcgctgtctttgaagacaaagtgttctggacagatatcatcaacgaagctatcttttcagccaatcgtctgaccggttccgacgtgaatctcctggcagagaaccttctgtcccccgaggacatggtcctgttccacaacctgacacaaccaagaggagtcaactggtgcgaaaggaccaccctgtctaatggcggctgtcagtacctgtgccttcctgctcctcaaatcaatccacactctcctaaattcacctgcgcatgccccgatggaatgttgcttgcccgtgatatgaggtcatgtctgaccgaagccgaggccgctgtggctacccaggagacatccaccgtgcgcctgaaggtctccagcactgctgtgagaacccaacatactacaacccgtcctgttcctgacacatccaggctgcctggtgcaacacctggactcactacagtagagatagtcacaatgagccatcaggcactcggcgatgtagctggacgtggtaatgagaaaaagcccagctccgtgcgcgccctttctatcgtgctgccaatcgtgctcctggttttcctgtgcctcggcgtcttcctgctttggaaaaattggcgtttgaagaatattaactctataaatttcgacaatcccgtttaccagaagaccacagaggatgaggtacacatatgccacaatcaagatggttattcttacccaagtcgtcagatggtgtcactcgaggacgatgtagca

SEQ ID NO: 507 - DNA, 2580 bp, Artificial Sequence
  Description of Artificial Sequence: Synthetic Transcript Sequence
atgggaccttgggggtggaaactccgatggactgttgctctgttgctcgctgcagctgggacagcagttggggatcggtgcgaacggaacgaattccagtgtcaggatgggaaatgcatatcatacaagtgggtctgtgatgggagtgctgaatgtcaggatgggagtgatgaatcccaagaaacttgtctgtctgtgacttgtaaaagtggagacttttcttgcggaggacgcgtcaacagatgcatcccacagttttggaggtgtgatggacaggttgattgtgataatgggagtgatgagcagggatgcccacctaagacatgctcccaagatgaatttaggtgccatgatgggaaatgcatctctaggcaatttgtgtgcgacagtgatcgagattgtttggacggatctgatgaagcttcttgtcccgtgctcacatgtgggcctgcatccttccagtgcaattcctcaacttgcatcccccagctttgggcttgtgacaatgatcccgattgtgaggacggatctgatgagtggccacagcgctgtcggggattgtatgtttttcagggggattccagtccttgctctgctttcgaatttcactgcttatctggagaatgcatacacagttcttggaggtgtgacgggggacctgattgcaaagataaatctgacgaagaaaactgtgctgttgcaacatgtagaccagatgaattccagtgtagtgatgggaactgcattcacggatcgcggcagtgcgaccgagagtacgattgtaaggatatgtctgatgaagttgggtgcgttaatgtcacactgtgtgaagggcctaacaaattcaagtgtcactctggagagtgtatcactctcgataaagtttgcaatatggctagagattgtcgcgattggtcagatgaacctataaaagagtgtggaactaatgcttgcttagacaacaatggggggtgttctcatgtgtgtaacgatctaaagatagggtatgaatgcttatgtcctgatgggttccagttagttgctcagcggcgttgtgaggatatagatgaatgtcaggaccccgatacatgtagtcaattgtgtgtcaacctcgaaggggggtacaaatgccagtgtgaagagggatttcagctcgatcctcacactaaagcctgcaaagccgtggggtccatcgcctatctcttttttactaatagacatgaagtgaggaaaatgacactcgatcggtctgaatacacttcattaatacccaacctaaggaatgttgttgctcttgatactgaagtcgctagtaacaggatctattggagtgatctgtcacagaggatgatctgttcaacacagttggatcgggctcatggagtgtcatcatatgatactgtgatctctcgggatatccaagccccagatggactcgctgtggattggatacatagtaacatttactggacagatagtgtactcggaacagtctccgtggcggatacgaaaggagttaaaagaaaaactctctttcgggagaatgggtcaaaaccccgggcgatcgtggttgatcctgttcacggattcatgtattggacagattgggggacacctgccaaaatcaagaaagggggactcaatggagtcgatatttatagtctggtcactgaaaacatacaatggcccaacggaataacactcgatcttctttcagggaggctctattgggtcgattctaaactccactctatctcatccattgatgtgaatgggggaaatagaaaaacaatcctcgaagacgaaaagcggcttgctcaccctttctcactcgcggtgttcgaagataaagtattttggacagacataataaacgaagccatcttcagtgctaatcggttgactgggtctgacgtgaacttattagctgaaaacttgctcagtccagaagatatggtgctattccacaacctgactcaaccacggggagtgaactggtgtgaacggactacattatcaaatggagggtgccagtatctctgcctgcccgcgcctcaaatcaacccccatagtcctaaattcacgtgtgcctgcccagatggaatgctgttagcacgagatatgagatcctgtctgacagaagccgaggccgccgtagcgactcaggaaactagtacagtaaggctcaaagtgtcatccactgctgtgcgcactcagcacacaacaactcgaccagtacccgatacaagtcggctgcccggggcaacacccgggctaactactgtagaaattgtgactatgtcacatcaggctctgggagatgtagctggacgggggaacgagaagaaacctagttcggtgagggctctttccatagttctccctatcgttctcctcgtgtttctgtgtttaggagtatttttactgtggaaaaattggaggctaaaaaacataaacagtattaacttcgacaatccagtctatcagaagacaacagaagacgaagtccatatctgtcataaccaggatggatattcttatcccagtcggcagatggtctccctcgaggatgatgttgca

SEQ ID NO: 508 - DNA, 2580 bp, Artificial Sequence
  Description of Artificial Sequence: Synthetic Transcript Sequence
atggggccctggggctggaagttgcgttggaccgtagcacttctgctcgccgcagcaggcactgctgtaggagaccgatgcgagcgaaacgaattccagtgtcaggatggcaagtgtatcagctacaagtgggtgtgcgacggatccgctgaatgccaggatgggtctgacgagtctcaggagacatgtctttccgtgacctgtaagagcggtgacttttcgtgtggagggcgggttaacagatgtattccacagttctggcggtgtgacgggcaggttgattgcgacaatggatcagacgagcagggttgcccacccaaaacctgcagccaagatgaatttaggtgccacgatggtaagtgtatttcacgccagtttgtctgcgattcggatcgagactgcttagacggctcagatgaggcatcatgtcctgtgttaacatgtggccctgcttcatttcagtgcaattctagcacctgcatcccccagctctgggcttgtgacaacgatcctgattgtgaggatgggtcagatgagtggcctcagcgatgcaggggcctttacgtcttccagggcgatagttcgccctgctcggcattcgagtttcattgcctgagtggagagtgcatccactctagctggcgatgcgacggcgggcctgattgcaaagacaagtcagacgaagagaactgtgctgtggccacctgcagacctgatgagtttcaatgctcagacggaaattgcatccacgggagtcggcaatgcgaccgtgagtacgactgcaaagatatgagtgacgaagtgggatgcgtgaatgtcaccctatgcgaaggcccgaacaagttcaagtgtcactctggagaatgtatcaccctcgataaagtgtgtaatatggctagagattgtcgagattggtcggacgaacctatcaaagagtgcgggaccaatgcctgcctcgataataatggggggtgttctcacgtctgcaatgatttaaagattggctatgagtgcctgtgccccgacggctttcaacttgtagcacagaggcggtgcgaagacatcgacgagtgtcaggaccctgacacatgttctcagctctgtgtgaacttggaaggcgggtataaatgtcagtgtgaggagggctttcaacttgacccacataccaaggcgtgcaaagcagtcgggtccatcgcctatctgttcttcaccaaccggcacgaggtaagaaagatgacactcgaccgatccgagtatacatctttgattcccaatcttcgcaacgttgtggctctcgatacggaagtggcatccaaccggatatattggtcagacctgtcgcagcgtatgatctgtagtacccagcttgaccgggcccacggcgtcagctcatatgatactgtgatcagccgggatattcaggcccccgatggtctcgctgtcgactggatacactctaatatatattggacggattccgtgcttgggactgtctcagttgcggacacaaagggagtgaagcgcaagacactctttagagagaacggctccaagccccgcgctattgtggtggaccctgtacatggctttatgtattggacagactggggcacgcccgctaaaattaagaaggggggactcaacggagtggatatctactcgctcgtgacggagaacatccagtggcccaacggcattactctggacctgttgagcggacggctctactgggttgactctaaacttcattcgatttcttctattgacgttaacggtggtaaccgtaaaacgatcctcgaggatgagaaacggctagcccacccgttttctcttgccgttttcgaggataaagtgttttggacagacatcatcaatgaggcaatttttagcgcaaatcgcctaaccgggtctgacgtgaacttgctggccgaaaatctgcttagccctgaggatatggtgctattccataacctcacgcagccccgcggcgtgaactggtgtgaaagaactaccttgagcaacgggggctgccagtacctgtgtctgcccgcaccacaaattaatccacatagcccaaaattcacttgcgcctgtccggatggcatgctcctcgctcgggacatgcgcagctgtctcactgaggctgaggcagcggtcgcgacacaggaaacctctaccgtgagactcaaggtaagttccaccgcagtgcgaactcagcatacaacgacaaggcccgtgccagatacttcccggctgccgggagcaacacctgggctgacaactgtggaaatcgtgacaatgagccatcaggcactgggtgacgtggcggggcggggtaatgaaaagaagccctcttcagtgcgagcactttccatcgtgttgccgatcgtgcttctggtttttttatgtctaggcgtctttctgctctggaaaaattggcggctgaagaatattaatagtatcaatttcgacaatccagtctatcaaaaaacaacggaagacgaggtgcacatctgtcacaatcaagatggctactcttatccatcaaggcaaatggtgagcctggaagatgatgtcgcc

SEQ ID NO: 509 - DNA, 2580 bp, Artificial Sequence
  Description of Artificial Sequence: Synthetic Transcript Sequence
atgggaccttggggatggaaactgcgatggactgttgcactcttgcttgccgctgcgggtaccgcagtgggagatcggtgcgagagaaacgaatttcagtgtcaggatggaaagtgcatttcgtacaagtgggtttgtgatggttccgccgaatgtcaagacggttccgacgaatcccaagagacttgcctgtcggtgacgtgcaagagcggcgacttttcatgcggcggaagagtgaacagatgtattccccaattctggaggtgtgacggacaggtggattgtgataacgggtccgacgaacaaggttgccccccaaagacgtgttcacaagatgagtttagatgtcacgatggcaagtgtatctcgcgacagttcgtgtgtgatagcgatcgcgactgtctggatggttcggatgaggcctcgtgccctgtcctcacgtgtggacctgcgtcgttccagtgtaattcctcgacctgtattccccagctgtgggcttgtgacaacgaccccgattgcgaagatggatcggacgaatggcctcagcgctgtcgcggactgtacgtgttccaaggggacagcagcccatgctcagcgtttgagtttcactgtctctccggcgaatgtatccactcgtcctggcggtgtgatggtggccctgactgtaaggataagtcggacgaggagaactgtgcagtcgcaacttgtagacccgacgagtttcagtgttcggacggaaactgtattcacggttccagacaatgtgatcgagaatacgattgtaaagatatgtcagacgaagtgggttgtgtgaacgtgaccctgtgtgaaggaccaaataagtttaagtgccatagcggagaatgcatcactctggataaggtgtgtaatatggcaagagactgccgagactggtccgatgaaccaatcaaggaatgcggaacgaacgcctgccttgacaacaacggaggttgctcgcacgtgtgtaacgatttgaaaatcggatacgagtgtctttgtccagacggttttcaacttgtcgcacaaagaaggtgtgaagatatcgatgaatgccaagatcctgatacctgtagccaactgtgtgtgaatctggaggggggctacaagtgccaatgtgaagaaggttttcagctcgatcctcatactaaggcatgcaaggcagtgggttcaattgcatacctgtttttcaccaatcgccacgaggtccgaaagatgactttggatcgctccgaatacaccagcctcattcctaaccttcgcaacgtcgtggccttggataccgaagtcgcatccaaccgaatttactggtccgatctttcgcaacgcatgatttgctcgactcagcttgatagggcacatggggtgtcctcatacgataccgtgatctcgcgagacattcaggcgcccgacggactggcagtggactggattcactcgaacatttactggaccgattctgtcctgggtaccgtttccgtcgcagataccaagggtgtgaaacgtaaaacgctctttcgcgaaaacggttcaaagccgcgggcaattgttgtcgatcctgtgcatggctttatgtactggactgattggggcactcctgctaagataaagaaaggaggtcttaatggagttgacatttactcgcttgtgactgagaatattcagtggccgaatggaataacgctcgatcttctgtcagggagactgtattgggtggattcaaagctccatagcatttcgtctatcgacgtgaacgggggtaatagaaagaccatcttggaagatgaaaaaagacttgcacatcctttttctctggcagtgttcgaagataaagtgttctggaccgatatcatcaacgaggctatcttttctgccaaccggttgactggtagcgacgtgaacttgctggcagaaaatctgctttcaccggaggatatggtgctcttccataatctcacccaaccaagaggggtcaactggtgtgagaggactactctctcgaatggtggatgccagtatctttgccttccagcaccccagataaatccacatagcccaaagttcacttgtgcgtgtccggatggcatgcttctggctcgggatatgcgtagctgcctgactgaagcagaggcagcagtggcgactcaagaaacttcaactgtgaggctgaaagtgtcatcgacggcagtgcgaactcaacataccactactaggcctgttcctgacacgtcgagattgccaggcgcgactcccgggcttaccactgtcgagatagtcaccatgtcgcatcaagcattgggcgacgtggcaggacgcggtaatgagaaaaaaccatcttccgtccgcgccctctccatagtcctgcctattgtgttgctcgtctttctgtgcctgggcgtctttctgctgtggaagaactggcggctgaaaaacattaactccatcaacttcgataaccctgtgtaccagaaaaccaccgaggacgaggtccacatatgccacaatcaagacggttacagctacccctctcgccaaatggtgtcacttgaagatgacgtggcg

SEQ ID NO: 510 - DNA, 2580 bp, Artificial Sequence
  Description of Artificial Sequence: Synthetic Transcript Sequence
atgggtccatggggttggaagctgcgctggactgtggccctgctgcttgccgccgctggcaccgccgtcggcgaccggtgcgagcgcaacgaattccagtgccaggacggaaagtgcatctcgtataagtgggtgtgcgacggcagcgccgagtgtcaggacggatcggacgaatcgcaggaaacctgcttgtcggtgacctgcaagagcggtgacttctcgtgcggcggacgggtgaacaggtgtatacctcaattctggcggtgtgacggacaagtcgactgcgacaatggctcggacgagcaaggatgcccccctaagacctgctcccaggatgaatttagatgccacgacggcaagtgcatttcacgccaatttgtctgcgactccgacagagattgcctcgatggatccgacgaagcgtcctgcccggtcctgacttgcggcccagcctctttccaatgcaacagctcaacgtgtatccctcagctctgggcatgcgacaacgacccggactgtgaggacggaagcgacgagtggccacaacgctgccgggggctgtacgtgttccaaggagattcctcgccttgtagcgcgttcgaattccactgtcttagtggcgagtgtattcatagctcgtggaggtgtgacggcggaccggactgcaaggacaagtctgatgaggaaaattgcgccgtggcgacttgccggccggacgagttccagtgttcggatggtaactgcatccatggctcaagacagtgcgaccgcgagtacgactgtaaggatatgtcagatgaagtgggatgcgtcaatgtcaccctctgcgagggaccaaacaagtttaagtgccacagcggagagtgtatcactcttgacaaggtgtgtaatatggcccgggactgccgcgactggagcgatgagccaattaaggaatgtggcactaacgcatgtcttgacaacaatggaggatgttcgcatgtgtgcaacgatctgaaaatcggttacgaatgcctgtgcccggacggatttcagctggtggcgcagcgccggtgtgaagatatcgatgaatgccaagacccggacacctgttcccaactctgtgtgaatctggaaggggggtacaaatgccaatgtgaggagggattccagctggatccgcacaccaaggcgtgcaaggcagttggatcgattgcgtacctgttctttactaataggcatgaggtcagaaagatgactctggaccggagcgagtacactagcctgatcccaaatctgcgcaatgtggtggccttggacacggaggttgcgtcgaatcggatctactggtcggacctctcacagcgcatgatctgctcgacccaactggaccgggcccatggtgtgtccagctacgataccgtgatcagcagggacatacaagctccagatgggctcgctgtggactggattcattcaaacatctactggacggattccgtgctcggaaccgtgtcggtcgctgacactaagggagtgaaacgtaagactctgttcagggaaaacggatcaaagccacgcgcaatcgtggtggaccccgttcatgggttcatgtactggaccgactggggaaccccggcgaaaatcaaaaagggcggcctcaatggtgtggacatctacagtctcgttactgaaaacatacagtggcccaacggaatcaccctcgatctcttgtctggacggctttactgggtagattccaagctgcactcgatcagcagcatcgacgtgaatggcggaaaccgcaaaaccatcctggaggatgaaaaacgcctggcccacccattttccctcgctgtgttcgaggataaggtgttctggactgacatcatcaacgaagccatcttctcggcgaatcgcctgacgggctccgatgtcaatttgttggccgagaacttgctgtcgccagaggatatggtgctgttccacaatctgacccagccacgcggagtcaactggtgcgaacgcaccaccctgtcaaacggcggctgccagtacttgtgcttgccggccccgcaaatcaacccgcacagcccgaagtttacgtgcgcatgtccggacggaatgctcctcgcccgcgatatgcgctcgtgtctcacggaggccgaagcagccgtggcgacgcaggaaacttcgactgtgagactgaaggtgtcatcgactgccgttcgcacccagcacactactacgcgtcccgtccctgatacttcgcggctgccgggcgcaaccccgggactgaccaccgtggaaatcgtgaccatgtcccaccaggcgctgggagatgtggcaggaagaggaaacgagaaaaagccatcgtcagtccgcgcactgtccatcgtgctgccaattgtcctgctcgtgtttctgtgcctgggagtctttctgctgtggaagaactggaggctcaagaatatcaattccatcaatttcgacaaccctgtgtaccaaaagactacggaggacgaagtccacatctgtcacaatcaagacggatactcgtacccaagccggcaaatggtgtcgctggaagatgatgtggcg

SEQ ID NO: 511 - DNA, 2580 bp, Artificial Sequence
  Description of Artificial Sequence: Synthetic Transcript Sequence
atgggtccttggggctggaaacttcggtggacagtcgctttacttctggcggctgctggcacggcggttggagataggtgtgagcgcaacgaatttcagtgccaggatggcaaatgtatttcctataaatgggtatgcgacggctctgcggaatgccaggatggatctgatgaatcacaagaaacatgtttaagtgtgacatgcaaatcaggagacttctcatgcggcggcagggtaaatagatgcatcccgcagttttggaggtgcgatgggcaagtagattgcgataatggatctgacgaacaaggatgccctccgaagacttgttcgcaggacgaatttcgttgtcatgacggcaaatgcatttccagacaatttgtgtgtgattctgatagggattgtttggatggttcagacgaagcaagctgtccggtattgacctgcggccctgcatcatttcaatgcaatagctctacctgcattccgcagctctgggcttgtgacaacgatccagattgtgaagatgggtctgatgagtggccgcagcgctgcagaggtctttacgtttttcagggggacagctccccttgttctgcctttgaattccattgcctgagtggcgaatgcatccatagcagctggcggtgcgacggcggcccggactgcaaagataaaagcgatgaagagaactgcgcagttgccacatgtaggccggatgagtttcagtgctctgatggcaattgcatccatggcagccgtcaatgtgatcgtgaatatgattgtaaagatatgtcagatgaagtcggatgcgttaatgtcacattatgcgagggcccgaataaatttaaatgtcattctggtgaatgcattacactcgacaaagtttgtaacatggcaagggattgtagagattggtcggacgaaccaatcaaagaatgtggaactaacgcttgccttgacaacaatggaggatgtagtcatgtttgcaacgatttaaagatcggatacgaatgtttgtgtccggacgggtttcagcttgtagctcagcgccgctgtgaagacattgatgagtgccaggatccagatacttgcagccaactgtgcgttaatctcgaaggcgggtataagtgccagtgcgaagaaggctttcaattagaccctcataccaaagcttgtaaagcagtcggtagcattgcctacttatttttcacaaaccgtcacgaggtccgaaaaatgacactggaccgctccgaatatacgagcttaattcctaatttgcggaacgttgtggcactggataccgaggtcgctagcaaccgtatttattggtccgacttaagccagcgtatgatttgtagtacacaattggacagagctcatggcgttagctcatatgacacggtcatatccagggatatccaggctccagacggattagcagtagattggatccattcaaatatctattggacggactcagtgcttggcactgtatctgttgccgatacgaaaggggttaaacgcaaaaccctttttcgggaaaatgggagcaaacctcgcgcgattgttgtggatccagttcacggttttatgtattggactgattggggtacaccagctaaaatcaagaaaggaggccttaacggggtggacatctactccctggtgacagagaacattcagtggcctaacggaatcactctggatcttttatccggtcgcctttattgggttgatagcaagcttcattcaatctccagcattgacgtaaacggagggaatcgcaaaacaattctcgaagacgagaaacgacttgcgcatccattttcacttgctgtctttgaggataaggttttttggacagatatcattaacgaagccattttcagcgcgaatcgacttaccggctctgatgtgaatttgctggcagaaaatctcctgagtcccgaagatatggttttgtttcacaatttaactcaacctagaggtgtcaattggtgcgaaagaacaaccctaagtaatggcggctgccaatacctttgtttgccggccccccaaatcaacccgcattcccccaaatttacatgtgcctgtccggatggtatgcttttagcccgcgacatgcggtcttgcttgacggaagcagaagcggcagtggctacacaggaaacatctacagttagattgaaggtctcctctacagcggttaggacacagcatacgaccacgcgcccagtcccggacacctcgcggctaccgggagcgacccctggtttgacaacagtcgaaattgttactatgtctcatcaggccctcggagatgtggctgggcgtggcaatgaaaaaaagcctagttcggtcagggcactctctatcgttttgccgattgtcttactggtgtttttatgcctaggggtctttctgctttggaaaaattggagattgaaaaatataaattctattaactttgataatccggtgtatcaaaaaacaacagaggatgaggtgcatatatgccataatcaagacgggtactcctatccaagccgccaaatggtgtcattggaggatgatgtcgct

SEQ ID NO: 512 - DNA, 2580 bp, Artificial Sequence
  Description of Artificial Sequence: Synthetic Transcript Sequence
atgggcccgtggggctggaaactgaggtggacagttgcactgctcttagctgctgctggcacggccgtgggcgaccggtgcgaaaggaatgaattccagtgccaggacggaaaatgcataagctataaatgggtgtgcgacggctcggctgaatgccaggatggaagtgatgagagtcaggaaacctgcctttcagtgacgtgtaaaagcggcgacttcagctgcggaggaagggtaaaccgctgtatcccacaattttggaggtgtgatggtcaagtcgattgcgacaacgggtctgacgagcagggatgccctcccaaaacgtgctcccaggatgagtttagatgccacgacggcaagtgcatttccagacagttcgtgtgtgactccgatcgggattgccttgacggctccgacgaagcatcctgccccgtcctgacctgtgggcctgctagtttccagtgtaacagttccacctgcatccctcagctttgggcctgtgataacgatcctgattgcgaggatggctcagacgaatggccacagcggtgcaggggcctgtacgttttccaaggggatagctcaccctgtagcgcttttgagttccactgtttatctggtgagtgcatccattcgtcctggaggtgcgacggtggacccgactgcaaagacaagagtgacgaagagaactgtgcagtcgctacctgccggcctgacgagttccaatgtagtgatggaaattgcatacatggctcaagacagtgtgaccgggagtacgattgtaaagacatgagtgacgaggtggggtgcgtgaatgtgactctgtgcgaaggtcctaataagtttaagtgtcattccggagagtgtattacacttgacaaggtatgcaacatggctcgagactgccgagattggagcgacgagcccatcaaggagtgcggcacaaatgcctgtctcgataataatggggggtgctcacacgtatgcaacgacctcaaaatcggctatgagtgtttgtgcccagacggttttcagctggtcgcccagcggcggtgtgaagacatagatgaatgccaagatcccgatacctgctcccaactttgcgtgaatctcgagggaggatataagtgccagtgcgaagagggttttcaactcgacccccacaccaaagcctgcaaagctgtggggtctatcgcctacctattctttaccaacaggcatgaagttcgtaaaatgaccctcgatcgcagtgagtacacatctttgattcccaacttgcgaaacgttgtcgcactcgatactgaggtcgcctctaaccgaatatactggtctgacctctcccagcgaatgatttgcagcacacagctggaccgcgcgcatggcgtgtccagctacgatacagtgatcagcagggacatccaagctccggatggactggctgtggactggatccatagcaacatttactggaccgactcggtgctggggactgtttcagtcgcagacaccaagggggtgaagcgcaagaccttgtttagggagaatggcagcaaacccagagcaattgttgtagatcccgtgcatggatttatgtattggactgattggggcactccggccaaaatcaaaaaaggtggcctcaatggggtggatatttactcactggtaacagagaacatccagtggcccaatgggattacactggatctactatcggggaggctctactgggtggacagcaagctacatagcatatcctccatcgacgtcaacggggggaatcgtaagacgatcctggaagacgagaagcggctggctcaccctttcagtttggccgtgttcgaggacaaagtgttctggactgacattatcaatgaagcaattttcagcgcaaatcgtttaaccgggtctgacgtgaatttgttggcagaaaacttgctgagcccagaggatatggttctgttccacaaccttacgcagccgaggggagtcaactggtgcgagaggacaaccctctctaacggcggctgccagtatttgtgtctgcccgcccctcagatcaacccacattccccgaagtttacctgcgcctgcccagacggcatgctcctagccagggatatgagaagctgccttactgaagccgaggcggcggtggcgacgcaggagacatctaccgtgcgcctcaaggtttctagcaccgctgtgcgtacccaacacaccactacaagacctgtaccagacacctcccgcctaccgggagcaaccccaggtctgaccactgtggaaatcgtaaccatgtcccatcaggccctaggtgacgtggccgggagaggtaacgaaaaaaagcctagtagcgtgcgagcactgtctatagtgcttcccattgtactgcttgtttttctatgtctcggggtctttctactttggaagaattggagattgaaaaatataaattctattaatttcgataatcccgtgtatcagaagacaaccgaagacgaagtgcatatctgccataatcaggatggatactcgtaccctagtcggcagatggtgtccctcgaagatgatgtggcc

SEQ ID NO: 513 - DNA, 2580 bp, Artificial Sequence
  Description of Artificial Sequence: Synthetic Transcript Sequence
atgggaccctgggggtggaaactgagatggactgtagctctacttctcgccgcagctgggacagctgttggagatcgctgcgagaggaacgaatttcagtgtcaggatggaaaatgtatctcatataaatgggtgtgtgacgggtccgcagaatgccaggatggaagtgatgaatctcaggaaacatgcctttccgtgacttgcaaatccggggatttttcctgtggaggaagggtgaacaggtgtataccccagttttggaggtgtgatgggcaggtcgattgtgacaatggatcagatgaacaggggtgtcctcctaaaacttgctcccaggatgaatttaggtgtcacgatgggaaatgtatttcccggcagttcgtatgtgattcagatagggactgcttggatggatccgatgaagcctcttgtccagtgctcacttgtgggcccgcctcttttcaatgtaatagttccacttgcatcccccagctatgggcctgtgataacgatcccgattgcgaggacggaagtgatgaatggcctcagcgatgtcgggggctttacgtatttcagggagattctagtccctgctctgcatttgaattccactgtttatccggagaatgtattcattcatcatggcgctgtgatgggggacccgattgcaaagataaatcagatgaagaaaattgcgcagtggccacttgtcggccagatgagttccagtgttccgatggaaattgcattcacgggagtaggcagtgtgatagagaatatgattgcaaagatatgtcggacgaggttggatgtgtaaatgtgactctctgtgaaggaccaaataaattcaagtgtcactctggagaatgcattactttggacaaagtatgcaatatggctcgtgattgcagagattggtctgatgaaccaataaaagaatgtgggacaaacgcttgtctcgataacaacgggggatgctctcatgtttgcaacgacctaaaaatcgggtatgaatgcctctgcccagacggattccagttggtggcccagcggagatgcgaagacatcgatgaatgccaggatcctgatacttgctcccagctttgcgtcaatctcgagggagggtataaatgccagtgtgaagaaggattccagctggaccctcatactaaagcttgtaaagccgtgggatcaatcgcctacttatttttcacaaatcggcacgaagtgcgaaaaatgactctagataggtcggagtatacatcactcatccccaacctccggaacgttgtagccttagatactgaggtagcctccaaccggatctattggtccgatctgtcacagagaatgatatgctctacacagcttgatcgggcacatggagtgtcttcttatgacacagttatttctagagatatacaggctccagatggactcgcagtagattggattcactctaacatctattggacggattctgtcctgggaacagtgtctgtagcagatacaaaaggagtgaaaaggaaaactctcttccgggaaaatggatccaaacctagggccattgtcgtggatcctgtccacgggttcatgtactggacagactgggggacaccagctaagatcaaaaaagggggacttaacggggtggatatatattcactcgtgacagaaaatattcagtggccaaatgggataacactggacctactatcggggcgcctttactgggtggatagtaaactacactcaatctcttcaatcgatgtcaacggagggaaccgaaagacaatacttgaagatgaaaaacggctggcacatccattttcattagctgttttcgaagataaagtattttggactgacatcatcaacgaagcaatcttctctgcaaaccggcttactgggagtgatgtgaatctgctcgcagagaatttgctttcccctgaagatatggtgctcttccacaaccttactcagccacggggggtaaattggtgtgaacgcactacgctcagtaatgggggatgtcagtatctgtgtcttcctgcacctcagatcaacccccattcgcccaaatttacttgtgcctgtccagatggaatgctgttggcccgggatatgaggtcttgtctgactgaagccgaagcggctgtagcaacacaagagacatccactgttaggctcaaggtcagtagtacagcagtaagaactcagcatactacaacacgcccggtgcctgatacatctagacttccaggggcaactcctggactaactacagttgaaattgtgactatgtcccatcaggcactgggagatgttgctgggcgcggaaacgaaaaaaaaccctctagtgtccgagctctatctatagtactacccattgtcctcctagtattcctttgtcttggagtctttcttctctggaaaaattggagattgaagaacattaactcaattaactttgataaccccgtgtaccagaaaactacagaagatgaagtgcatatctgtcacaaccaggatggatactcatatccttcacggcagatggtgtctttagaggatgatgtggcc

SEQ ID NO: 514 - DNA, 2580 bp, Artificial Sequence
  Description of Artificial Sequence: Synthetic Transcript Sequence
atgggaccctggggatggaaactgcgctggaccgtggctctgctgctggccgccgccggcactgcggtgggggatcggtgtgaaagaaatgaattccagtgccaggacggaaagtgcattagctataagtgggtgtgcgatggtagtgcagagtgtcaggatgggtccgatgaatctcaggagacttgtctgagcgtgacttgtaagtcaggcgatttttcctgcggaggacgggttaaccgttgcataccacagttttggagatgtgacggccaggtggattgcgacaatgggagcgacgagcagggttgtcccccaaaaacatgctcccaggacgagttcagatgccatgacgggaagtgcatttctagacagttcgtctgcgactccgaccgagattgtctggatgggagtgacgaagcatcatgtcccgtcttaacatgcggacctgcctcttttcagtgcaacagctctacatgtatacctcagttgtgggcatgtgataatgatcctgactgtgaggacggtagcgacgagtggcctcagaggtgtagaggcctctacgtgtttcagggcgactcttcaccatgcagtgcttttgagttccattgcctctccggggaatgtattcacagttcctggcgctgcgacggggggccagactgcaaagataaatccgacgaagaaaattgcgctgtggctacatgccggccagatgaatttcagtgcagcgatggaaattgtattcacggctcccgccaatgtgatcgcgaatacgattgcaaggacatgagcgatgaggtcggatgcgtcaatgtgaccttatgcgaaggtcctaacaagttcaaatgccactcaggagagtgcatcaccctggataaagtttgtaatatggcgagagactgccgtgattggtccgacgagcctatcaaagagtgcggcacgaatgcttgcctggataataatggagggtgttcacacgtctgtaatgatctgaaaataggctacgagtgtttgtgtcctgatggtttccaactagtggcccagcgcaggtgcgaggacattgatgaatgtcaggatccagatacatgctcacaactgtgcgtgaatttagaaggcggttataagtgccagtgcgaagaaggcttccagctcgatccgcacacaaaggcctgcaaggcggtggggagtatcgcctatcttttctttacgaaccggcatgaagtcagaaagatgactctggaccgctccgagtacacatccctcatcccgaacctgagaaacgtggtggcactcgatacggaggtggcttctaatagaatctactggagtgacttgtcccaaagaatgatctgtagcacccagcttgatcgtgcccatggcgtgagctcgtatgacaccgtgatctcacgggacatccaggcacccgatggattggctgtggattggatacattcaaatatttactggacagattccgtgctggggaccgttagtgtggcagatacaaaaggggtgaagagaaagaccctcttcagagaaaatgggtctaaaccgagagctatcgtggtagaccctgtgcacgggttcatgtattggaccgattggggaacaccggccaaaatcaaaaagggcgggttgaacggtgtggatatttactccctggtgactgaaaacattcagtggcctaatggcatcaccctggatctgttgtcaggccgcctctactgggttgactctaagctgcactcgataagttcgatcgacgtgaacgggggcaaccgaaagacaattctggaagacgagaagcgtttggcccatcccttctccctcgctgtgttcgaggataaggtgttttggactgatattattaatgaagctatattttccgctaatcggctgacaggcagcgatgttaacctcttagcggagaatctgttatcacccgaggacatggttctgtttcacaatctgacacaaccccggggtgttaactggtgtgagcgcacaacgctaagtaacggcggctgtcagtacctctgccttccagcgccccagattaatcctcactccccgaagttcacatgcgcgtgccccgatggcatgctattggcgcgagacatgcgatcttgtctgaccgaagctgaagcggccgtggcaacccaggagacctccactgttcggttaaaagtgagttccacagccgtgcgaacccagcataccaccacccgccctgtgcccgataccagcaggctacccggtgctacccccgggttgactaccgtggagatcgtgaccatgagccaccaggcgctcggtgacgtggccggacggggcaatgagaagaagccttccagtgtgcgagctctctcaattgttctgccaatcgttttgctagtgttcctctgcctcggggtatttcttttgtggaagaactggcggctcaagaatatcaattcgattaattttgataacccagtgtatcagaagactacagaagacgaggtacacatctgccacaatcaggacggatattcatacccgagcaggcaaatggtgtctctggaggacgacgttgcc

SEQ ID NO: 515 - DNA, 2580 bp, Artificial Sequence
  Description of Artificial Sequence: Synthetic Transcript Sequence
atgggaccttggggatggaaactgcgttggacagtggctttgctccttgccgctgccggaactgcagtaggcgatcgttgtgagcgcaatgaattccaatgccaggacggtaagtgcatctcctacaaatgggtctgtgacggctctgcggagtgccaagacggatctgatgagagccaggaaacatgcctgtctgtgacttgcaagtccggcgacttttcatgcggaggtcgtgttaatagatgtattccccaattctggagatgtgacggacaggtcgattgtgataatgggtcagatgaacagggttgtcctcctaaaacctgttctcaggatgaatttcggtgtcacgatgggaaatgcattagcagacaattcgtatgtgattcagacagagactgccttgatggttccgatgaagcaagttgcccggtcctgacttgcggtccggcttcatttcagtgcaatagttccacatgtatccctcagctgtgggcgtgtgacaatgaccctgattgtgaagatggtagtgatgaatggccgcagcgctgccgcgggctgtacgttttccagggagactcttccccctgctcagccttcgaattccattgcctctctggtgaatgcatccacagctcgtggcgatgtgacggaggacctgattgcaaagacaagtcggatgaggagaattgcgcagtggctacatgtcgcccagacgagttccagtgctctgatggtaattgcatacacggatctcgtcagtgtgatcgagaatacgactgcaaagatatgtcggatgaggtgggctgtgtgaatgttaccctgtgcgagggtccaaacaagtttaagtgtcactcaggtgagtgtatcaccttggataaggtgtgtaacatggcgcgcgactgtcgtgattggtcggacgaaccgatcaaggaatgcggaactaatgcatgccttgataataatggtggatgtagccatgtttgtaacgatcttaagattggctatgagtgcctgtgtcccgatgggtttcaattagttgcgcagcgccgctgcgaggatatcgacgaatgccaggatcctgacacctgcagccagctatgtgtgaacctggaaggcgggtacaagtgccagtgcgaagaaggttttcaattggaccctcatacaaaagcttgtaaagcggtggggtcgatcgcgtacctgttctttaccaatcgccacgaggtgcggaagatgactctcgatcgcagcgagtacacaagcctcattcctaacttgcgtaatgtagttgccctcgacaccgaggttgcatccaaccgcatctactggtccgatttgtcccagcggatgatctgctcaactcagttggatcgagcccacggtgtctcaagctatgacactgttatttctcgggatatacaagcccctgacgggctagcagtggactggatccattctaatatctattggactgatagtgtacttggtacggtttctgtggccgacacaaagggagtcaagcgaaaaacattattccgagaaaacggatctaaaccaagggccattgtggttgacccggtgcacggtttcatgtattggactgactggggtacgccggcgaaaattaagaagggtggcctcaacggtgtggacatatattcgctggttaccgagaatatccagtggcctaacggcatcacactggatctcctttcgggtcgcttgtattgggtggactccaaactgcatagcatatctagtattgatgtgaacggtggaaaccgtaaaaccattctcgaggatgagaaacggctagcccaccctttcagcttagctgtgttcgaggataaagtgttttggacagatataatcaatgaggccatattttccgcgaatcggctcaccggttccgatgtcaatctcttggctgaaaatcttctttcgcctgaggacatggtccttttccacaatcttacacagcccaggggggtgaactggtgcgaacgcaccacacttagtaacggcggctgccaatatctctgtctcccagcgccccaaattaatccgcatagtccaaaatttacctgtgcttgccccgacggcatgctactcgcacgagatatgcggagttgtttaacagaagcagaggccgccgtcgctactcaggagacaagtacggtccgtcttaaggtcagttccacggcagtacggacacagcatacgactacccgtcccgtgccagacacgagcaggctgcctggtgccacgccaggtctaacaacggtcgagatcgtgactatgtcgcatcaagccctaggagacgtcgcaggcagaggtaatgaaaagaagcctagctctgttagggctttgtccatcgtcctccccattgtactcttagtcttcttatgcctaggagttttcctgctttggaagaactggagactgaagaacatcaacagtatcaattttgacaatcctgtctatcagaagacgactgaggatgaggtacacatctgccataaccaggacggctattcttatccaagccggcagatggttagtctcgaagatgatgtcgct

SEQ ID NO: 516 - DNA, 2580 bp, Artificial Sequence
  Description of Artificial Sequence: Synthetic Transcript Sequence
atgggaccctggggttggaaactgcgttggacagtcgctcttctcctcgctgccgctgggaccgcagtcggcgaccgatgtgagagaaatgagttccagtgtcaagatggcaagtgtatcagttacaagtgggtctgtgacggtagtgctgaatgtcaggatggctcagacgaatcacaggagacatgcctatctgtcacgtgtaagtctggcgatttctcctgcggcggtagagtcaaccgctgcatcccccaattttggcgatgcgatggccaggtcgattgtgacaacgggtctgacgagcaggggtgtccccctaaaacatgtagccaggacgagttcagatgccacgatggaaaatgcatctcacgacaatttgtctgtgactccgatcgtgactgccttgatggatccgatgaggccagctgccctgtactgacctgcggtcctgcttccttccagtgtaacagctctacgtgtatcccccagctttgggcatgtgataacgacccagactgcgaggacggctctgacgagtggcctcagcgctgccgaggtctttatgtttttcaaggggatagctcaccttgctccgcctttgaattccactgcctgagcggggagtgtattcatagctcctggaggtgtgacggggggccggattgcaaggacaaaagcgacgaagaaaactgtgccgttgcgacctgccgccctgacgaatttcagtgtagcgacggcaattgcatacatggttctcggcagtgtgatagagagtatgactgtaaggacatgagcgatgaggtaggctgcgtcaacgtcacactgtgcgaaggccctaataagttcaagtgtcattctggcgagtgcataacactggacaaagtgtgcaatatggcccgggattgccgggattggagcgacgagcctatcaaagaatgtgggacaaacgcttgcctcgacaataatggcggatgcagccacgtttgcaacgaccttaaaatcggatacgagtgcttgtgcccagacgggttccagttagtcgcccagcgtaggtgtgaagatattgatgagtgccaggatccagacacctgttctcagctgtgcgtgaacctcgagggcggttataagtgccaatgtgaagaagggtttcagctcgacccccacacaaaagcatgcaaagccgtgggctccatcgcatacctcttcttcacaaaccgacacgaagtcaggaagatgacactggaccgatccgagtacaccagtctcatccctaacctgcgaaatgtggtggctctagacacagaagtggcgtccaaccgcatctattggtccgacctctctcagagaatgatctgctctactcagctagaccgagcacacggagtgagttcatatgatacagtcattagcagagatatacaggccccggacggccttgctgtggactggatacactcaaacatctattggaccgattccgtactcggaaccgtgtctgtagcagacaccaagggagtgaaacgtaagaccctgttccgggagaacggctcaaaaccaagggctattgtggtcgaccctgtgcatggcttcatgtattggaccgactgggggacccctgcaaagatcaagaaaggcggattgaacggcgtggatatctactcactcgtgaccgagaacattcagtggcctaatggtatcacattggatctgttgagtggtcggttgtactgggtagactccaagctgcattcaatctcatccatcgatgtcaacggtggtaatcgcaagacgatacttgaagacgagaaaaggcttgctcacccgttctctctggcagtgttcgaagacaaagtgttctggacagatatcatcaacgaagcaatcttctcagcaaatcggctgacaggatctgacgtgaatttgctcgcagagaatctgctgagccccgaggacatggtcctgttccataacctgacccagccccggggtgtgaattggtgtgagcgcactactctgtcaaacggaggatgtcagtacctgtgtctgccagctccccagatcaacccgcacagcccaaagttcacctgcgcgtgccccgatgggatgctgctcgccagggatatgcggtcttgcttgactgaggcggaagcggccgtggcgacgcaggagacctcaaccgtcagactgaaggtgagctccacagccgtgagaactcagcatacgacaacgcgaccagttccagatacctcccggctgcctggagcgacacccggcctaactaccgtggaaatcgtgaccatgtcacaccaggcactgggagacgtggccggccggggcaacgaaaagaagcccagcagcgtgcgggcactgagcatcgttcttcccattgtgctgctggttttcctatgtttaggtgtgtttctgctgtggaagaactggcgccttaaaaatatcaatagcatcaatttcgacaaccctgtgtaccagaagactaccgaggatgaagtgcacatctgccataatcaggacggctactcttacccatcaaggcagatggtaagtctcgaggacgacgtggca

SEQ ID NO: 517 - DNA, 2580 bp, Artificial Sequence
  Description of Artificial Sequence: Synthetic Transcript Sequence
atggggccctggggatggaagctccggtggactgtggccctcctcctggccgcagctgggacagccgtcggagacaggtgtgaacgcaatgagtttcagtgccaggacggaaagtgcataagctataagtgggtgtgcgatggatcagctgagtgccaggacgggtccgacgagagccaggagacatgcctgtccgtgacctgcaagtctggtgatttcagttgcggtggtagagtcaatcgatgcatcccacagttttggcgctgtgacggtcaggtcgactgcgacaatggcagtgatgagcagggctgtccacctaagacgtgttctcaggacgaatttcgctgccacgatggaaagtgcatatcaaggcagttcgtgtgcgactcagacagggactgtttagacgggtcagacgaggcttcctgtccggtgctaacttgtggccctgcttcctttcagtgcaactcaagcacctgcattcctcaactatgggcctgcgacaacgatccagactgtgaggacggttcagatgagtggccacagaggtgtaggggactgtacgtcttccaaggggacagctccccctgctctgccttcgagtttcactgtctctcaggtgaatgtatccattcaagttggaggtgtgacggcgggcccgactgcaaggataaatcagacgaagaaaattgcgcagttgccacttgccggcccgatgagttccaatgcagtgacggcaattgcatacacgggtctcggcaatgcgatagagaatatgattgtaaggacatgagtgatgaggtgggttgcgtaaacgtaacactgtgtgagggtcccaataagtttaaatgtcattctggagagtgcatcacgctagacaaggtgtgcaatatggcaagggattgccgtgactggtccgacgaacctatcaaagagtgcgggacgaatgcatgtctggataataatggcggctgctcccatgtctgcaacgatctcaagatcggctatgaatgcctgtgccctgacggatttcaactggtcgcccagcgaagatgcgaggatatcgatgaatgccaagacccagatacctgctcacaactttgtgtcaacctggaaggtggctataagtgccagtgtgaggaaggcttccaattagacccccacaccaaggcttgcaaggccgtcggtagcatcgcctatttgtttttcaccaatcgccacgaggttagaaaaatgacattagaccgcagcgaatatacttctctaatacccaacttgcggaatgtggtggccctcgacaccgaggtggcaagtaatagaatctactggtcagatctgtcccagcggatgatatgtagcacacagctcgaccgggcgcacggcgtgtcatcctacgatactgtcatctctcgggacatccaggccccagacggtcttgcagtggactggattcatagcaacatctactggaccgattccgttttgggtaccgtatccgttgcggataccaagggggtgaaacggaagaccctgttccgcgagaatggttcaaagccaagagctattgtcgttgacccagtacacgggtttatgtattggacggactggggcacccccgccaagataaagaagggcggtctcaacggggtggatatatatagtctggttaccgagaacattcagtggccaaatggcataacactggacctgctgtcaggcagactgtattgggtcgactccaagttgcattcgatttcaagtatcgatgtgaacggtggcaaccgcaagaccattctcgaagacgaaaaacgccttgcccatcccttttcacttgcggtgtttgaggacaaggtattttggactgacataattaatgaagcaattttctccgccaacagactgacgggctcggacgtgaacttgctcgcagagaacttgctatcacccgaggatatggtgctgttccacaacttaacacaaccccgcggggtaaactggtgtgaaagaactaccttatccaacggcgggtgccagtacctctgcctgcctgcccctcagattaatccgcactccccaaaatttacatgcgcctgccctgatgggatgctgcttgccagagatatgcgcagctgtctgacagaagccgaggctgcggtggcgacccaagaaacatcaaccgtgcgcctgaaagtgtcgtctactgcagtccgcacacagcacactacgacacgaccggtaccagatacatcgcgactgcctggagctaccccaggtctcactaccgtggagatagtgactatgtcacatcaggctctcggtgacgtcgcgggacgcggcaacgaaaaaaagccttcctcggttagagcactatccatcgtcttgcctattgtgctgctggtgttcctttgtctgggggtgttcctgctctggaagaattggagactgaaaaacatcaattcaattaatttcgataacccagtgtatcagaagaccaccgaagacgaggtgcatatctgccataaccaggacggttattcgtaccccagcagacagatggtctcccttgaggacgacgtagct

SEQ ID NO: 518 - DNA, 2580 bp, Artificial Sequence
  Description of Artificial Sequence: Synthetic Transcript Sequence
atgggtccttggggatggaaacttcggtggacagtggcattgctgctcgccgccgccggcacagccgtcggagatcgctgtgagaggaatgagtttcaatgccaggatggaaagtgtatatcctacaagtgggtgtgtgatggttcggctgaatgccaggacgggtctgatgagagtcaggaaacttgtctgtccgtgacttgtaagtcaggcgattttagctgtggcgggcgcgtgaatagatgcattccacagttctggcgatgtgacggccaggtggattgcgacaacggcagtgatgaacagggttgtcccccaaagacctgtagccaggatgaattcaggtgtcatgacgggaagtgcattagccggcagtttgtgtgcgacagcgatagagactgtttggacgggtccgacgaggcttcctgtcctgtgcttacatgcggccccgcctcgtttcagtgtaattcgtcgacctgtatacctcagctctgggcttgcgacaacgaccccgattgcgaggacgggtccgacgagtggccacagcgttgtcgcggcttgtatgttttccagggagattcatcaccttgttccgcatttgaattccattgtttgagcggcgagtgtatccatagtagctggcgatgtgatggcggtcccgattgtaaggataagagcgacgaggaaaattgcgcggttgccacatgccgaccagatgagtttcagtgtagtgacggcaactgcatccatggaagtcgccagtgcgatcgtgagtatgattgtaaggacatgtccgatgaggttggttgtgttaacgttacactgtgtgagggaccaaacaagttcaaatgccactcgggagagtgcatcactctggacaaggtatgtaatatggcccgcgattgtagagactggagcgatgagcccatcaaggagtgcggaacaaacgcctgtctggacaacaacggaggatgcagtcatgtgtgcaatgatctgaaaatcggctacgagtgtctgtgtcctgatggcttccagctcgtggcccaaagaaggtgcgaggatatcgacgaatgtcaagacccagacacttgcagtcagttgtgtgtaaacctcgagggaggatacaagtgtcagtgcgaggaaggcttccagctcgacccacatacaaaggcatgcaaggcagtggggtcaatcgcctacctgttcttcaccaacaggcatgaggtgagaaaaatgacactggataggtccgaatatacatcccttattcctaatctgaggaacgtcgtggcactggatacagaggttgcaagtaacaggatctattggtcagacttaagccagcgcatgatctgcagcacccagctcgatcgcgcccatggggtctccagctatgacacagtgatctccagggacatccaggcccccgacggcctggccgtggattggattcactccaatatctattggacagattcggtgctgggaactgtgtcagtcgccgatactaagggcgtgaagcgcaagacactgtttcgcgagaatgggtccaagccgcgggctattgtggtcgaccctgtgcacggcttcatgtactggacagactggggtactcccgccaaaattaagaaggggggactgaatggcgtcgacatctactcattagtaactgaaaacatccaatggcctaatgggataaccctagatctcctgagtggcaggctttactgggtggacagcaaacttcattcaatttcttctatagacgtaaatggtggcaataggaagaccattttggaagacgagaagaggctcgcccaccccttctccctggccgtcttcgaagataaggtgttctggactgatataatcaacgaagcaattttcagtgcaaaccgactgacaggatctgatgtgaacctcctggccgagaaccttctgtcaccggaggatatggtacttttccataatctgacccagcctagaggagtgaattggtgtgagagaacaacgctcagcaacggtgggtgtcagtacctgtgtctgccagcaccccagatcaatccgcatagccccaaattcacgtgtgcatgccctgacggaatgttactggcgagggacatgcgcagctgtttgaccgaagctgaggccgccgtggccactcaggagacctctaccgtgaggttgaaggtgtcatccacagccgtgagaactcagcacactacaacccggcccgtacctgacaccagccgactgcctggagcaacccccggcttgacaaccgtggagattgtaaccatgtctcaccaggccctgggggatgtggctggtagaggcaatgagaagaagccctcatccgtgcgggccctctcaattgtgttgccaatagtgctcttggtcttcctgtgcctcggcgtgttccttctgtggaaaaattggcgactcaagaacatcaattccattaactttgataaccctgtctaccagaaaaccaccgaagatgaggtgcacatttgccacaaccaggatggctactcttacccttcccggcagatggtgtcgctggaagacgacgtggcc

SEQ ID NO: 519 - DNA, 2580 bp, Artificial Sequence
  Description of Artificial Sequence: Synthetic Transcript Sequence
atgggaccttggggctggaagctcagatggacggtcgctctcctcctcgcagcagccggaaccgcagtcggggataggtgtgagaggaatgaattccagtgtcaggatggaaagtgtattagctacaagtgggtgtgtgacggatcggctgaatgccaagatggctccgatgaatcgcaagaaacttgtctctcggtcacctgtaagtccggcgatttttcgtgtgggggccgggtcaatcgttgtattccacaattctggagatgcgacggacaagtggattgtgacaacggttcggacgaacaaggatgtcccccaaagacttgcagccaagacgagttccgatgccatgatggaaaatgtatatccagacaatttgtgtgtgactcagatcgtgactgtcttgatggttcagatgaggccagctgccctgtgcttacttgcgggccggcatcctttcaatgtaactcgtcgacctgtatacctcagctttgggcatgtgacaatgatcccgattgcgaggatgggtccgatgagtggcctcagagatgtagaggactctacgtttttcaaggcgatagctccccgtgctcggcttttgaatttcactgtctttccggagagtgcatccattcctcatggcgctgtgacgggggccctgactgtaaggacaagtcagacgaggaaaattgcgcagtggcaacttgccgaccggatgaattccaatgctcggatggaaattgtatccatggtagcagacagtgtgatcgcgagtacgactgtaaagatatgtcggatgaagtgggatgcgtcaacgttactctgtgcgaaggtccaaacaagttcaaatgccactcgggcgaatgcattactcttgataaggtctgtaacatggccagagattgtcgagactggtccgacgagccgattaaggaatgtggtactaacgcatgtctggacaataatgggggctgtagccatgtgtgcaacgatctcaagattggttacgaatgcctttgtccagatggattccaactggtggcacaacgaagatgcgaggacattgacgaatgtcaagatcctgatacttgctcccaactgtgcgtgaacctggagggcggctataagtgccagtgtgaagaaggtttccaactggaccctcatactaaggcatgtaaggccgtgggtagcatcgcatacctcttcttcaccaaccgacacgaagttcggaagatgactcttgatcgttcggaatacacctctctgatccctaatttgagaaatgtcgtggcacttgataccgaagtggcaagcaaccggatctactggtccgacctttcgcagcgtatgatttgctccacgcagctcgaccgggcacatggtgtgtcgtcgtacgatactgtcatctcacgggacattcaggctcctgacggactcgccgtggattggattcatagcaacatttactggactgactcggtgctgggaacggtgtcagtggctgacaccaagggcgtgaagcggaaaaccctctttcgggaaaacgggtcgaagccgcgggctatcgtggtggacccagtccatggattcatgtattggaccgactggggaactccagccaaaatcaaaaaaggtgggctgaatggggttgatatctacagtctcgtgaccgagaatatacaatggcctaatggaataacccttgatctgctctccggaaggctgtactgggttgattccaaactccatagcattagctcaattgatgtgaatggcggtaaccgcaagactatcctcgaagatgaaaagagacttgcacatccattcagccttgccgtatttgaggacaaagtgttctggactgacattatcaacgaggcgatcttttcggcaaaccggcttaccggttcggatgtgaacctgcttgcagaaaacttgctgtccccggaagatatggtcttgtttcataatcttactcagccacggggagtgaactggtgcgaaaggactactctgtccaatggaggctgccagtacctgtgccttcccgcacctcagatcaacccacattcccccaagttcacttgcgcgtgtccagacggaatgctgctggcaagggatatgaggagctgcctgactgaagcagaggcagccgtggcaactcaagaaacttcgaccgtgaggctcaaggtgagctcgactgcagtgagaactcaacataccaccacccgcccagtgcccgatacttcgcgccttccaggagccactccagggctcaccactgtggaaattgtgaccatgtcgcatcaagcgctcggagacgttgcgggaagaggtaacgagaagaaaccatccagcgtgagagcactctcgatcgtccttcctattgtgcttttggtgtttctctgccttggagtgttcctcctgtggaagaactggagactcaaaaacatcaacagcataaactttgacaaccctgtgtaccaaaaaacgaccgaagatgaagttcacatctgccacaaccaggatggttacagctacccttcgcggcagatggtgtctcttgaggacgacgtcgcg

SEQ ID NO: 520 - DNA, 2580 bp, Artificial Sequence
  Description of Artificial Sequence: Synthetic Transcript Sequence
atgggaccctgggggtggaaattgcggtggaccgtcgccctgctgcttgcagcagccggtaccgccgtgggagatagatgcgaacggaatgagttccaatgccaagatggtaagtgcatctcgtacaaatgggtctgcgacggctcagcggagtgtcaagacggctccgatgagagccaggagacttgcctttcggtcacgtgtaaatcgggtgatttctcgtgcggaggacgggtgaatagatgtatcccccaattctggaggtgtgatggtcaggtcgactgtgacaacggttctgacgagcaaggttgcccaccaaagacttgtagccaggatgaatttagatgtcatgacggtaaatgtatctcacgacagtttgtgtgtgattccgaccgcgactgtctggatggatcggacgaagcatcctgcccagttctgacctgtggacctgcttcgtttcaatgtaactcatcgacttgcatcccgcaactttgggcctgcgacaacgatcctgattgtgaagatggttcagatgagtggccccagcgttgtagaggactgtatgtgtttcagggcgactcctccccatgctcggcattcgaatttcattgcctgtcgggagagtgcatccactcgtcctggagatgtgacggaggtcctgactgtaaagataagagcgatgaagaaaattgtgctgttgcaacttgcagaccggacgaatttcaatgctcggacggaaattgtatacatggatccagacagtgcgatcgagaatatgattgcaaggacatgtcagacgaagtgggatgtgtcaacgtcaccctgtgtgagggacctaataagtttaagtgtcactcgggagaatgcattacgctggacaaagtatgtaacatggcacgcgactgtcgcgattggtcggatgaaccaatcaaagaatgtgggactaatgcgtgtctggacaataacgggggttgtagccacgtctgtaatgatctgaagataggatacgagtgtctgtgtccagacggcttccaattggtggcacaacggcggtgtgaggacattgacgaatgccaagaccctgatacgtgttctcaactctgtgtgaacctcgaaggaggctacaaatgtcaatgcgaggaaggatttcaacttgatcctcacaccaaagcatgtaaggcagtgggttcgatcgcatacctcttcttcactaacagacatgaggtgagaaaaatgaccctcgaccggtccgaatacacttcgctgattcctaatctgcgcaatgtggtcgcgctggataccgaggtcgcttccaacagaatttactggtcagatctttctcaaagaatgatttgctccacccaactggatagggcgcacggagtgtcctcctacgatactgtgatcagtcgtgatatccaggccccagacggtctggcagttgattggattcattcaaatatctactggaccgattcggtgttgggtactgtcagcgtggcagatactaaaggcgtcaaaagaaagacccttttccgggagaacggtagcaagcctcgggcaatcgtggtcgatcctgtgcatggatttatgtactggactgattggggtactcctgcaaagatcaaaaaaggaggcctcaacggcgtggatatctactcgctggtgaccgagaatattcagtggccgaacggcattactctggaccttctgtccggtaggctgtactgggtggacagcaagctccatagcatttcttcaattgatgtgaacggtggtaaccgaaagactatcctggaagatgaaaagagattggcccatcccttttcacttgcggtctttgaggacaaggtgttttggaccgacatcattaatgaagcaatcttctccgccaaccggctgacgggctcagatgtgaaccttctggcggagaacctgctgtctccggaagatatggtcctctttcacaatcttactcaaccacgaggagtcaactggtgtgagagaacgaccctgtcaaacggaggttgtcagtacctttgtctgccagcacctcagatcaatccgcattccccaaagtttacctgtgcctgtcctgatggaatgttgctggcacgcgatatgcgctcgtgtcttacggaagcagaagccgcagtggctacccaggagacttcaaccgtccgacttaaggtgtcctccactgcggtgcgtacgcagcatactaccacgcgtcctgtgccagacacctcgcgcctgccgggggcaactcccggcttgactactgtcgaaattgtgaccatgtcccatcaggctctgggagatgtggcaggccggggaaacgagaaaaagccatcctcggtgcgtgcgctgtccatcgtcttgccaatcgtcctcttggtgttcctttgcctgggagtgttccttctctggaagaattggagactcaagaacattaactccattaactttgataacccggtgtaccaaaagacgaccgaagatgaagtgcacatctgtcacaaccaagatggctactcatacccctcgcgacagatggtgtcgctggaagatgatgtggca

SEQ ID NO: 521 - DNA, 2580 bp, Artificial Sequence
  Description of Artificial Sequence: Synthetic Transcript Sequence
atgggtccgtggggatggaaacttcgctggactgtggctctgctgctcgcggcagcagggaccgccgtgggagacagatgtgaacgcaacgaattccagtgtcaagatgggaagtgtatttcatacaagtgggtctgcgatggatccgcagaatgtcaagacggcagcgacgagtcgcaggaaacttgtctctcagtgacttgtaagagcggagatttttcctgtggcggacgggtgaaccgatgtatcccgcagttttggcgatgtgatgggcaggtggattgcgataacggatccgatgaacagggctgcccgccaaaaacctgtagccaagatgagttcaggtgtcatgatggaaagtgtatttcgaggcagtttgtgtgtgattctgaccgcgactgtctcgatggaagcgacgaggcctcctgtcctgtgctgacttgcggcccggcaagtttccagtgtaacagcagcacttgcattccccaactttgggcatgtgacaatgatccagattgcgaagatggttccgacgaatggcctcaaagatgtagaggactttacgtgtttcaaggtgactcgtccccttgttccgcgtttgaatttcattgtcttagtggagagtgtatccactcgtcctggcgctgtgatggaggtccagattgtaaagacaagtccgatgaagagaactgtgcagtggccacttgccgacccgatgagtttcaatgttctgatggaaactgcatccacggttcacgccaatgcgatagagaatacgactgtaaggacatgtcagatgaagtcggctgcgtcaacgtgacgctctgcgagggtcctaataagttcaagtgccattcaggagagtgcattactctggataaggtgtgtaatatggcaagggattgtagggattggtcggatgagcctataaaggaatgtggcaccaatgcctgccttgacaacaatggcggatgcagtcatgtttgtaatgacctgaaaattggttacgaatgcctgtgcccagatgggtttcaattggtcgcccaacgccgctgtgaggacatcgacgagtgccaggatcccgacacgtgctcacaactgtgcgtgaacctggaaggtgggtacaagtgccagtgcgaagaaggatttcagcttgatcctcatactaaagcatgcaaggcagtgggctcgattgcatacttgttctttaccaatcggcacgaagtgcgtaaaatgacgctggacagatcggaatacacctccctcattcctaaccttagaaatgtggtggcacttgatactgaagtggccagcaacagaatttactggtccgatctttcacagcgtatgatatgtagcacccaactggacagagcacatggggtatcgtcatatgatacggtgatttcgagggacatccaggctccggatggacttgcggtcgattggattcacagcaacatttactggaccgactctgtgcttggtacggtgtcggtggcagataccaaaggcgtcaagcgtaagacgcttttcagagagaatgggtccaagcctcgagcaattgtggttgacccagtccatgggttcatgtactggactgactggggaactcccgctaagattaagaagggtggtcttaatggagtggacatctacagcctggtgaccgagaacatccaatggcctaatggcatcaccctcgatcttctttctgggagattgtactgggtagatagcaaactccactcgatctcatcaattgacgtgaacgggggtaatcgcaagactatactcgaagatgaaaaaaggttggcccatccattctcccttgcggtgtttgaggataaggtcttttggaccgatatcataaacgaagcgatcttttcggcaaaccggcttactggatcagatgtcaacctgctggcagaaaatcttctctcgcccgaggatatggtgctgtttcacaaccttactcaaccacgaggagtcaactggtgcgagaggaccacgctttccaacggtggttgtcaatacctctgtctgcctgcaccccagataaacccacattcgccaaagttcacctgtgcatgccctgatggcatgttgctggcaagggacatgcggtcgtgtctgaccgaagcggaagcggccgtggcaacccaggaaacttcgaccgtcagactgaaggtgagcagcactgctgtcaggacccagcataccactacccgtcccgtccctgacacctcgagactgcctggtgccacccctggtcttactaccgttgaaatcgtgactatgtcgcatcaggcccttggagatgtggctggacgcgggaatgaaaagaaaccaagttcggtgagagcgctgtcgattgtgcttccaatcgtcctccttgtgttcctttgtctgggcgtgtttttgctctggaagaattggcgcctcaaaaacattaacagcatcaatttcgacaaccctgtataccaaaagaccactgaagatgaggtgcatatttgtcacaaccaagacgggtactcctatccatcccgtcaaatggtatcgctggaggatgacgttgca

SEQ ID NO: 522 - DNA, 2580 bp, Artificial Sequence
  Description of Artificial Sequence: Synthetic Transcript Sequence
atgggcccatggggctggaagctccggtggactgtcgccctgctgctcgccgcagccggtaccgcagttggggatagatgcgaacgcaatgagtttcaatgtcaggatggcaagtgtataagctacaagtgggtgtgcgacgggtcagccgaatgccaggacggctctgacgagtcgcaggagacatgcctgtccgtgacgtgcaagtcgggcgatttttcctgtggtggacgggttaatcgctgtattccacagttctggcggtgtgacgggcaagtggactgtgataatgggtctgatgagcagggctgtcctccaaaaacttgttcgcaggacgaattcagatgccacgatggcaagtgcataagtaggcagttcgtatgcgacagcgatagggactgcttggacggaagcgacgaagcctcttgtcctgtgttgacatgtggaccagctagtttccagtgtaactcatctacctgcatccctcagctgtgggcctgcgacaacgaccccgactgcgaggatggtagcgacgaatggcctcagcgctgtcggggtctttacgtttttcagggggattcgagcccatgctctgcttttgagtttcattgcctgtctggagaatgcattcatagcagctggaggtgcgacggcggccccgattgtaaagacaagtctgacgaagaaaattgtgctgtggctacttgcagacctgacgaatttcagtgctctgatggcaattgtattcatggcagtcggcagtgcgatagggaatatgattgtaaggatatgtctgacgaggtgggttgtgttaatgtgacgctgtgtgaggggcccaacaaattcaagtgccacagcggggagtgcatcaccctcgacaaagtgtgcaatatggcgcgtgactgcagggactggagcgacgaacctataaaggagtgcggcaccaatgcatgcttagataacaacggtggctgtagccatgtttgcaacgatctgaaaatcggatatgagtgcctctgccccgacggcttccaattagttgcgcagcggaggtgtgaagacatcgatgagtgccaggacccggacacgtgctcgcagctgtgtgtgaatttggaaggaggctacaagtgccagtgcgaggaaggcttccagctggaccctcatacaaaagcctgtaaggctgttgggtccatcgcatatttattctttaccaatcggcacgaagtcaggaagatgaccttggaccggtctgaatacaccagcttgatcccaaatttaaggaatgtcgtggctttggataccgaggtagcttccaatagaatctactggtcggacctctcccagaggatgatttgttctacccagctggatcgtgcccatggcgtgagctcttatgataccgtgatcagccgcgatatccaagcacctgatgggctggcggtggactggatacactccaacatctattggactgacagtgtgcttggcaccgttagtgtcgccgatactaaaggggtaaaaagaaaaaccttgttccgagaaaacggatctaaacccagggcgattgtggtggaccctgttcatggattcatgtactggacagactggggaactcccgccaagattaagaagggggggttaaacggcgtggacatttattcactcgtgactgagaatatccagtggcccaatggtatcacgctagatctgctctcgggtcggctttactgggttgactcaaagctgcattccatctcatctatcgatgttaacggcggaaatcgaaagaccatcctggaagacgagaagcgtctggcacatccattttccttagcagtattcgaagacaaggtgttctggactgacattattaacgaggctatctttagtgcaaaccgtttgactggctccgacgtgaacctgctggccgaaaacctgctaagcccggaagacatggtgttattccacaacctgacccagccgcggggagtcaactggtgtgagcgaacaaccctctctaacggcggctgtcaatatctatgcttgcctgcgcctcagataaacccacacagcccaaagtttacttgtgcatgcccagatgggatgctgctagccagagatatgcggtcctgcctgacagaggccgaagccgctgtggcaactcaggagacgagcacagtgcgactgaaggttagtagcaccgcagtgagaactcagcacaccaccactcgtcctgtaccagatacttctcgattacctggtgcaacaccgggactaactaccgtcgagatcgttacaatgtctcaccaggctctgggagatgtagctggcagaggaaatgagaagaagcccagcagcgtacgcgcgttgtctattgtgctccctatcgtgctactggtattcctctgcctcggagtttttttactttggaagaactggcgactgaagaacataaattccatcaattttgacaacccggtttaccagaagacaacagaggatgaagtacacatatgtcacaaccaggacggctacagctatccatctagacagatggtttccctcgaagacgatgtggca

SEQ ID NO: 523 - DNA, 2580 bp, Artificial Sequence
  Description of Artificial Sequence: Synthetic Transcript Sequence
atggggccgtggggatggaagctgcggtggaccgtggctctcctcctggccgcggccggaaccgctgtcggtgaccggtgtgaaagaaacgaattccagtgtcaagatggaaaatgcatctcctacaagtgggtgtgcgatggatccgccgaatgccaggacggatcggacgagtcccaagaaacttgcctgtcggtgacgtgtaagtcaggagatttctcgtgcggagggagggtgaacagatgtatcccccagttctggagatgtgacggccaggtggactgtgacaacgggtcagacgaacaggggtgcccgccgaaaacttgttcccaagatgaattcaggtgtcacgacggcaagtgcatctcacgccagttcgtctgcgactcggaccgggactgcctggacgggtcggacgaggcttcctgcccggtgctgacgtgtggacccgcgtcgttccagtgcaattcctcgacttgtattccgcagctgtgggcctgcgacaacgacccggactgcgaggacggctcagacgaatggccccaacgctgccgaggcctgtacgtgttccaaggcgattcatccccgtgttccgccttcgaattccattgcttgagcggggaatgcatccactcgagctggcggtgtgacggcggtcccgattgcaaggacaaatcggacgaagaaaactgtgcggtggcaacgtgtcggccggacgaatttcagtgttctgatggaaactgcatccacggcagccggcaatgcgaccgggagtacgattgtaaggacatgagcgacgaagtcggatgcgtgaacgtcaccctgtgtgaaggtcctaacaagttcaaatgccacagcggcgagtgcatcacccttgataaagtgtgcaacatggccagagactgccgcgattggtcggacgagccgatcaaagaatgcggaaccaatgcgtgcctggacaacaatgggggatgttcacatgtctgcaatgacctcaagatcggttatgagtgcctgtgtccggacgggttccagttggtggcccaaaggcggtgcgaagatattgacgagtgtcaggaccccgacacttgctcccagctgtgtgtgaaccttgaaggcggatacaagtgccaatgcgaagagggcttccagctggatccgcacaccaaagcgtgtaaggctgtgggaagcatcgcctacctcttcttcactaaccggcacgaggtgcggaagatgactctggataggtcagaatatacgtcgctgatccccaatttgcggaacgtcgtggcgctggatacggaagtcgccagcaaccgcatctactggtcggatctttcgcagagaatgatctgctccacccaactggatcgcgcacatggggtcagctcgtacgacaccgtgatcagccgcgatatccaggctccagatggactggcggtggattggatccattcaaacatttactggactgactctgtgcttggaaccgtgagcgtggctgacaccaagggagtgaagcgcaagactttgttccgcgaaaacgggagcaagccgcgagcgatcgtggtggatccggtgcacggcttcatgtactggacggactggggcaccccggcaaagatcaagaaagggggtctgaacggagttgacatctactccctggtgaccgagaatatccaatggccgaacggcatcactctcgatctgctgtcaggtaggctgtactgggtcgactcgaagctgcattcgatcagctcaatcgatgtcaacggaggaaaccgcaagaccatcctcgaagatgaaaagcggctggcgcacccattctcgctcgccgtgtttgaggacaaggtcttttggaccgacattatcaacgaggcgatcttttcggccaaccgcctcacgggaagcgatgtgaacctgctggccgaaaatctcctctcaccggaggacatggtcttgttccataacctgacccagccgagaggtgttaactggtgcgaacggaccacgctttctaatgggggatgccagtacctgtgcctccctgcgccacagatcaatcctcatagcccgaagtttacttgcgcctgccccgacggaatgttgctcgccagagacatgcgctcgtgcctcactgaagccgaggcggcggtcgcaacccaggaaacttcgaccgtgcggctgaaggtgtcctccactgcagtgcgcacccaacataccactaccagaccggtgccagatacctcgagacttcctggggccactcccggactgaccaccgtggagatcgtcactatgtcgcaccaggcgctcggtgacgtggcaggaagagggaacgagaagaaaccgtcctcagtgcgggctctgtccattgtgctgcctatcgtgctgctcgttttcctgtgcctcggcgtctttctgctgtggaagaattggcgactgaagaacatcaatagcatcaacttcgacaatcctgtctaccaaaagaccaccgaggatgaggtccacatctgtcataaccaagacggctactcctacccatcccgccaaatggtgtcgctggaagatgatgtggcc

SEQ ID NO: 524 - DNA, 2580 bp, Artificial Sequence
  Description of Artificial Sequence: Synthetic Transcript Sequence
atggggccatggggatggaagctgcggtggactgtggccctgctgctggcagcggctggtactgcggtcggagacagatgcgaacggaacgaattccagtgtcaagacggaaagtgcatcagctacaaatgggtctgcgatggatccgccgaatgccaagacggttcggacgaatcacaggagacttgcctgtctgtgacttgtaagtccggagatttctcgtgcggcggacgcgtcaaccgctgcatcccgcagttctggcgctgtgacggtcaagtggactgcgataacgggtccgacgagcagggctgcccgcctaagacttgttcgcaggacgagtttcggtgtcacgacggcaagtgtatttcccgccagtttgtgtgcgactccgaccgcgactgcctcgacggatcggatgaagcgtcatgcccagtgctcacttgcggaccagcctccttccagtgcaactcttcgacttgcatcccccaactgtgggcctgcgataacgacccggattgcgaagacggatctgacgaatggccacagcgctgcaggggcctgtacgtgttccaaggcgactcgtcaccgtgctccgcttttgaattccactgcctgtcgggagaatgcatccatagcagctggagatgcgacggcggacccgattgcaaggacaaaagcgacgaagaaaattgcgccgtggccacttgccgcccggatgagttccaatgctcggatggaaattgcatccacgggagccggcaatgcgacagagagtacgattgcaaagatatgagcgacgaggtcggatgcgtgaatgtgaccctttgcgaagggcctaacaagttcaagtgccactcgggggaatgcatcactctggacaaagtgtgcaacatggcacgagactgccgggactggtcggatgagccaatcaaggagtgtggaactaacgcttgcttggacaacaacggcggttgttcacatgtgtgtaacgatctcaagatcggatacgagtgtctgtgcccggacgggttccagctggtggcgcaacggcggtgcgaggacatcgatgaatgccaagatcctgatacctgctcgcagctgtgcgtcaatctggaaggtggttacaagtgccagtgcgaggaagggttccaacttgacccgcacaccaaggcttgcaaagccgtcggaagcatcgcttatctgttctttaccaaccgccacgaagtgaggaaaatgaccctggacagaagcgagtacacctccctgatccctaatctgcggaacgtggtcgcgctcgacaccgaagtggccagcaaccggatctactggtctgacctgagccaacgaatgatttgcagcacccagttggaccgggcccatggtgtgtcgagctacgacacggtgatcagccgggacattcaggcgccggacggcctggctgtcgattggatccatagcaacatttactggaccgactcagtgctcggaactgttagcgttgctgacaccaagggagtgaagcggaaaactctcttcagagagaacggtagtaagccaagagctatcgtcgtagatccggtgcacggtttcatgtattggacggattggggaacgcccgcgaagatcaagaagggaggactcaatggagtggatatctacagccttgtcaccgagaacatccagtggccgaacggaatcaccctggacttgctgtccgggagactttactgggtggactcgaagctgcactcgatctccagcatcgacgtgaatgggggaaatagaaagaccatcctcgaggacgagaagcggctcgctcatcccttttcgctcgctgttttcgaggacaaggtgttttggacggacatcatcaacgaggccatcttttccgctaatcgcctgaccgggtcggatgtcaacctgctggcggaaaatctgctttcccctgaagacatggtgcttttccataacctcacgcagccccgcggagtcaactggtgcgagcgcactactttgtcaaacggagggtgccagtacttgtgtctcccggctccgcagatcaacccacacagccccaaattcacctgtgcatgccccgatggaatgctgctcgcccgggacatgcggtcctgcctcactgaagcggaggctgcggtcgcaacccaagagacttcgaccgtgcggcttaaagtgtcgtcgactgccgtccgcacccagcatactaccacgcggccggtgcctgacaccagccgcctcccaggcgcgactccaggactgacgacggtcgagatcgtgaccatgagccaccaggcactcggcgatgtggccgggcgcggaaatgagaaaaagccatcgtccgtgcgggccctttccatcgtgctgccgatcgtccttttggtcttcctctgcctcggggtcttcctcctgtggaagaactggcgcctgaagaacatcaacagcatcaacttcgataatcctgtctaccagaagactacggaagacgaggttcacatctgccataatcaggacggatacagctacccatcacggcaaatggtgtcccttgaagatgacgtggca

SEQ ID NO: 525 - DNA, 2580 bp, Artificial Sequence
  Description of Artificial Sequence: Synthetic Transcript Sequence
atgggtccatggggctggaaactgagatggaccgtagccctgctcctggcggccgcaggaacggcggtcggagatcgatgcgagaggaatgagttccagtgtcaggacggcaagtgtatatcgtacaagtgggtctgtgacgggtcagccgaatgtcaggatggttcggatgagtcgcaggagacgtgtctgtccgtcacttgcaagtcaggagatttctcatgtggaggacgggtgaacagatgcattccgcagttctggcggtgtgatgggcaagtcgattgtgacaacggatcggacgaacaagggtgcccgccaaagacctgttcgcaggacgaattcagatgccacgatggtaagtgtatctcgcggcagttcgtgtgcgattccgaccgggattgcctggatggatcagacgaggcgtcgtgccctgtgctgacctgcgggcctgcctcgttccaatgtaattcgtcgacctgtatcccccagctctgggcctgcgacaatgatcctgactgcgaagatggttcagacgagtggccccagagatgtaggggactgtacgtgtttcagggagacagctcgccttgtagcgcattcgagtttcattgccttagcggagaatgcatccattcatcctggcgctgcgacgggggaccggactgtaaggacaagtccgacgaagagaattgcgccgtcgcgacttgccggccggacgaattccagtgctcggacggtaactgtattcatgggtcccggcagtgcgaccgcgagtacgactgcaaagacatgtccgacgaggtcggctgcgtgaatgtgaccctctgcgaaggcccgaacaagttcaagtgccatagcggggagtgcatcacccttgataaagtctgcaacatggcccgcgattgccgcgattggtcggacgaaccgatcaaagagtgcggaactaacgcatgtctggacaacaatggaggatgctcgcatgtctgtaacgacttgaagattggctacgagtgcctgtgcccggatggattccaactggtggcccagcggcgctgtgaagatatcgacgaatgccaggacccagacacttgctcgcaactctgtgtgaacctggaaggagggtacaagtgccagtgcgaggaaggattccagcttgatccgcacactaaggcctgcaaagcggtgggatcaatcgcttacctgttctttaccaatagacacgaggtcaggaagatgactttggatcgcagcgagtacacgtccctgatccctaaccttcggaacgtggtcgccctggataccgaagtggcgtccaacagaatctactggtcggatctgtcgcagcgcatgatctgctctactcaactggaccgggcccacggagtgtcgagctacgacaccgtcatctcgagggacatccaagctccagacggactcgccgtcgattggatccactccaatatctactggaccgattcagtgctggggaccgtctccgtggcagacactaagggagtcaagagaaagacgttgtttagggagaatggttccaagccgcgcgccatcgtggtcgatcccgtgcatgggttcatgtactggaccgactggggaaccccggctaagatcaaaaaggggggactcaacggcgtggacatatacagcctcgtgactgagaatatacagtggcccaacgggattacgctggacctccttagcggaaggctgtactgggtcgactccaagctgcactcgatctcatcaattgacgtgaacggaggcaaccgcaagacgattctggaggacgagaagcggctcgcacatccgttctcgctcgccgtgttcgaagataaggtgttctggaccgatatcatcaacgaagctattttctccgccaaccgcctgactggatccgatgtgaacctgttggcggaaaacttgctgagcccagaggatatggtgctgttccacaacttgactcagccaaggggagtgaactggtgcgaaaggactaccctgagcaacggcgggtgccaatacctgtgccttcccgcgccccaaatcaatccgcactccccgaagttcacttgcgcttgccctgatggaatgcttctcgccagagatatgaggtcgtgcctgaccgaagcggaggcagccgtggccacccaggaaactagcacggtgcggctgaaagtctcgagcacggctgtgcggactcaacataccactactcgccctgtgccggacacctcccggttgccaggcgcgactcccggactgaccactgtggaaatcgtgaccatgtcacaccaggctttgggagatgtggcaggacgcggcaatgagaagaagccgtcgagcgttagagcattgagcatcgtcttgccgattgtcctcctcgtctttctgtgcctgggagtgttcctgctgtggaaaaactggcgcctgaagaacatcaactccatcaactttgacaaccccgtgtaccaaaaaactaccgaagatgaagtgcacatctgtcacaaccaggatggctactcgtaccctagccggcagatggtgtccttggaagatgatgtggcg

SEQ ID NO: 526 - DNA, 2580 bp, Artificial Sequence
  Description of Artificial Sequence: Synthetic Transcript Sequence
atgggtccttggggatggaaactccgctggacagtcgctctactgctggccgccgcaggaactgccgttggtgaccgctgcgaacgcaacgagtttcagtgccaggatggcaagtgcatctcttacaaatgggtgtgcgatgggtcggcagaatgtcaggacggtagcgacgaatcccaagaaacatgcctgtccgtcacctgcaaaagcggcgatttcagttgcggcggtagagtgaatagatgtattccgcagttctggagatgcgatgggcaagtggactgtgacaatgggagtgatgaacaggggtgcccgcccaagacatgtagtcaggacgaattcaggtgtcacgacggcaaatgcatctctaggcagttcgtctgtgatagcgatcgggattgtcttgatggatctgatgaggcctcatgtccagtattgacttgcggacctgcttctttccaatgtaactcatccacttgcatacctcagctgtgggcttgtgacaatgatcctgattgcgaggatggcagcgatgagtggcctcaacggtgtcgtggcctctacgtattccaaggggacagctccccctgtagtgccttcgagtttcactgcttaagtggcgagtgtatccatagtagctggagatgtgatggcggtccggattgcaaggacaagtctgatgaggagaattgcgctgttgctacgtgtcgccccgacgaatttcagtgcagcgatggcaactgcatccatggcagcagacagtgcgacagagagtacgactgcaaagacatgagcgacgaagtgggttgtgtgaatgtgaccctatgcgagggccccaataaattcaagtgtcactccggggagtgtataacactagataaggtttgcaacatggcccgcgactgtcgtgattggagtgacgaacctatcaaagagtgcggaacaaacgcatgcctggataacaatggcggctgtagtcatgtgtgcaacgatttgaagattggctatgaatgcctatgccctgatggctttcagttggtggctcagcgcagatgcgaggacatcgatgaatgtcaggaccccgacacctgctcacagctgtgcgttaatcttgagggcgggtataagtgccagtgtgaggagggcttccagctcgatccacacaccaaggcatgtaaggctgtggggtcaatcgcctatcttttctttaccaaccgccacgaggttcggaaaatgacactggaccgcagcgagtatacatcactgatcccgaacttgaggaatgtggtcgccttagataccgaggtcgcttctaacaggatctattggtcagacctttctcagaggatgatctgctctacacagcttgaccgggcgcacggagtcagttcctatgacaccgtcataagccgcgacatccaggctccagatggtctcgccgttgactggattcattcaaacatctactggaccgatagtgtgctgggcacagtcagcgtggctgacacgaagggcgttaaaaggaaaaccctgtttcgggaaaatgggtctaagccccgagccattgtggtggatccagtgcacggctttatgtactggacagattggggtactcctgctaagattaaaaaaggaggacttaatggggtagacatctatagcctggtaaccgaaaacatccaatggcccaatgggataactctagacctcctgagcgggagactgtactgggtagacagtaaacttcactcaatttcctccatagacgtgaacggcgggaatcgaaagactatattagaagacgagaagcggctggcacatccattcagcttggctgtctttgaagacaaggtattctggaccgacattatcaatgaggcaatatttagcgctaatcgcttgacagggtctgacgtaaatctccttgccgagaatctcctgtcccctgaagacatggtcttgttccacaatctgacccaacctaggggtgtgaactggtgtgagagaactacactaagtaatggtggatgtcagtatctctgcctgcctgcgcctcagatcaacccgcattcccctaagtttacatgtgcatgcccagacgggatgttgcttgcacgcgatatgcggtcttgtcttactgaggcagaggcggctgtggccacacaggagactagtaccgtgcgtttaaaagtaagctctaccgcagtccgcacccagcatacaacgacacgtccagtcccggatacatctcggctgcctggcgccacacccggtcttaccaccgtcgaaattgtcacaatgagtcatcaggcgcttggggacgtggctgggaggggcaatgaaaagaaacccagttccgtgagagcgttgagcattgtgctgcccattgtcctgctagtgtttttatgtttgggcgtgttcctgctgtggaaaaactggcgactgaagaacataaactccattaactttgacaatcctgtatatcaaaagaccacggaagacgaggtccatatctgtcataaccaggacggctactcctacccatccagacagatggtttccttggaagacgatgttgcc

SEQ ID NO: 527 - DNA, 2580 bp, Artificial Sequence
  Description of Artificial Sequence: Synthetic Transcript Sequence
atgggtccttggggctggaaactgaggtggaccgtcgcattactgctggcagctgccgggactgcggttggagaccgttgcgaacgcaacgagttccagtgtcaggatgggaagtgcatcagctacaagtgggtatgcgacggttccgccgaatgccaggacgggtccgacgagagtcaggaaacttgtctgtctgtaacatgcaagtccggggatttctcgtgcggaggccgggtgaatcgctgtatcccgcaattttggagatgtgacgggcaggtagattgcgacaacggcagtgacgagcagggttgcccgcctaaaacctgctcacaagacgaattccgatgtcacgacgggaagtgtatcagtcggcagtttgtgtgcgacagtgacagagattgtcttgatggatcagatgaagcttcctgtcccgtacttacttgtggaccggcctcattccagtgcaatagtagcacatgcatcccccagctgtgggcctgtgataacgacccagattgtgaagatggcagcgatgaatggccccagcgctgcagaggtttgtacgtgtttcagggagactcatctccctgttccgccttcgagttccattgccttagtggtgagtgcatacattcaagctggcgatgcgacggcggccccgattgtaaggataaaagcgacgaggagaactgcgccgtcgcaacttgccggccggacgagttccagtgttcagacgggaactgtattcacggttcccgccagtgtgaccgagagtacgattgtaaggatatgtccgatgaagtgggctgcgtgaatgtgaccttgtgtgagggccccaacaaattcaagtgccattcaggtgagtgtattaccctcgacaaggtgtgcaacatggctcgcgactgtcgggactggtcggacgagccgattaaggagtgtgggaccaacgcctgcctggataataacggcggctgctctcacgtgtgcaacgacctgaaaattggctatgagtgcctctgccctgatggctttcaactcgtggcacagcggaggtgcgaagacatcgatgaatgtcaggacccagacacttgtagccagctgtgcgttaatctagaaggaggctacaagtgccagtgtgaggagggttttcaactggacccgcataccaaagcctgcaaagccgtcggcagcatcgcgtacctgttctttactaatagacacgaagtcaggaagatgaccctggatagaagtgagtacacaagtctcatcccaaatctgcggaatgtggtggccctggacaccgaggtagcaagtaatagaatatactggtctgacttatcacagcggatgatatgcagtacccagttggatcgtgcccatggagtttcttcttacgacacggtgatatctcgggatatacaggctcctgatggactggcggttgactggattcattccaatatctattggactgatagtgtgctcggcactgtaagtgttgccgacaccaaaggggtgaagaggaaaacgttattcagagagaatgggtctaagccaagggctatagtcgtggatcctgtgcatggcttcatgtactggaccgactggggcaccccggcaaagatcaagaagggcggcctgaacggagtggacatttatagcctcgtgacagaaaacatacagtggccaaacggcattacattagacctcctctcaggcaggttgtactgggtggactcaaagttacactctataagttcaattgatgtgaatggtggaaatagaaagaccattctggaagacgagaagcggctggcccatcctttttcccttgctgtcttcgaagacaaagtgttctggacggacatcattaatgaagctatcttttcagctaaccggctaaccgggtcagatgtgaacctgctggccgagaacctgctctcgcctgaagatatggttctctttcataacctcacccagccccggggcgtgaattggtgtgaacgcacaaccctctcaaacggggggtgccagtatctttgtcttcccgcacctcaaatcaatcctcactctccgaagtttacatgcgcttgccccgacggcatgcttctcgctagagatatgcgttcctgcctgacagaagctgaggccgccgtggccacacaggagacaagtaccgttcgactcaaggtgtcctccacggctgtccgtacccagcatacaacgacaaggcctgtgcctgacacatcccgtctccctggggccactcccgggcttaccacagttgagatcgtgactatgagccaccaagcccttggtgatgtcgctggtcggggtaatgagaaaaagccctccagcgtgcgtgctctgagcatcgtgctgccaatcgtcttgctggtctttctgtgcctcggcgtgttcttactatggaaaaactggcggctcaagaacataaactcaataaactttgataaccccgtataccagaagaccacggaggatgaagtccacatttgtcataaccaggatggatattcgtatccttctaggcagatggtgtctctggaagatgacgttgcc

SEQ ID NO: 528 - DNA, 2580 bp, Artificial Sequence
  Description of Artificial Sequence: Synthetic Transcript Sequence
atgggaccttggggatggaagctgagatggaccgtggctcttctgctggctgcagccggaaccgctgtcggtgataggtgtgaacgcaatgagtttcagtgccaagatggaaaatgtatctcgtacaaatgggtgtgtgacggatccgccgaatgccaggatggaagcgatgaatcacaggaaacgtgtttgtccgtgacgtgtaaatccggagatttttcctgtggcggacgcgtgaacaggtgcattcctcagttctggagatgcgatgggcaggtcgattgtgataatggaagcgacgagcagggatgcccccctaagacctgttcccaggatgaatttagatgtcacgacggtaaatgcatttcgcgccaattcgtgtgcgattcggatcgagattgcctcgatggatcagacgaggcgagctgccctgtgctcacttgtggaccagcgtcgttccagtgtaactcgtcgacctgtataccgcaactgtgggcatgtgataacgatcctgattgtgaagatgggtcagatgaatggccccaaaggtgcaggggactttacgtgtttcaaggtgattcgtccccttgttcggccttcgagttccattgtctgtcgggggaatgtattcactcgagctggcgttgtgatggggggccagactgcaaagacaagagcgatgaagaaaattgtgcagtggcgacttgtcgccctgacgaatttcaatgtagcgatggtaactgtatccatggctcccgccaatgtgatcgagagtacgattgcaaagatatgagtgatgaagtgggatgcgtgaacgtgaccctgtgtgaaggtcctaacaagttcaaatgtcattcaggagaatgcattacccttgacaaggtgtgtaacatggccagagattgtcgggattggtcagatgagcctataaaggagtgtggaaccaatgcatgtctggataacaacggtggttgtagccatgtctgtaatgatcttaagattggttacgaatgcctttgcccagatggctttcaactggtcgcacagaggagatgtgaggatatcgacgaatgtcaagatccagatacctgttcgcaactctgcgtgaacctggaaggtggctacaagtgccagtgtgaagaaggttttcagctggatccccataccaaagcctgcaaggcagtgggctccattgcgtatctcttcttcactaataggcatgaagtccgcaagatgaccctggacaggagcgagtacacttcgcttattcctaatctcagaaacgtggtcgcactcgataccgaggtggcatctaacagaatttactggtcggacctgtcacagcgaatgatttgttcgactcagcttgacagagcacatggtgtgtcaagctacgataccgttatctcacgggacattcaagccccagacggattggccgtggattggatacactcgaacatctactggactgacagcgtgcttgggaccgtgtccgtcgcagacactaagggtgtcaagcgcaagaccctttttcgggagaacggttctaagccaagggcaatcgttgtggatccagtgcacggattcatgtactggaccgattggggaacccccgcgaaaatcaaaaagggtggccttaacggtgtcgatatctactcgctggtcactgaaaacattcaatggccaaatggtattacgctggacctgttgtccgggcggctgtactgggtggactctaagctgcattcaatcagctccattgatgtcaatggaggtaatagaaagactatacttgaggacgagaaaaggcttgctcaccctttcagccttgccgtgtttgaagataaggtgttttggactgacattatcaacgaggcgattttcagcgcaaaccggctcaccggatccgatgtgaatctgctcgcggagaacttgctgtcccctgaagatatggtcttgtttcacaatctgacccaaccccgaggggtgaactggtgcgaacgcaccacccttagcaacggaggttgtcagtacctctgcctgcccgccccccagattaatccccacagccccaagttcacctgcgcgtgcccagatgggatgcttttggcaagagatatgcgctcatgtcttaccgaagcagaagcggcagtggcgacccaggaaacttcaactgtgaggctgaaagtctcaagcactgctgtgaggacccaacataccaccaccagaccagtgcctgatacgtcacggctgccgggggcaacccctggacttacgaccgtggaaattgtgaccatgtcgcaccaagcactgggcgacgtggccggacgcggaaacgaaaagaaaccttcgtcggtgcgtgccctgtcaatcgtgcttcctattgtgcttcttgtgttcctgtgtcttggggtgtttctcctctggaagaactggagactgaaaaacattaactcgatcaactttgataacccagtctatcaaaagaccacggaggatgaagtccatatctgtcataaccaagatggatactcgtacccctcacgacaaatggtgtcactggaggacgacgtcgct

SEQ ID NO: 529 - DNA, 2580 bp, Artificial Sequence
  Description of Artificial Sequence: Synthetic Transcript Sequence
atgggaccatggggatggaaactccgctggaccgtggcactgcttcttgcagcagcgggaactgctgtgggtgatagatgcgaacgtaatgagttccaatgtcaagacggtaagtgcatttcgtacaagtgggtctgcgatggatcggcagaatgtcaagatgggtcagacgaaagccaagaaacctgcttgtccgtcacttgtaagtccggagacttctcgtgtggaggtcgggtcaatcgctgcattcctcagttctggaggtgtgatggacaagtggactgtgataacggttccgacgaacagggttgtcctcccaagacctgttcccaagatgaatttaggtgtcacgacgggaagtgtatcagcaggcaatttgtgtgcgattcggatcgggattgtttggatggctccgatgaagccagctgcccggtgctcacttgtggtccagcaagttttcaatgtaactcgtcgacttgtatacctcaactctgggcatgtgacaatgaccctgattgtgaggacggcagtgacgagtggccgcagcgctgcaggggactgtacgtctttcagggcgactcgtcgccctgttcggcatttgagttccattgtttgtcaggagagtgtatccactcctcatggagatgtgatggaggaccagattgtaaagacaagtccgacgaggaaaactgcgcggtggctacctgtcgcccagatgagtttcagtgttcggacggtaattgtattcatggtagcagacagtgtgatcgagaatacgattgcaaggatatgtcggacgaggtgggttgcgtgaatgtgactctctgtgaaggcccaaataagtttaagtgccattcgggtgagtgcatcactcttgataaggtgtgcaacatggcacgcgactgccgcgattggtccgacgaacctatcaaagaatgtggtaccaatgcgtgtctggataacaacgggggttgtagccatgtctgcaatgacctgaagatcggctacgaatgtctgtgtccagacggatttcaacttgtcgcacaacggcggtgtgaagatattgatgaatgtcaggaccctgacacctgtagccaattgtgcgtgaacctcgaaggggggtataagtgtcaatgtgaagaagggtttcagctcgatccacataccaaggcttgcaaagcagtgggatcgattgcctatctgttctttactaatcgacacgaagtgcgaaagatgaccctggacaggtccgagtacacctcgttgattccaaatttgagaaacgtcgtggccctggatactgaggtggcctctaatcgcatttactggtccgatctttcgcagagaatgatttgctccactcagctcgatagagcccatggagtgtcaagctacgataccgtgatcagcagggatatccaggcccccgacggacttgcagtggactggatacattctaacatttactggactgatagcgtcctgggcaccgtgtcggtggcggacaccaagggtgtcaaacggaaaactttgtttcgcgagaacggatcgaaacccagagcaattgtcgtggatcctgtgcacgggttcatgtattggactgactggggaactccagcaaaaatcaagaagggcggtttgaacggagtcgatatctacagcctggtgacggagaacattcaatggcccaatggcattaccctggatcttctctcaggacggctttactgggtcgattcaaaactgcactcgatttcctccatcgatgtgaacggcggaaatagaaagaccatccttgaagatgaaaagagacttgctcatccgttttcgttggccgtgttcgaagataaggtgttctggactgacatcattaatgaagcaatcttttctgcaaatagactgactggctccgacgtgaacctgctggcagaaaatctgctcagccccgaagatatggtcctctttcacaacctcacgcagccaagaggagtcaactggtgtgaacgcaccaccctgtccaatggcggttgtcaatacctttgcctgcctgccccgcagatcaatccgcattcgcccaaattcacctgtgcctgtccagatggcatgctccttgcgagagacatgagaagttgtttgactgaagcagaggctgccgttgctacgcaagagactagcaccgtgcgcctcaaggtgtcgtccactgccgtgaggacccagcatactaccacccggccagtgccagatacttcgcggctgccgggcgcaacgccaggactgaccactgtggagattgtgaccatgagccaccaagcacttggagatgttgcagggcgcggtaatgagaagaaaccttcatcggtgcgcgcactgtccatcgtgttgcctatcgtgcttctggtgtttctgtgtctgggggtctttcttctgtggaagaattggcgccttaagaacatcaacagcatcaattttgataaccccgtgtaccaaaagactaccgaagatgaagtgcatatctgccataaccaagatggatactcctacccttccaggcagatggtatccctggaagatgacgttgca

SEQ ID NO: 530 - DNA, 2580 bp, Artificial Sequence
  Description of Artificial Sequence: Synthetic Transcript Sequence
atgggaccgtggggatggaagctgcgctggaccgtggccctgctgctcgccgcggccgggactgcagtgggtgaccggtgcgagcgcaacgagttccagtgccaagacgggaagtgcatttcgtacaagtgggtctgcgacggtagcgcagagtgccaggacggttccgatgagtcacaggaaacctgcctttcagtgacgtgcaagagcggagactttagctgcggcggaagggtcaataggtgcatcccgcagttctggcggtgcgatggacaagtggattgcgacaatggatcagatgagcaagggtgccccccaaaaacttgctcacaagacgaattccggtgccatgacggaaagtgcatctcgagacagttcgtgtgcgactctgaccgcgactgtctcgatgggtccgacgaagcgagctgtccagtgctgacttgcggacccgcttcgttccagtgcaactcctcgacttgcattccgcaactgtgggcgtgtgacaatgacccagactgtgaggacggatcagatgaatggccgcaacggtgccggggtctgtacgtgtttcagggtgattcgtcgccttgctcggcattcgaattccactgcctgtcgggagagtgcatccattcatcgtggagatgtgacgggggaccagattgtaaggacaaatccgatgaggaaaactgcgcggtggccacctgccggccggatgaattccagtgctcagacggaaactgcatccacggatcccggcaatgcgaccgtgaatatgattgtaaggatatgtccgacgaggtcggatgcgtgaatgtcactctgtgtgagggacccaacaaattcaaatgccattcaggcgagtgtatcacccttgacaaggtttgtaacatggctcgcgattgcagagactggtcagatgaaccaattaaggagtgtggaaccaacgcctgtctggacaataatggaggctgctcgcatgtttgtaacgatctcaagatcggatacgaatgcctgtgccccgatggcttccagttggtcgctcaacggcggtgcgaggatatcgacgagtgccaggatccggacacctgcagccaactctgcgtcaatctcgagggtggctacaagtgccagtgcgaagaaggcttccagctggacccgcataccaaggcttgcaaggcggtgggatccatcgcgtacttgttcttcactaacagacacgaggttaggaagatgactctggatagaagcgagtacacctcactgatcccaaacctcaggaacgtggttgcactggataccgaagtcgcctcgaatcgaatctactggtcggacctcagccaaagaatgatttgctccactcagctggatagagcccatggagtctccagctacgacactgtcatcagccgcgacatccaggcaccggatggactggccgtggactggatccactcgaacatttactggactgactcagtattgggtactgtgtctgtggcggacactaagggagtgaagcgaaagactttgttccgggagaacggatcgaaaccaagggcaatcgtggtcgacccggtgcacggcttcatgtactggactgattggggaaccccggccaagatcaaaaagggcggactgaacggagttgacatctactcacttgtgactgaaaacatacagtggccaaacggaatcaccttggatctgctgtccggaaggctctactgggtcgactcgaagctgcatagcatctcttcaatagacgtcaacggtggcaacagaaagaccattctcgaggacgaaaaacgcctcgcgcacccgttttcgctggctgtgttcgaggacaaggtgttctggactgacatcatcaacgaggccatcttttcggccaatcggctcaccggatcggacgtcaatctcctggccgaaaacctcctttcgccagaggacatggtcctgttccataaccttacccaaccaaggggagttaactggtgcgaacgcaccaccctcagcaacggagggtgtcagtacctctgcctcccagctccacagattaatccacacagccctaagttcacctgtgcatgtccggacggcatgctccttgcacgggacatgcggagctgtctcactgaggcggaagcagctgtcgcgacccaggaaaccagcaccgtccgcctcaaagtgtcatcaactgctgtgcgcacccaacacaccactacccggccggtgccggatacctcgcgcctgccgggcgccactcctggactgaccaccgtggaaatcgtcactatgtcccatcaagcgctgggggatgtggcaggacggggtaatgagaagaaaccttcgtcggtgcgggccctgtcaatcgtcctgccgatcgtgctcctggtgttcctgtgcttgggagtgttcctgctttggaagaactggcggctgaagaacataaacagcatcaatttcgataaccctgtgtaccaaaagacgaccgaggacgaagtccacatttgccacaatcaagacggatactcataccctagccgccagatggtttcgcttgaggacgacgtggcc

SEQ ID NO: 531 - DNA, 2580 bp, Artificial Sequence
  Description of Artificial Sequence: Synthetic Transcript Sequence
atgggcccttggggctggaagctgcggtggacagtggctctgctgctggctgcggctggaactgcggtgggagacagatgtgagaggaatgagtttcaatgccaagacggcaaatgcatctcttataaatgggtgtgtgacgggtcggccgaatgtcaggatggctccgacgaatctcaggagacctgcctcagcgtgacttgtaagagtggggattttagttgcggagggcgagtgaaccgctgtatcccccagttctggagatgtgacggccaagtggactgcgacaatggaagtgacgaacaggggtgccctccaaagacctgttcccaggacgagtttcggtgccacgatggaaagtgcatcagcaggcagtttgtatgcgattccgaccgcgactgtctggacggctccgacgaggcatcgtgcccggtgttgacttgcggacctgcttcattccagtgtaattctagtacctgtatcccccaactgtgggcttgcgacaacgacccagactgcgaggacggctccgacgaatggccccagcgctgtaggggcctgtacgtgtttcagggcgacagttcaccatgcagcgcctttgagttccactgcctgagtggcgaatgcattcatagctcatggagatgcgacgggggacccgattgcaaagataagagtgatgaagaaaattgtgccgtcgccacctgcaggcccgacgaatttcagtgcagcgacggaaactgtatccacgggtcaaggcaatgtgacagagagtatgattgtaaggatatgtccgatgaggtggggtgtgtgaacgtgacactttgcgaggggccgaacaagttcaagtgtcattcaggcgagtgtatcactttagataaggtatgcaatatggcacgcgactgtcgagattggtctgacgagcccataaaagaatgcggcacgaatgcttgtctagacaacaatggcgggtgctctcacgtgtgtaacgatctaaagatcggctacgaatgcctgtgtcccgacggcttccagctggtagcccagcgcaggtgcgaagacattgacgaatgtcaagacccggacacttgttcccaactgtgtgtcaatctggaggggggatataaatgccagtgtgaggaagggttccagctggatccccacacaaaggcctgcaaggccgtggggtctatcgcctaccttttcttcaccaacaggcacgaagtccgaaagatgaccctggacaggtctgaatacactagcttaattccaaatttgagaaacgtggtggcgctcgacacagaagtagccagcaaccggatctactggtcggacctgagccaacggatgatttgctcaacacagctggacagggcacatggtgtatctagctacgatactgtaatctctcgcgacattcaggcccccgacgggctcgccgtcgattggatccactccaatatttattggaccgactcagtgcttggtaccgtctccgtggcagacactaagggcgtgaaacgcaagactttgtttcgcgagaatgggtccaagccccgagctatcgtggttgaccccgttcatggttttatgtactggacagattggggcaccccagctaagattaagaagggcggattgaacggggttgatatctattcactcgttactgaaaatatccagtggcctaatggcattaccctggatctgttgagtggtcggttgtactgggtcgacagcaagctgcattcaatttcctctattgatgtcaatggaggcaatcgaaaaaccatactcgaggatgagaagcgcctggctcacccattctcgttggccgtgttcgaggataaggttttttggaccgatatcattaacgaagccatcttttcagccaatagactgacaggatcagacgtgaacctgctggccgaaaaccttttatcccccgaagatatggttctgttccacaacttgacgcagccacgtggggtgaattggtgcgagcggaccacgctatccaatggcggatgccagtacctctgcctgcctgcccctcagatcaacccgcattctccaaaatttacatgtgcgtgccccgacggcatgctactggctagggatatgcggagctgtttaaccgaagccgaggctgccgtcgccacacaggaaactagcacagtcagattgaaagtctcgtcaactgcggtccgtactcagcacacgaccacaaggccagtgcccgacacgagccgccttcctggagccactccgggtctgactacggttgagatcgtgactatgagtcatcaggccctaggtgatgttgccggccgggggaacgaaaagaagccctctagcgttcgcgcgcttagcatcgtcctgcccattgtgcttctggtgtttctgtgtctcggtgtcttcctcctgtggaaaaactggaggctgaagaatattaatagtattaacttcgataatccagtttaccagaagaccactgaagacgaggtgcacatctgtcacaatcaggatggatacagctatccctctcggcaaatggtctcactggaggacgatgtagca

SEQ ID NO: 532 - DNA, 2580 bp, Artificial Sequence
  Description of Artificial Sequence: Synthetic Transcript Sequence
atgggtccgtggggttggaaattacgatggacggtagcgctattattagcggcggcgggtacggcggttggtgatcgttgtgaacgaaatgaatttcaatgtcaagatggtaaatgtatatcgtataaatgggtttgtgatggttcggcggaatgtcaagatggttcggatgaatcgcaagaaacgtgtctatcggtaacgtgtaaatcgggtgatttttcgtgtggtggtcgagtaaatcgttgtataccgcaattttggcgatgtgatggtcaagtagattgtgataatggttcggatgaacaaggttgtccgccgaaaacgtgttcgcaagatgaatttcgttgtcatgatggtaaatgtatatcgcgtcaatttgtatgtgattcggatcgtgattgtttagatggttcggatgaagcgtcgtgtccggtactaacgtgtggtccggcgtcgtttcaatgtaattcgtcgacgtgtataccgcaactatgggcgtgtgataatgatccggattgtgaagatggttcggatgaatggccgcaacgatgtcgaggtttatatgtatttcaaggtgattcgtcgccgtgttcggcgtttgaatttcattgtctatcgggtgaatgtatacattcgtcgtggcgatgtgatggtggtccggattgtaaagataaatcggatgaagaaaattgtgcggtagcgacgtgtcgtccggatgaatttcaatgttcggatggtaattgtatacatggttcgcgtcaatgtgatcgagaatatgattgtaaagatatgtcggatgaagttggttgtgttaatgttacgctatgtgaaggtccgaataaatttaaatgtcattcgggtgaatgtataacgttagataaagtatgtaatatggcgcgtgattgtcgagattggtcggatgaaccgataaaagaatgtggtacgaatgcgtgtttagataataatggtggttgttcgcatgtatgtaatgatttaaaaataggttatgaatgtctatgtccggatggttttcaattagtagcgcaacgtcgatgtgaagatatagatgaatgtcaagatccggatacgtgttcgcaactatgtgttaatttagaaggtggttataaatgtcaatgtgaagaaggttttcaactagatccgcatacgaaagcgtgtaaagcggttggttcgatagcgtatttattttttacgaatcgacatgaagttcgaaaaatgacgttagatcgttcggaatatacgtcgttaataccgaatttacgaaatgttgttgcgttagatacggaagtagcgtcgaatcgaatatattggtcggatttatcgcaacgtatgatatgttcgacgcaactagatcgtgcgcatggtgtttcgtcgtatgatacggtaatatcgcgagatatacaagcgccggatggtttagcggtagattggatacattcgaatatatattggacggattcggttctaggtacggtatcggtagcggatacgaaaggtgttaaacgaaaaacgctatttcgagaaaatggttcgaaaccgcgagcgatagtagtagatccggttcatggttttatgtattggacggattggggtacgccggcgaaaataaaaaaaggtggtttaaatggtgttgatatatattcgttagtaacggaaaatatacaatggccgaatggtataacgttagatctactatcgggtcgactatattgggttgattcgaaattacattcgatatcgtcgatagatgtaaatggtggtaatcgaaaaacgatactagaagatgaaaaacgactagcgcatccgttttcgctagcggtatttgaagataaagtattttggacggatataataaatgaagcgatattttcggcgaatcgattaacgggttcggatgtaaatttactagcggaaaatttattatcgccggaagatatggttctatttcataatttaacgcaaccgcgtggtgttaattggtgtgaacgaacgacgttatcgaatggtggttgtcaatatctatgtctaccggcgccgcaaataaatccgcattcgccgaaatttacgtgtgcgtgtccggatggtatgttattagcgcgagatatgcgttcgtgtctaacggaagcggaagcggcggtagcgacgcaagaaacgtcgacggtacgtttaaaagtatcgtcgacggcggttcgtacgcaacatacgacgacgcgaccggtaccggatacgtcgcgactaccgggtgcgacgccgggtttaacgacggttgaaatagttacgatgtcgcatcaagcgttaggtgatgttgcgggtcgtggtaatgaaaaaaaaccgtcgtcggttcgtgcgttatcgatagtactaccgatagtactactagtatttttatgtttaggtgtatttctattatggaaaaattggcgattaaaaaatataaattcgataaattttgataatccggtttatcaaaaaacgacggaagatgaagtacatatatgtcataatcaagatggttattcgtatccgtcgcgtcaaatggtatcgttagaagatgatgtagcg

SEQ ID NO: 533 - DNA, 2580 bp, Artificial Sequence
  Description of Artificial Sequence: Synthetic Transcript Sequence
atgggtccgtggggatggaagttgagatggacggtcgcactgttgctggcagccgccggcaccgctgtcggagacaggtgcgaacgcaacgagtttcagtgccaggacggtaaatgcatatcgtacaaatgggtgtgcgatggaagcgccgaatgccaagatggcagcgacgagtcgcaggaaacgtgcttgtccgttacgtgcaagtccggcgatttcagctgcggtggccgtgtgaatcgatgcatacctcagttctggcgctgtgatggccaggtcgattgcgacaatggctccgatgaacaaggctgtcctccgaagacatgctcgcaggatgagttccgctgccatgacggtaagtgcatcagccgccaattcgtgtgtgactccgatcgtgactgcctggatggctcggacgaggcctcatgtccagttctgacctgcggcccagcgtccttccagtgtaactcgagtacatgcattccgcagctgtgggcttgtgacaacgatcccgactgcgaggacggaagtgacgagtggccgcaacggtgccgcggattgtatgttttccagggcgatagtagtccatgttcggcattcgagttccactgcttgtcgggtgagtgcatccacagctcatggaggtgtgatggaggtccggattgcaaggacaaatccgatgaagagaactgcgcagtggcaacttgccgtccagacgagttccaatgctcagacggcaattgtatccatggatcacgtcagtgcgatcgggagtatgactgtaaggatatgagtgacgaggtgggttgtgtgaatgtcaccctgtgcgagggtccaaacaagttcaaatgtcactctggtgagtgcatcaccctggacaaagtttgcaacatggcgcgcgattgcagggattggagcgacgagccgatcaaagagtgcggaaccaatgcctgtctcgacaataatggcggctgttcgcatgtgtgcaacgacctcaagatcggatatgagtgcttgtgcccggacggctttcaattggttgcccagcgacgctgtgaagacatcgacgaatgccaggatcctgatacgtgcagccagttgtgtgtaaaccttgaggggggttacaagtgccaatgtgaggaggggttccaacttgaccctcacacaaaagcctgcaaagcagtcggttcgattgcctatttgtttttcacgaaccgtcacgaggtgcgaaaaatgacccttgacaggagtgaatacacaagtctgatacccaacctgaggaatgtggtggctctggatactgaggtggcctcgaatcgcatctattggtcggatttgagccagaggatgatatgctcaacgcagctggatcgagcccacggcgtgagctcgtatgataccgtgataagcagggatattcaggctcccgatgggctggctgtcgattggatccacagtaacatttactggaccgattccgttcttggcactgtgagcgtggcggataccaagggtgttaagcgtaagacgctatttcgcgaaaacgggtcgaagccccgtgccatcgttgtggacccagtgcatggatttatgtattggacggattggggtacccccgcgaagatcaaaaaagggggtctcaacggcgtcgatatctactcgctagtcacagaaaatatccagtggccgaacgggatcacactcgatcttctgtcgggccggctttactgggtggattcgaagctgcacagcatttcctccatcgatgtaaatggcggcaataggaaaaccatcttggaggatgaaaaaagactggcgcatccattttcattggcggtgtttgaggataaagtcttctggacggacatcataaacgaggcaatcttctcggcgaatcggctcactgggtccgatgtaaacctgctcgcggagaacttgctttcaccggaagatatggtgctcttccataatttgacccaaccccggggagtgaactggtgcgagcgcactaccctgtccaacggcggatgccagtacttgtgcctgcctgccccccagattaatccacacagccccaagttcacgtgcgcctgccccgacggcatgttgctggcccgcgatatgcggtcgtgcttaacggaggccgaggcagctgtcgcgacgcaggagaccagcacggtacgcctaaaggtgagtagcactgccgtcaggacccagcacaccaccactcgacccgtcccggatacatctcgcctgccgggtgctacccccggactaacgaccgtcgagatagttaccatgtcgcatcaagctctgggcgacgttgctggccgggggaacgagaaaaagccatccagcgtgcgtgccctgtcgatcgtactgccaatcgtgctgctggtcttcctatgtctaggcgtgttccttctgtggaagaactggcgcctgaagaacatcaatagtattaacttcgataatccggtttatcagaagacaacggaggatgaagtgcatatctgccataatcaggatggctactcgtacccctcgcgtcagatggtttcacttgaggacgatgtggcc

SEQ ID NO: 534 - DNA, 2580 bp, Artificial Sequence
  Description of Artificial Sequence: Synthetic Transcript Sequence
atgggaccatggggctggaaattgagatggaccgtggccctgctgctggccgcagctggaactgcagtgggcgataggtgtgaaaggaatgaattccagtgtcaggacggaaaatgcatttcatacaaatgggtgtgtgacggctcagccgaatgtcaagacggatccgacgagtcgcaagaaacctgtctttccgtcacttgtaagtcgggtgatttctcctgcggaggaagagtgaaccgctgcatcccgcaattctggcggtgtgatggtcaagtcgattgtgacaacggttccgatgaacaggggtgcccgcctaaaacctgtagccaggatgagtttcgctgccacgatggcaaatgcatttcgcgccaatttgtctgcgactccgatcgggattgccttgacgggtcggacgaagcgtcatgtccggtcctgacctgcgggccagcatccttccagtgcaactcgtcgacctgtatcccccaactctgggcgtgtgacaatgaccctgactgtgaagatggatcggacgaatggccgcagagatgtcgcgggctctacgtgttccagggagactcaagcccctgtagcgcctttgaattccactgcctctcaggagagtgcatccactcctcatggcggtgcgatggaggaccggactgtaaagataaaagcgatgaggagaattgcgctgtggcgacctgtcggcccgacgaatttcaatgtagcgatgggaattgcatccacggatcgagacagtgcgaccgcgaatacgattgcaaggatatgtcagatgaagtgggatgcgtgaacgtgaccctgtgcgaggggccaaataagttcaagtgccatagcggcgagtgcatcactctggataaggtctgcaacatggcacgggactgtcgcgactggagcgacgaaccgatcaaggagtgtgggactaatgcatgtctcgataacaacgggggctgtagccatgtgtgcaatgacctgaaaatcgggtacgaatgtctctgccctgatggattccaactggtcgcgcagaggaggtgtgaggacattgatgaatgccaggacccggacacctgctcccagctgtgcgtgaacctggagggcggatacaagtgtcagtgcgaagagggatttcaattggacccgcacaccaaagcctgtaaggccgttggttcaatcgcctaccttttctttaccaacagacatgaggtccggaagatgaccctcgaccggtcggaatacacctcactgatcccgaatctccgcaatgtggtggcgctggatactgaggtggccagcaataggatttactggtccgacctctcccagcggatgatctgcagcactcaacttgatcgggcccatggagtctcatcatacgataccgtcatctcgcgggatatccaggcccctgatggactggcggtcgactggatccatagcaacatctattggaccgactcagtgctgggaaccgtgtccgtcgcggacacgaagggtgtgaaaagaaagaccctcttcagagagaacggttcgaagccgcgggcgatcgtggtggaccctgtccacggattcatgtactggactgattggggcactccagccaaaatcaagaaggggggactgaacggagtggacatctacagccttgtgaccgaaaacatccaatggcccaacggaatcaccctcgacttgctctcgggtcggctgtactgggtggactctaagctccactcaatttcctccatcgatgtcaatggggggaaccgcaagaccatcctcgaggacgagaagcggttggcccatcctttctcactggctgtctttgaagataaggtgttttggactgatatcatcaatgaggcgatcttctcggccaaccggcttactggatcggatgtgaacctcctggcagaaaacctcttgtcccccgaagatatggtgctgttccataacctgacccagccgcgcggagtcaattggtgtgagcgcaccactctttccaacggagggtgccaatacctgtgcctgccagccccgcagattaatccacactctccaaagttcacttgcgcatgcccggatggaatgttgctcgcccgggacatgcgctcatgcctcactgaagcagaggccgcagtcgcgacccaggagacttccacggtgcggctgaaggtaagctcgactgcagtacgcacccagcacaccaccacgcggccagtcccggacacgtcaagactcccgggcgctactccgggactgaccaccgtcgaaatcgtgaccatgagccaccaggctttgggagacgtcgcggggcgtggcaacgagaagaaaccttcgtccgtcagggcactgtcgatcgtgctgccgattgtgttgctcgtgttcctgtgcctcggcgtgttcctgctgtggaagaactggcgcctgaagaacattaactcaattaactttgataatccggtgtaccaaaagaccacggaggatgaagtgcatatctgccacaaccaagacgggtactcgtatccgtcgaggcagatggtgtctctggaggacgacgtagcc

SEQ ID NO: 535 - DNA, 2580 bp, Artificial Sequence
  Description of Artificial Sequence: Synthetic Transcript Sequence
atgggaccatggggatggaagttgaggtggactgtcgcgcttttgttggctgctgctgggacggctgtgggggacaggtgcgaaagaaacgaattccaatgccaagatgggaagtgcatatcttacaagtgggtttgtgatggaagcgccgagtgtcaagacgggagcgatgaaagccaagaaacctgcctttcggttacctgtaaatccggagattttagttgcggcggaagagtaaacagatgtataccgcaattctggcgttgtgacggacaagttgactgtgataacggctcagacgagcaaggctgtcctccaaagacctgttcgcaagacgagtttcggtgccatgacggtaaatgcatttcgaggcaatttgtatgcgacagcgatagagattgtcttgacggtagtgacgaagcttcttgcccagtactgacatgtgggcccgcgtccttccaatgtaattcatcaacgtgcatcccccaactttgggcttgcgataacgatcctgactgtgaagacggttctgacgaatggccacaacggtgtcggggattatatgtgttccaaggtgattcatcaccgtgctctgcttttgagtttcattgcctttcgggcgaatgtatacatagtagttggagatgtgacggaggaccagactgcaaagataaatctgatgaggagaattgcgcggttgccacttgccggcctgatgagttccaatgttctgatggaaactgtattcacggttcacgtcaatgcgaccgtgagtatgactgtaaggatatgagcgatgaggtgggctgtgttaacgtcactctctgtgagggaccaaataaattcaaatgtcactcaggagaatgcattaccctggataaggtgtgtaatatggcacgtgactgtagggattggtcagatgagcccatcaaagagtgtggtaccaatgcgtgcttggataataatggtggttgctcgcatgtttgcaacgatttaaagatcggttatgagtgtttatgtccggatggtttccagttggtcgcccaacgaagatgtgaggacatagatgaatgccaagatcccgatacgtgctcacaattatgcgttaacctggagggaggttacaagtgccaatgtgaagaggggtttcagctcgaccctcacactaaagcatgcaaagctgtgggtagcattgcctacctgttcttcacaaatagacacgaggttaggaaaatgactttagatcgttcagaatatactagcttgattccaaacctcaggaacgtggttgcgctggatacagaagtggcttctaatcgcatttattggagcgatttgagccaaagaatgatctgttcgacacaacttgatcgtgcccatggagtatcgtcttacgacactgttatttcacgtgacatacaagcccctgatggcctggcagttgactggattcatagtaacatatactggacggatagcgtcctgggcactgtttcggttgctgacaccaagggtgtaaagcgcaagaccctttttagggaaaacgggagtaagccgagggctatagttgttgatccagttcatggtttcatgtattggaccgattggggcactcccgcaaagatcaagaaaggtgggttgaatggtgttgatatatacagcttggttaccgagaacatacagtggcctaacggtatcacccttgatctgctttccggcaggttgtactgggtagattcgaagctgcatagtatctcgagtattgatgtaaatggaggtaaccgtaagaccattctggaagatgagaagcgtttggctcatcctttttccctcgctgtttttgaggataaagtgttttggacagatataataaatgaggctattttctccgccaatcgtttgacaggatcggatgtgaatctcctcgctgaaaatcttttatctccagaagatatggtgttgtttcacaatcttactcaacctaggggagttaactggtgcgaacgtactactctgagcaacggtggatgccagtatttgtgcttaccagccccacaaattaatcctcactctcccaagttcacgtgcgcctgtcctgacggtatgttactagctagggacatgcgctcttgcctgacagaagccgaggcggcagtggctactcaagagacatctaccgttaggttaaaggtaagtagtaccgcagtacgcactcaacatactacaaccagaccagtgcccgatacttcccggttgcctggagctacaccaggtcttaccactgtcgaaatcgttacaatgtctcaccaggcccttggggacgttgcaggaaggggaaacgaaaagaagccgtctagtgttcgtgcgctctctattgtgttgcctattgtgttgctcgtttttctctgcttgggagtttttcttctctggaagaactggaggctaaagaacattaattctattaattttgacaacccagtctatcaaaagaccacggaagatgaggtgcatatttgtcataatcaagatggatactcttatccctcccgacagatggtttcccttgaggacgacgtcgca

SEQ ID NO: 536 - DNA, 2580 bp, Artificial Sequence
  Description of Artificial Sequence: Synthetic Transcript Sequence
atgggaccttggggttggaaattgaggtggactgtggcccttctgctggcagcagcaggaacggccgtgggagataggtgcgaacgcaatgaatttcaatgtcaagatggtaaatgtattagctacaagtgggtctgtgacggttcagccgagtgtcaagacggatccgatgagtcgcaagaaacctgtctcagcgtgacctgtaaatcaggggacttttcgtgcggaggacgtgtgaatagatgcatccctcagttttggagatgtgacgggcaggtggattgcgacaatggaagcgacgaacaaggctgcccaccaaaaacttgttcgcaagatgaattcagatgtcacgacggaaagtgtatatcccggcaatttgtctgtgattcagatcgggattgtctggacgggtccgatgaagcctcgtgtcctgtgctgacttgtggacctgcatctttccagtgtaattctagcacctgcattcctcaactttgggcgtgtgataatgaccccgattgtgaggatggttcggacgaatggccacagcgatgccgcggactctacgtgtttcagggtgactccagcccttgttccgcgtttgagttccactgcctgtccggagagtgtatacatagctcctggaggtgtgatgggggccctgattgcaaggataagtccgatgaggaaaactgtgccgtggcaacctgtagacctgatgaattccaatgtagcgatgggaactgtatccacggaagccggcagtgcgatcgcgagtacgactgcaaagatatgagcgatgaggtgggatgtgttaacgtgaccctctgcgaaggaccaaacaagttcaagtgtcattcgggcgagtgtatcacgttggataaggtgtgcaacatggccagagattgtcgtgattggagcgatgaacctattaaggaatgcgggaccaacgcgtgtctggacaacaacggtggatgctcgcatgtgtgcaacgaccttaagattggttacgaatgtttgtgccctgatgggttccagcttgttgcacagagaagatgtgaggacattgatgaatgtcaggatccagacacctgttcgcaactgtgcgtgaatctggagggaggttacaagtgtcagtgtgaagagggctttcaattggacccccacaccaaagcatgcaaagccgtgggtagcattgcatatctgttctttaccaacagacacgaggtgagaaaaatgacgctggatcgatcagaatacacctccctgattcctaaccttcggaacgtggtagccctggatactgaagtggcgtcgaacagaatttactggtcggatctgagccaaaggatgatttgttcgacgcaactggacagagctcatggagtgagcagctacgacaccgtgatctcaagagatatacaggcccctgatggactggcggtcgactggattcattcaaacatttactggaccgactcagtgctgggcaccgtgagcgtggccgacaccaaaggagtcaagcgtaagaccctcttccgcgaaaacggatcgaagccccgcgcaatcgtggtcgatcctgtgcatggtttcatgtactggactgattggggaactccagccaagattaagaaaggcggactcaacggtgtagacatatactcgctcgtcaccgagaacattcagtggccaaacggaatcacccttgacctgctttccggaagattgtactgggtggatagcaaactgcattccatctcctcgattgacgtcaacggtggaaaccggaaaacgattctggaagatgaaaagcgtctggcacatccctttagcttggctgtctttgaagataaagttttctggaccgatatcattaacgaagcgatctttagcgccaaccgacttactggatcggatgtgaaccttctggccgaaaacctcctctcccctgaagatatggtcctgtttcataatctcacccaacctagaggtgttaattggtgtgaacgtactactctgagcaatggaggctgtcagtacctttgcctgccagcacctcagataaatccacattcgccaaagtttacctgtgcgtgcccggacggaatgcttctggcaagagatatgcggtcgtgcctgactgaagcagaagcagcggtcgcaactcaggaaacctcaaccgtgaggcttaaagtgtccagcaccgcagtgagaactcaacataccactactagacctgtgcctgacacttccagattgccaggcgcaactcccggcttgactaccgtggaaattgtcactatgtctcatcaagcccttggagacgtggcagggcgcgggaatgagaagaaaccatcctcggtgcgggcactgtcaatcgtgttgcctattgtgctgctggtgttcctttgtctgggtgtctttcttctgtggaagaattggcggcttaagaacataaactccattaacttcgataaccctgtgtaccagaaaacgaccgaggacgaagtgcacatctgtcacaaccaagatggttacagctacccatcgagacagatggtgtcacttgaggatgacgtggcc

SEQ ID NO: 537 - DNA, 2580 bp, Artificial Sequence
  Description of Artificial Sequence: Synthetic Transcript Sequence
atgggtccctggggatggaagctgagatggaccgtggccttgctcctagcagcagccgggaccgcggtgggcgataggtgcgagagaaatgaattccagtgccaggatggaaaatgcatcagctacaagtgggtctgcgacgggtcagctgaatgccaggacggcagtgacgagagccaagagacctgcctttccgtgacatgcaaatccggagactttagttgtgggggaagagttaacagatgcattcctcagttctggcgctgtgatgggcaggttgactgtgacaacggaagcgacgaacaagggtgccctcctaagacctgtagccaggacgagttccgctgccacgatggcaagtgcattagtagacagttcgtgtgtgactcagatcgggattgtttggacggcagtgatgaggcctcgtgtccagtgctcacctgcggtccagcttctttccagtgcaatagctccacctgtatcccccagctttgggcttgcgacaacgacccagactgtgaagatggatcagatgagtggcctcaaaggtgccgtggactctacgtgttccaaggggatagctcaccctgctcagctttcgagttccattgcctaagcggtgagtgtatacactcatcttggcgttgcgatggtggtcctgattgtaaggacaaatccgacgaagagaattgtgccgtggcgacttgtcgcccagatgagttccagtgcagcgatggtaattgcattcacggctcaaggcagtgcgaccgcgagtatgactgtaaagacatgagcgatgaggtgggatgcgtgaatgtgactctctgtgaaggccccaataagtttaaatgtcatagcggggaatgcatcacccttgataaggtgtgtaacatggctcgggattgtcgggattggtctgacgaacctatcaaggagtgtggaacaaatgcttgtctcgataataacggcgggtgttcacacgtgtgcaatgatctgaagataggttacgagtgcttgtgcccagacggattccagctggtggcgcagagacggtgtgaggacattgatgaatgccaggacccagatacatgttcccagctctgtgtgaatctcgaggggggttataaatgccagtgtgaagaggggtttcagctagatcctcacaccaaagcatgtaaggccgttgggtccatcgcttatcttttcttcactaatcgccacgaagtgagaaagatgacattagaccggtcagagtatacatccctgattcccaatctccgtaacgtggtggcactggataccgaggtagccagtaatagaatttattggtctgacctgtcccagagaatgatctgctcgacgcagctggacagggcccacggagtgtctagttatgacacggtgatcagccgcgatatccaggctccagatggtctcgccgtggactggatccattcaaatatatactggaccgattccgtgctgggaactgtgtctgtggccgacaccaaaggggtgaaacgcaagaccttatttcgagagaatgggagcaagcccagggctatagtagtggatccagtgcacggattcatgtattggacagactggggtacgcccgccaagatcaagaagggcggcttaaatggagtcgacatctatagcctcgttactgaaaatatacagtggcctaatgggattacactggatttgctctccgggcggctctattgggtggacagtaagttgcattctatttcatcaatcgacgtcaatggcggcaatcggaaaaccattttggaggatgagaagagactggctcatccattctctctcgcagtgtttgaggataaggtattttggaccgacataatcaatgaggccatcttcagcgcaaaccggcttactgggtccgacgtcaaccttttagccgagaacttgctgtcccccgaagacatggtgttgttccacaatcttacacaacctcgcggggtcaactggtgtgagcggacaacactgagcaatgggggctgtcagtacctgtgcctcccagcgccgcagatcaacccacacagtcccaagttcacatgtgcctgcccagatggcatgttacttgcccgcgatatgcggtcctgcctcactgaggccgaggctgctgtcgcgacacaagaaactagtactgtgaggctaaaagtgtcttctacagccgttaggacgcagcacactactacccgaccggtgccggataccagcaggctacccggtgcaactccagggctgaccacagtggagattgtgacaatgagccaccaagctctcggggatgttgcaggcagggggaacgagaagaaaccgtcttctgtacgggctttgtcaattgtcttgcccatcgtgcttctggtgttcttgtgtctgggcgtcttcctcttgtggaaaaactggaggctgaaaaacatcaactcaatcaacttcgataacccagtgtatcaaaaaactaccgaggacgaggtgcacatttgtcacaatcaggatggctacagttacccatccagacagatggtctctcttgaagacgacgtggct

SEQ ID NO: 538 - DNA, 2580 bp, Artificial Sequence
  Description of Artificial Sequence: Synthetic Transcript Sequence
atgggtccgtggggctggaagctgcgctggaccgtcgcacttctgctcgcagccgcgggaactgctgttggagatagatgtgaaagaaacgagttccagtgtcaagacggtaaatgtatctcgtacaagtgggtgtgtgatggatccgccgagtgccaagatggtagcgatgaatcccaagaaacctgtttgtcagtgacttgtaagagcggcgacttttcatgcgggggccgagtgaaccgctgtatccctcaattctggcggtgtgatggacaagtcgattgcgacaatggttcggatgagcaggggtgtcctcctaaaacctgctcccaggatgaatttcggtgccacgacggaaagtgtatctctcgacaattcgtgtgtgattcggaccgggattgcctggatggaagtgatgaggcatcctgtccagtgcttacgtgcgggcctgcatcatttcaatgcaattccagcacctgtattccccagctttgggcatgtgataacgaccctgactgtgaggacggatcagacgaatggccgcagcggtgcagaggtctttacgtgtttcaaggtgatagctcaccctgcagcgcctttgaatttcactgtctttcgggagagtgcattcattcctcctggagatgtgacggtggtccggattgtaaagataagtcggacgaggaaaattgtgcagtggcaacctgcagacctgatgaatttcaatgttctgatggaaactgtatccacggatccagacagtgcgatagagaatacgactgtaaggatatgagcgatgaagtgggatgtgtgaacgtcactctttgcgagggaccaaacaaattcaagtgccattcaggagaatgtatcaccctcgacaaggtgtgtaacatggcgcgagattgtcgcgattggtccgatgagcctatcaaagagtgtggtaccaacgcctgtctggacaataacggtgggtgttcccatgtgtgcaacgatctgaaaattggatatgagtgcctttgtcctgacggatttcagctcgtggcccaacgtaggtgcgaggatatagatgagtgccaggatcctgatacctgttcacaactgtgtgtcaaccttgaaggcggatacaagtgccagtgtgaagagggatttcagttggacccgcatactaaggcctgtaaggcggtgggttcaatcgcctaccttttctttaccaacagacatgaagtgaggaagatgactcttgatagatctgaatacacgtcccttattcctaacctgcgcaatgtggtggcactggacaccgaggtggcttcaaaccgcatatactggagcgatttgtcacaacggatgatttgctccacccagctggatcgggcgcatggcgtgagctcctacgacaccgtgatctcacgcgacattcaggcaccggacggactggcggtcgactggatccactccaacatttactggaccgattccgttcttggtaccgtgtcggtcgcagataccaaaggagttaagcgcaagactctgtttagagaaaacggatcgaagccgcgagctattgtggtcgatcctgtgcatggatttatgtactggactgactgggggacccctgcaaagatcaaaaagggtggtctgaacggtgtggacatctactctctggtcactgaaaacattcagtggcctaacgggattacccttgatttgttgtcggggcgcctctactgggttgacagcaagctgcactccatctcatcaatagatgtgaacggaggaaacagaaagaccatcctggaggacgaaaagcggttggcacatcctttttcgctcgcggtgtttgaggacaaagtgttttggaccgacattatcaatgaagcgatattcagtgcaaacaggcttactgggtccgacgtgaaccttctggcagaaaacctcctgtcgcctgaggatatggtgctgttccataacctcacccaaccccggggagtgaattggtgcgaacggactaccctgagcaacgggggatgtcagtacctctgcctgccagcaccccagattaatccgcattcacctaagtttacgtgtgcatgtcctgacgggatgctgctggcaagagatatgcggtcgtgtctgaccgaagcagaagccgcagtggccacccaagaaactagcaccgtgcgtcttaaagtgtcatccaccgccgtgcgaacccagcacactactacccggcctgtgcctgatacgtcgcgtctgcctggagccaccccaggtcttaccacggtggaaattgtcactatgtcgcatcaagccctgggagatgtggcaggtcggggaaacgaaaagaagccctcgtccgtgcgcgcccttagcatcgtgctccctattgtcctccttgtctttctgtgtttgggagtgtttcttctgtggaaaaactggcgactcaagaacattaacagcattaacttcgacaacccagtctaccagaaaactactgaagatgaggtgcatatctgtcataaccaagatggctactcgtatccaagccggcagatggtgtcactcgaagatgatgtggca

SEQ ID NO: 539 - DNA, 2580 bp, Artificial Sequence
  Description of Artificial Sequence: Synthetic Transcript Sequence
atgggtccgtggggttggaagctgaggtggactgtggccctgctcctcgcagccgcagggacagcagtaggtgatcggtgtgagcggaacgagtttcagtgccaggatggaaagtgtatcagttataagtgggtatgcgatggcagcgcagagtgtcaggacgggtccgacgaaagccaggaaacttgcctctcagtaacttgtaagtctggagacttcagttgcggcggacgggtgaataggtgcatccctcagttctggcgatgcgatggacaagtggattgtgacaacggatccgatgagcagggatgtcctccaaagacatgctctcaggacgagttccgatgtcacgatggaaaatgtatcagtcgacagttcgtctgcgatagcgacagggattgtctcgacggctccgatgaggcatcttgcccagtcctgacctgtggtcccgccagctttcagtgcaatagtagcacctgcataccacagctgtgggcttgtgataacgaccccgattgcgaggacggctccgatgagtggccccagcggtgccgcgggctctacgtgttccaaggggattctagcccctgcagcgcgtttgagttccattgcctgtccggggagtgcatccacagttcatggaggtgcgatggcggtcctgactgcaaggataagagcgatgaggaaaactgcgccgtcgcgacctgtaggcctgatgagttccagtgcagcgacggtaactgtatccacggatccaggcagtgcgacagggagtacgactgtaaagatatgtccgatgaggtagggtgcgtaaacgtcaccttgtgcgagggcccaaacaagttcaaatgccacagtggagaatgcatcaccttggataaagtgtgtaacatggcgcgcgactgtcgcgattggtcagatgagccaattaaagaatgcgggaccaacgcttgtctggataataacggcggctgtagccacgtctgcaatgatctgaagatcggctacgagtgtctctgtcccgacgggttccagctcgtggcccaaagaaggtgtgaagatatagacgagtgtcaggacccagatacctgtagtcaactctgcgtgaacctggagggcggatataaatgtcagtgcgaagaaggctttcagctggatcctcacaccaaagcctgcaaggccgttggtagtattgcctacctttttttcaccaatcggcacgaagtgcggaagatgaccttggacaggagcgaatacacatcactgatccctaaccttcggaatgtagtggcactcgacacggaagtagcgagtaaccgaatttattggtctgacctgagccagcgcatgatttgtagtacccagttggaccgagcccacggggtcagcagctatgacacagtgatatcccgcgacatacaggcccctgacgggcttgcggtagattggatacactccaacatctactggaccgatagcgtattgggcaccgtaagtgtggccgatacgaagggagtgaaacggaaaaccctcttccgggagaacggctccaagccaagagcgattgtggtggatcctgttcatggattcatgtactggaccgactgggggactcctgctaagattaaaaagggaggattgaacggtgtggacatctactctctggttacggagaatattcagtggcccaatggcattacgctggacttgctgtctgggaggctttattgggtggactctaagctgcatagcattagttctatcgacgtgaacggggggaataggaaaaccatactcgaggacgaaaagcgcctggcccatccattcagtctcgctgtgttcgaggacaaggtcttctggactgatattataaatgaagcaatcttttccgccaacagactgacaggtagcgatgtcaacctcctggccgagaatctcttgagccctgaagacatggtgctttttcacaacctgactcagcctcgcggggtgaattggtgcgagcggactacgctttccaatggcggatgtcagtacctctgcctcccagcgccccagatcaacccgcactcccctaagtttacttgcgcctgcccagacggcatgctgctggctcgcgatatgagaagctgtctgaccgaggcggaggcagccgtcgccacccaagaaacgagcaccgtaaggctgaaggtctcatccacagcagttcgcacgcaacataccacaaccagacctgttcctgacacctctcgcctgccaggcgcgacccccggccttaccacagttgaaatcgtcaccatgtcacaccaggctctgggagacgttgccggcagggggaatgaaaagaagccgtctagtgtgagagctctgagcatagtgctgccaatcgtgctcctcgtgttcctgtgcctcggagtctttttgctttggaagaactggcggcttaagaacattaatagcatcaattttgataacccagtctaccaaaaaacaaccgaagatgaggttcacatatgtcataaccaagacggttacagctacccttcacgccagatggtgtcactggaagacgacgtcgct

SEQ ID NO: 540 - DNA, 2580 bp, Artificial Sequence
  Description of Artificial Sequence: Synthetic Transcript Sequence
atgggaccctggggatggaaacttcgctggaccgtggccctcttgctggctgcggctggaaccgctgtgggtgatcgatgtgaacgtaacgagtttcagtgtcaggacgggaagtgcatctcttacaaatgggtctgcgacggctcggcagagtgccaagatggctccgatgaatcccaagagacttgtctgtcggtcacttgcaaatcaggtgatttctcctgcggagggcgggtgaatcgctgcatcccgcagttctggcggtgcgatggccaagtggactgcgacaacggcagtgatgagcagggctgcccgccaaaaacgtgcagccaagacgaattccggtgtcatgacggaaagtgcatttcgcgccagttcgtctgcgattccgacagagattgcttggacggctcagatgaagccagctgccccgttcttacctgcggtcctgcgagcttccaatgtaatagctcaacttgcatccctcaactgtgggcgtgcgacaatgacccggactgtgaagatgggtcagatgagtggccccagcgctgtcggggcctgtacgtgtttcagggagacagctcgccatgctccgcttttgagttccactgtctcagcggcgagtgtatccactcgtcatggcgctgtgacggaggccctgactgcaaggacaagagcgacgaagaaaattgcgccgtagcaacttgccggcctgatgagtttcaatgttcagacgggaactgcatccatgggtcgcgacaatgtgatcgggaatacgattgcaaggacatgtctgacgaagtgggatgtgtcaacgtgacgttgtgtgaaggacctaacaaattcaaatgccattcaggcgaatgtatcacgctggacaaagtgtgcaacatggcgagggactgccgggactggtccgacgagccgatcaaagaatgcggaactaatgcgtgcctggacaataatggcggttgttcacatgtctgcaacgacctgaagatcggatatgaatgcctgtgcccggacgggttccagctggttgcccagagacgctgtgaggacattgacgagtgtcaagacccagacacctgttcccagctttgcgtgaacctcgagggtggatacaagtgccagtgtgaagagggattccagctggacccccataccaaggcctgcaaggcggtgggatcaatcgcatatcttttcttcactaaccggcacgaggtgcggaagatgacgttggaccgctccgaatacacgagcctgatcccgaacctgcgtaacgtggtcgctctggataccgaagtggcctcgaaccgcatctactggagcgacctgtcccagagaatgatctgctcgactcaactggatagagcccatggggtgagcagctatgataccgtgatctcgcgggacattcaggccccggacggactggcggtcgattggatacacagcaacatctactggactgactccgtcctggggaccgtgagcgtggccgacactaagggagtgaaacgcaagaccctgtttagagagaatggcagcaagccgagagcgatcgtagtcgaccctgtccacggatttatgtactggacggactggggaactccggcaaagatcaaaaagggaggcctcaatggggtggacatttactcgttggttactgaaaacattcagtggccaaacggcatcaccctggatctgctcagcgggcgcctttactgggtggactccaagctgcactccatctctagcatcgatgtgaatggcgggaacagaaagactatcctcgaggacgagaagcggcttgcccatccgttctcactggccgtgttcgaagataaggtgttctggacggacataatcaatgaagctatcttttctgccaaccggctgaccggctccgacgtgaatctgctggccgaaaacctgctctcaccggaagatatggtgttgttccacaacctgacccaaccgagaggggtgaattggtgcgaacgcactaccctcagtaatgggggctgccagtacctgtgtctgccagcccctcagatcaacccccactcgccaaagttcacctgcgcctgcccggatggaatgcttcttgccagagatatgcggtcatgtctcaccgaggcagaagccgcggtcgcaactcaggaaacttcgaccgtcaggcttaaggtgagctcgaccgctgtcagaactcagcacactacgactcggccagtgccagacacctcgcgactgccaggagcaacccccgggctcactaccgtcgaaatcgtgaccatgtcccaccaggccctgggtgatgttgccggaagaggaaatgagaagaaaccttcgtccgttcgggcgctctccatcgtcctgccgattgtcctcctggttttcctctgtctcggagtgttcctcctgtggaagaactggcgcttgaagaacataaactcgatcaatttcgataacccggtgtatcagaaaactaccgaagatgaggtgcacatctgccataaccaggacgggtactcatacccttcaagacaaatggtgtcgcttgaagatgatgtggct

SEQ ID NO: 541 - DNA, 2580 bp, Artificial Sequence
  Description of Artificial Sequence: Synthetic Transcript Sequence
atggggccttggggctggaagctgagatggactgtcgctctgctgctggctgcggcggggactgccgtcggtgacagatgcgaaagaaacgaattccagtgccaggacggtaaatgtatctcgtacaagtgggtctgcgatgggtcagcggagtgccaggatggcagcgacgagagccaggagacttgtctgtcggtcacttgtaagagtggcgacttctcctgtggaggccgagtcaaccggtgcatcccccaattttggagatgcgacggtcaggtggactgtgacaacggatccgacgaacagggttgtcccccaaagacctgttcccaggacgaattccggtgtcacgacgggaagtgtatttcacggcaattcgtctgcgatagcgatagagattgcctggacggatcggacgaggcttcctgccctgtgctgacctgcggaccagcgtcctttcagtgcaattcctccacttgcatcccccagctgtgggcctgtgacaacgatccagactgcgaagatgggtcggacgagtggccacaaaggtgccggggcctctacgtgtttcagggagattcgtcgccgtgttcggccttcgaattccattgcttgtccggtgaatgcatccattcctcatggaggtgcgacggaggaccggattgtaaagataagtccgacgaggagaattgcgcggtggcgacttgccggcccgatgaattccagtgttcggacgggaattgtattcacggctcccgccagtgcgatcgcgagtacgattgcaaggatatgtcggatgaggtgggatgtgtgaacgtgaccctctgcgaaggcccaaacaagttcaaatgtcactcgggggagtgcattacccttgacaaggtgtgcaacatggcccgcgattgcagggactggtcggatgaaccgatcaaggagtgcggaacgaatgcctgcctggacaataatggaggctgctctcacgtgtgtaacgatctcaagatcggttacgaatgcctttgtccagacggtttccagttggtcgcccaacgacgatgcgaggacatcgatgaatgtcaagacccggacacctgcagccagctgtgcgttaacctcgaaggaggctacaagtgtcagtgcgaggagggctttcagctcgatccgcacaccaaagcctgtaaggcagtgggatcaattgcataccttttcttcactaatcggcatgaagtgcggaagatgaccctcgaccggagcgaatacacctccctgatcccgaacttgcggaacgtggtggccctcgacactgaggtcgcctcaaatcgaatctactggtctgatctgtcccaacgcatgatctgctccacccagctggatagggcgcacggtgtgtcctcttacgacacggtgatctcgcgcgatatccaggcgccagacggactggcagtggattggatccactcgaacatctactggaccgattcagtgctcggcacggtgtccgtggcggatactaaaggagtgaagcgtaagaccctgttccgggaaaatggatcgaagccacgcgccatcgtcgtggacccggtccacggcttcatgtactggaccgactggggaaccccggcgaaaatcaagaagggcggactcaacggagtggacatttactcacttgtgactgagaacatccagtggccgaacggtatcactctcgacttgctttccggacgcctgtactgggtggatagcaaactccattcaatctcgagcatcgatgtcaacggaggaaacagaaagactattctggaggacgaaaagcggctggcccacccgttctcattggccgtctttgaggacaaagtgttctggaccgacatcataaacgaagcgatcttctccgccaatcggctcactgggtccgatgtgaacctccttgcagagaacctgttgtcaccggaagatatggtactcttccacaatctgacccaaccgcggggagtcaattggtgcgagaggaccactctgtccaacggaggctgccagtacctctgcctgccggctccgcagatcaacccacacagcccgaaattcacttgcgcttgccctgacggaatgctcctggcgagagatatgaggagctgccttactgaagcagaggcagccgtcgcgacccaggaaacctcaactgtccgccttaaagtctcctcgaccgcagtgagaactcaacacactaccaccagaccggtcccagacacttcacgcctgccgggagcgactcctggactcactaccgtggagatcgtgaccatgtcgcatcaggcactcggcgacgtcgcaggcagaggcaacgaaaagaaaccctcttcagtgcgggccttgagcatcgtgctgccaatcgtcctgctcgtgtttttgtgcctgggagtgttcctcctgtggaagaactggcgcctcaagaatatcaacagcattaactttgataacccggtgtaccaaaagactaccgaagatgaggtgcacatctgccacaaccaggacggatactcatacccttcccgccagatggtttccctggaagatgatgtcgcc

SEQ ID NO: 542 - DNA, 2580 bp, Artificial Sequence
  Description of Artificial Sequence: Synthetic Transcript Sequence
atgggcccttggggctggaaactgcggtggacagtggcattgctgctagccgcagctggaactgccgtgggagatagatgcgaacgaaatgaattccagtgccaggatgggaagtgtatctcctataagtgggtgtgtgatggtagcgcggaatgtcaggacggatccgacgagtctcaggagacttgcctgagtgtgacttgcaagagcggagacttctcatgtggaggcagggtgaacagatgcattccccagttttggcggtgtgatgggcaggtagactgcgacaacgggtccgacgagcaaggctgcccacccaagacttgtagtcaggatgagtttcggtgccacgatggcaaatgtataagccggcagttcgtgtgtgactccgacagggattgcctggacggctctgatgaggctagctgccctgtcctaacttgtgggcccgcaagcttccagtgtaattccagcacgtgtatcccccagctgtgggcttgtgataacgaccccgattgcgaggatggaagtgacgaatggccccagcggtgcaggggcctctatgtgtttcaaggagacagttccccctgcagtgctttcgagtttcactgtctctctggggagtgcattcactccagctggcgctgtgatggtggacccgattgcaaagacaaaagtgacgaagagaactgcgcggtcgcgacctgccgcccagacgaattccagtgttcagatggaaattgcattcacggctcgaggcagtgcgacagagaatacgattgcaaggacatgagcgacgaagtcggctgcgtgaacgtcactctgtgcgaaggacccaataagttcaaatgtcatagcggggagtgtatcacccttgacaaggtttgcaacatggctcgggattgccgcgattggagcgacgaacccattaaagagtgtggtactaatgcctgtcttgacaataatggaggttgcagtcacgtgtgcaatgatttgaaaatcggttacgagtgtttatgtcccgacggatttcagctggtggctcagaggagatgcgaggacatcgatgaatgccaggaccctgacacttgcagtcagttgtgcgtgaatctggagggaggttacaagtgccagtgcgaggaaggtttccagctggatccacacacgaaagcttgcaaggcggtagggagtattgcgtacctctttttcactaaccggcacgaggtgagaaaaatgacactcgatcggagtgaatacacgtctctgataccaaatttgaggaacgttgtggccttagacactgaggttgctagcaaccgcatttattggtccgatctttcacagcgcatgatctgcagtacccaacttgaccgggcccatggcgtctcctcttacgacacagtaatctcaagggatatacaggcccccgacggcctcgctgtggactggattcactccaatatctactggacggactccgttctcggcactgtgtctgtcgcggatacgaagggggtaaaacgcaagacgctattcagagagaacggatcgaagccgcgggccatagtggtcgaccctgtgcacgggttcatgtactggactgactggggaacccctgccaaaatcaagaagggtggtcttaatggtgtggacatttatagcttggttacggagaatatccagtggccaaacggcatcactcttgatctgttgtctgggcgcctatattgggtcgattccaagctccattcgatctcctccatagacgtgaatggaggaaatcggaaaactatcctcgaagatgaaaagcgcctggctcaccctttttccttggccgtgtttgaggataaggtattctggaccgatatcattaatgaggctatttttagcgcaaacaggcttactgggtcagatgtgaatttgctggcagagaatcttttgtctccagaggacatggtactcttccacaatctgacccagcctcggggagtgaattggtgcgagcgcacgaccttgtccaacggcggctgccaatacctctgcttacccgctcctcagatcaatccacacagcccaaaattcacctgtgcttgtccggatggtatgctcctcgcacgggacatgcgtagctgtctaactgaagcagaggctgccgtcgccacccaagagacctccacagttaggctgaaagttagcagtaccgccgtcagaacacagcataccacaacacgaccagtgcccgatacttcaagacttccaggggccacccccggactaacaacagttgagatagttacaatgtcacaccaagccctgggtgacgtggccggccgcggtaatgagaaaaagcctagttccgttcgggcactgtccatagtcctcccaattgtgctactggtgttcctgtgtcttggcgtgtttcttctgtggaagaattggaggcttaaaaacattaatagcattaactttgacaacccagtctatcagaaaactacggaagatgaggtgcacatttgccacaaccaggacggatactcttaccctagccgccagatggtctctcttgaagacgacgtggcc

SEQ ID NO: 543 - DNA, 2580 bp, Artificial Sequence
  Description of Artificial Sequence: Synthetic Transcript Sequence
atgggcccatggggttggaagttacgatggaccgtggcgctgctgctcgcagccgccggcactgcagtaggagataggtgcgaaaggaacgaattccaatgtcaggacggcaagtgcatttcatataaatgggtgtgtgacgggagtgctgagtgccaggacggctccgatgagagccaggagacatgtctgtcagtgacctgcaaatcgggagattttagctgcggtggcagagttaaccgatgtatcccacagttctggcgatgtgacggccaggtggattgtgacaacggttcagatgagcagggatgccctccgaaaacctgttcccaggatgagttcaggtgccacgatgggaagtgcataagtcgccaattcgtgtgtgactccgaccgcgattgcttagacggcagcgatgaggcatcctgccctgtgctgacttgtggacccgccagttttcaatgcaattcttcgacttgtattccacagctgtgggcctgcgacaatgatccagattgtgaggatgggtcggatgagtggccacagcgatgtcgaggactatacgtctttcaaggcgacagctcaccctgttccgctttcgaatttcattgcctctcgggtgaatgtattcatagctcctggcgctgcgacggcgggcccgactgtaaggacaagtcagacgaggaaaattgtgcagtcgcaacttgcaggcccgacgagttccagtgctccgacggcaactgcattcacgggtcacggcagtgtgatcgagagtacgactgcaaggacatgtccgatgaagtcggctgcgtgaatgtgactttgtgcgagggccccaacaaatttaagtgtcacagtggcgaatgcattaccctggacaaagtctgcaacatggcaagggactgtcgagactggtcagatgaaccaataaaagaatgcggaaccaatgcatgcttggataacaatggggggtgcagccacgtgtgtaatgacctcaaaatcggatatgaatgcctctgtccagatggtttccagctggtggcacagaggaggtgcgaagatattgacgagtgccaggacccagacacttgctcccaactgtgcgttaacctggaaggcggatacaaatgtcagtgtgaagagggcttccagctagatccgcacaccaaggcttgcaaggcagtgggctcaatcgcttacctctttttcacaaaccgtcatgaggtccggaagatgacactggacaggagcgaatatacctcattgattcctaatctgagaaacgtcgtggctctcgacacagaagtcgcaagcaatcggatctactggtccgatctttctcagcgaatgatatgtagtacgcagctggatagagcacacggtgtgtcctcctatgatacggtgatatcccgagacatccaagcgcccgatggccttgccgtggattggattcactctaacatctactggacagactccgtcctggggacggtttctgtcgcagacactaagggtgttaaaagaaagaccctcttcagagagaacgggagtaaacccagagcgattgttgtcgatcccgtccatggcttcatgtattggaccgactggggcacgccagccaagattaaaaaaggcggattgaatggtgtagatatttattccctggttaccgagaacattcagtggcccaacggcataactctggacctacttagtgggagactttattgggtcgactctaagctgcacagcattagtagcatagacgtcaacggaggtaacagaaaaacaatcttagaagatgaaaagaggctggcccacccattcagcctcgcggtgttcgaagacaaggtcttttggaccgacatcattaatgaagcgattttttctgccaatagactcacgggctcagacgtgaacctcctggctgagaatcttctatcccctgaggacatggtgctcttccacaacctaactcagccgaggggtgtgaattggtgcgaacgtacaacgctcagcaatggcggatgccagtatctttgtttgcccgcgccacagatcaatccacattcacccaagtttacctgtgcttgtcctgatggaatgctcctagcaagggacatgcggtcttgcctgacagaagccgaagccgctgtggctactcaggaaacctctactgtgagattgaaggtctcatccaccgctgttaggacacaacacacaacaacgcggccggtgccagacacaagcagactccccggagctacgcccgggcttacgactgtagagatcgtgaccatgtctcaccaagctctgggagatgtggcgggcagagggaacgaaaagaagcccagcagtgtaagagcgttgagtattgtcctgcccatcgtgctgttagtttttctctgcctgggagtcttcctgctgtggaaaaattggaggcttaaaaatattaatagtataaacttcgataaccccgtgtaccagaaaactacggaagacgaagtccacatctgtcacaaccaggacggatacagctacccctcaagacagatggtatccctcgaagatgatgtcgcc

SEQ ID NO: 544 - DNA, 2580 bp, Artificial Sequence
  Description of Artificial Sequence: Synthetic Transcript Sequence
atgggaccatgggggtggaagctgaggtggaccgtcgccctcctgcttgccgcggcggggactgcggtgggtgaccggtgtgagcgcaacgaatttcaatgccaggacggaaagtgtatctcgtacaagtgggtctgcgacggatccgcggaatgccaagacggaagcgacgaatcccaagaaacgtgtttgagcgtgacctgtaagtcgggagacttttcatgcgggggtagagtgaaccgctgtatcccacagttttggaggtgcgacggacaggtcgattgtgacaacggttcggacgaacaaggttgcccacctaagacctgttcgcaggacgaattcagatgccacgacgggaagtgtatctcacggcaattcgtttgcgactcagatagagactgcctcgacggatccgatgaggcctcgtgtcccgtgctcacttgcggaccggcttcattccaatgtaactcgtccacctgcatcccgcaactgtgggcgtgcgataacgacccagactgtgaagatggttctgatgagtggcctcagcgctgcagaggcctttacgtctttcagggcgactccagcccctgctcggcctttgagttccactgtctgtcgggtgagtgcatccattcgtcatggcggtgcgatgggggtccggactgtaaggacaagtcggatgaggagaattgcgccgtggcgacctgccgcccagatgagttccaatgctcggacgggaactgcattcatgggtcgcgccagtgcgaccgcgaatacgattgtaaggatatgtccgacgaagtgggctgtgtcaacgtgaccttgtgtgaaggcccaaacaaattcaagtgccatagcggagagtgcatcactctcgacaaagtgtgcaatatggctcgggactgccgggactggagcgacgaaccgattaaagagtgcggaactaatgcgtgccttgataacaacggaggctgcagccacgtttgcaacgacctgaaaattgggtacgagtgtctgtgtccggatggattccagctggtcgctcaacggcggtgcgaggacattgacgagtgtcaggatcccgacacctgctcgcagctgtgcgtgaacttggaaggaggatacaaatgtcaatgtgaagaaggtttccagctggacccccatactaaggcatgcaaagcagtcgggagtatcgcgtacttgtttttcaccaacagacatgaggtccggaaaatgaccctggaccggtcggagtacacctccctcatccctaacctgaggaacgttgtggcccttgatactgaggtcgcatccaatcgtatctactggagcgaccttagccaacggatgatttgctctacccagctggacagagcgcacggcgtgtcatcgtacgataccgtgatctccagagatatccaggccccggacggattggccgtggactggattcatagcaatatctactggaccgactcggtcctggggaccgtgtctgtggcggatactaagggagtgaagcgcaagactctcttcagagaaaacggatcgaaaccgcgcgctatcgtcgtggaccctgtgcacggcttcatgtactggactgattgggggactccggcgaagatcaagaaaggggggctcaacggagtcgatatctactccctggtgaccgagaacattcaatggccgaacggtatcactctggatctgcttagcggccgcctctactgggtcgactcgaagctccatagcatctcctccatcgatgtgaacgggggaaatagaaagactatcctggaggacgaaaagcggctcgcccatccgttctcgctggccgttttcgaagataaagtgttctggactgacatcatcaacgaagccatcttcagcgcaaaccgccttactggttcggacgtgaacctgctggcggaaaacctgctctcgcctgaagatatggtcctctttcataatctgacgcaaccaaggggagtgaactggtgcgagagaaccactctgtctaacggcggatgccagtacctgtgcctgccagctccgcaaatcaacccgcattccccgaagttcacttgcgcttgcccggacggaatgctgctggcccgggacatgcgctcgtgcctgactgaggccgaggcggctgtggccacgcaggaaacctccaccgtgcgcctgaaggtgtcgtcgaccgcagtgagaacccagcacaccaccacgcgccccgttcccgacaccagccggctgccgggtgcaaccccgggtctgactactgtggagatcgtcactatgtcccatcaggctctgggagacgtggccggaaggggaaacgagaagaaaccttcgtccgtgagggcactgtcaattgtgctccctatcgtgctcctggtgttcctctgcctgggagtgtttttgctttggaagaattggcgccttaagaatatcaattccatcaattttgataaccccgtgtatcaaaaaactactgaggacgaggtgcacatctgccacaaccaagatggctactcctacccatcccgccagatggtgtcgcttgaagatgatgttgcc

SEQ ID NO: 545 - DNA, 2580 bp, Artificial Sequence
  Description of Artificial Sequence: Synthetic Transcript Sequence
atgggtccatggggctggaagctccggtggaccgtggccctgctcctggcagccgccgggaccgccgtcggagatagatgcgaaaggaacgagttccagtgtcaagatggcaagtgtattagttacaagtgggtgtgcgacggatccgcagagtgtcaagacggctcagacgaaagccaggagacttgccttagcgtgacctgcaagtctggagactttagctgcggaggaagagtcaaccgctgcatcccacagttctggcggtgcgatggccaagttgactgtgataacggaagtgacgagcagggatgccccccaaagacttgctctcaggacgaattcaggtgtcatgacggaaagtgcatctcaagacagttcgtctgcgatagtgaccgcgattgtctggatggcagtgacgaggcaagctgcccagtgcttacatgcggcccagcttctttccagtgcaattccagcacctgcattcctcagctctgggcttgtgacaacgatcccgactgcgaagatggaagtgatgagtggccccagcggtgtaggggcctgtacgttttccagggcgactcgagcccatgtagcgcctttgagtttcactgtctgtccggtgagtgcattcactcttcctggcgatgcgacggcggccccgattgcaaagataagtctgatgaggagaattgcgctgtggctacatgtcgccctgatgagtttcagtgctctgacgggaattgtatccacggaagtagacagtgtgaccgggaatacgactgtaaggacatgagcgacgaagtcgggtgtgtgaatgtgacgctgtgcgaaggtcctaataagttcaagtgtcacagcggagagtgcatcacactcgataaggtctgcaacatggcacgtgattgcagagattggtccgacgagccgatcaaagagtgcggtactaacgaatgcctggataataacggaggatgtagtcacgtgtgcaatgatctgaagattggcgccgagtgcctgtgtccggacgggttccagctcgtggcgcagaggaggtgtgaggacattgacgaatgccaggaccctgatacctgttcacaactatgcgtgaacttggaaggcggttataaatgtcaatgtgaggaggggtttcagctggatcctcacaccaaggcctgcaaagccgtcggatctatcgcatatctctttttcaccaaccgccatgaagtaaggaagatgacactcgataggagtgaatatacaagtctgatcccgaatctgagaaacgtagtcgccctggacaccgaagtggcatccaatcggatatactggtctgatctgtctcagcgcatgatctgcagcactcagttggacagggctcacggcgtatctagctacgacacagtaatctcacgcgatattcaagcgcccgatggcttggcagttgactggatccacagtaacatctactggaccgattccgtgttgggaacagtgtcagtggccgacaccaaaggagtgaaaaggaagacattattccgcgagaatggcagcaagccaagagcgattgtggtggacccggtgcatggattcatgtactggaccgactggggaactcctgcaaaaattaagaagggtggcctgaatggcgtggatatctacagtctggtgacggagaacatccagtggcccaatggtattacgctggatctgctaagtggaaggctgtactgggttgatagcaagctgcactctatctccagcatcgacgtcaacggaggaaatcggaaaacaattttggaggatgagaagcgcttggcccatcccttcagcctggcagtgttcgaagataaggtgttctggacggatatcattaacgaagcgatcttcagcgccaacagactcactggcagcgatgtgaatttgctcgccgagaatctcttgtccccagaagatatggtcctgttccataacctgacacagccacgcggggtaaactggtgtgagagaaccacactctccaacggcggttgccagtatctgtgcttgcctgcccctcaaattaacccacacagtccaaagtttacctgtgcctgcccagatgggatgctgcttgcccgggatatgagaagctgcctgaccgaggcagaagccgcagtagcgacccaggagacaagtaccgtgagactgaaagtgtcatcaacagccgtccgcacacagcataccaccactagacctgtccccgatacaagtaggctgcctggagccacccccgggctgaccacagtcgagatcgtgactatgtctcaccaggcactgggagacgttgctggacgcggtaatgagaagaagccctcttctgtgagggctcttagcatagtcttgccgatcgttctgttggtgtttctctgtctgggtgtgttcctcttatggaaaaactggaggctgaagaatataaacagcattaatttcgacaacccagtctatcagaagacaactgaggacgaagtgcacatttgccataaccaagacgggtacagttacccaagcaggcaaatggtatctctcgaagacgacgttgcc

SEQ ID NO: 546 - DNA, 2580 bp, Artificial Sequence
  Description of Artificial Sequence: Synthetic Transcript Sequence
atgggcccatgggggtggaagctcaggtggaccgtggcactgctgctggctgcagccggcacggctgtgggcgatagatgtgaacggaatgaatttcagtgccaggatgggaagtgtatcagctacaagtgggtgtgcgacggatcagcggaatgccaagacggcagcgacgaatcgcaggagacttgcttgtccgtcacctgcaagtccggtgacttttcgtgcggaggtcgagtcaatcggtgtatcccacaattctggcgctgcgatggtcaggttgattgcgacaacggatccgatgaacaaggatgcccgccaaaaacttgctcacaggatgaatttcggtgtcatgacgggaaatgcatctcacggcagttcgtgtgtgacagcgatcgggattgtctcgatggctctgacgaggcatcgtgtccggtcctcacctgcgggcccgcgtcattccagtgcaactcctccacctgtattcctcagctttgggcctgcgataacgatcccgattgtgaggacggttctgacgaatggccacaacggtgcaggggcctgtacgtgttccagggagactcctcaccgtgttccgcattcgaattccattgcctgtcaggcgagtgcatccactcctcctggagatgtgacggaggccctgactgcaaagacaaatccgacgaggagaattgcgctgttgcgacttgtaggccagatgaattccagtgctcggatggcaactgcatccacggttcgaggcagtgcgaccgcgagtacgattgcaaggacatgtcggatgaggtgggatgcgtgaatgtgaccctctgcgaaggcccgaataagttcaagtgccattccggagaatgcataacgctggacaaagtgtgcaacatggcgcgggattgccgggactggtccgacgaaccaatcaaggagtgcggaaccaatgagtgcctggataacaacggggggtgttcacacgtgtgcaacgacttgaaaatcggagcagaatgcttgtgtccagacgggttccaactggtcgcgcaacgccggtgtgaagatatcgatgaatgccaggatccggatacctgttcccagctgtgcgtgaacctcgaggggggctacaagtgtcaatgcgaggaaggattccaactcgacccacataccaaggcgtgtaaggcggtgggctccatcgcctacctgttctttactaatagacacgaggtgcggaagatgaccctggaccgatcagagtacacctcactgatccctaatctgcggaacgtggtcgcactggataccgaggtcgcttccaaccgcatatactggagcgacctctctcagcgcatgatctgctcgactcagctggaccgggcgcacggagtctccagctacgacactgtgatttccagagacattcaggcaccggacggtcttgccgtggattggatccacagcaatatctactggacggactcggttctgggcactgtgtcagtggcggacaccaaaggagtgaagcggaaaaccttgtttagagaaaatggatctaagcctcgggcgatcgtggtggatccagtccatggattcatgtactggactgactggggaactccagcgaagatcaaaaagggcggcctgaatggagtggacatttactcgctggttactgagaacattcagtggccgaacggtatcactttggatctgctgtcggggagactgtattgggtggactccaagctccatagcatctcgtcgattgacgtgaatggaggcaatagaaagactatcctggaggatgaaaagcgcctggcccacccgttctccctggcagtctttgaagataaggttttctggaccgacatcatcaacgaagcgatcttctcggccaatcggctgactggaagcgacgtgaacctccttgcagaaaacttgctgagccctgaggatatggtgctgttccacaatctgacccagccgcgtggtgtcaactggtgcgaaagaaccaccctgtcgaatggaggctgccaatacctctgcttgcctgccccccaaatcaatcctcacagtcccaagttcacttgcgcctgtcctgacggcatgctgctcgctcgagacatgcgctcgtgcctgaccgaagcagaagccgccgtggccacccaggaaacctcgactgtccggctcaaagtctcgtccaccgcagtgagaacccagcacactactacgcggccggttcctgacactagccggctcccgggggcgactcctgggctcaccactgtggaaatcgtgacgatgtcgcatcaagccctgggagacgtggctggtcgcggtaatgagaaaaagccgtcctcggtgcgcgcgctgtcaatcgtgttgccgatcgtcttgttggtgttcctttgtctgggggtctttcttctgtggaaaaactggcggctgaagaatatcaattcgatcaactttgacaatccagtctaccaaaagactaccgaggacgaggtgcatatctgccataatcaggacggctactcctacccgtcccgacagatggtgtcgctcgaagatgatgtggca

SEQ ID NO: 547 - DNA, 2580 bp, Artificial Sequence
  Description of Artificial Sequence: Synthetic Transcript Sequence
atggggccctggggctggaagctgagatggaccgtggcgctgctgttggctgcagcaggcactgccgtgggtgatcgctgcgaacggaacgagtttcagtgccaagacgggaaatgtatctcctataaatgggtgtgtgacggttccgccgagtgccaggatggttcggacgagtcgcaggagacatgcctgagcgtcacctgcaaaagtggtgatttctcctgtggaggtcgggttaaccgttgtatcccacagttctggcgatgcgacgggcaggtcgactgcgacaatggttcagacgaacaaggatgcccacccaagacttgttctcaagatgaatttcggtgtcatgacggcaagtgtatttcccgacaattcgtgtgcgattctgacagggactgtttagacggctccgatgaggcttcctgccctgtactgacgtgcgggcccgcgagctttcaatgtaactccagcacttgtattccccagctctgggcatgcgacaatgaccccgattgtgaggacggcagcgacgaatggccccagagatgcagaggactgtatgtcttccagggagattcgagtccgtgttctgcctttgagtttcattgcctttctggcgaatgtatccattcatcgtggaggtgtgacggcgggcccgactgtaaagataaatccgacgaggaaaattgcgccgtggccacatgtcgcccggatgagtttcaatgtagcgacggtaattgtatacacgggagccggcagtgcgatcgggagtacgactgcaaagacatgagcgacgaggtgggatgcgtgaatgtgactctctgtgagggcccaaataagtttaagtgccacagtggagaatgtattactctggataaggtgtgtaacatggctagagactgcagggattggagcgacgagccaatcaaggaatgtggcaccaatgaatgtctggacaacaacggtggctgcagccatgtatgcaacgacctcaaaattggggccgagtgcctgtgccctgacgggtttcagctcgtggcccagagacgttgtgaggatatcgacgaatgtcaggacccagacacctgttctcaactttgcgtgaatctcgagggcggatataagtgccagtgcgaagagggatttcagctcgacccacacactaaggcctgtaaggctgtgggaagcatcgcatatttgtttttcactaataggcatgaggtacgcaagatgaccctcgataggtctgaatatacaagcttgatccccaacttaagaaacgtagtggccctggacaccgaggttgcaagtaaccggatatactggtctgacttaagccagcggatgatatgtagcactcagctggatagagcgcatggggtgagctcctatgataccgtcatcagccgtgacatacaggctccggacgggctggccgtggactggattcattctaacatttactggaccgattcggtcctgggtactgtgtccgtagccgacaccaagggcgtgaaaaggaaaacgcttttcagagaaaatggttccaagcctagggccatcgtagtcgaccctgtgcatgggttcatgtactggaccgactgggggacgccggctaaaattaaaaaaggcgggctgaatggtgtagacatctacagtctggtgaccgaaaacatccagtggccgaatggaattaccctggatctgctgagcgggaggctgtactgggtggactccaagttgcactccatctccagtatagacgtcaatggcgggaatcgaaagactatcctggaggacgagaagaggctggcccatccttttagcctggcagtgtttgaagacaaagtcttttggactgatattatcaatgaagcaatattttctgccaaccgtctcacgggtagcgacgttaatctcctcgctgagaacttgctgagccccgaagatatggtgctgttccacaacctgactcagccccgcggggtcaactggtgcgaaaggacgacactgtcaaatgggggatgccagtatctgtgcctgccggcacctcaaataaatccccatagtcctaaattcacctgcgcctgcccggatggcatgctactggcaagagacatgcgctcatgtctgacagaagctgaagctgccgtcgccacccaggagacctctactgtgagactaaaggtgagttcaactgcggtccggacccagcacactactacacggcccgtgccagacacaagcagacttcccggagcgactccggggctaacaaccgtggagatcgtgaccatgagccaccaagccctgggcgacgtggcaggccgcgggaacgagaaaaagccaagttccgttagggctctgtctatcgtgcttcctattgttttgttggtcttcttatgcctgggcgttttcctcctctggaagaactggagactgaaaaacataaattcaatcaatttcgacaatcctgtatatcaaaaaactactgaggatgaagtgcatatctgccacaatcaggatggatattcgtaccctagtcggcaaatggtgtctctcgaagacgatgtcgcc

SEQ ID NO: 548 - DNA, 2580 bp, Artificial Sequence
  Description of Artificial Sequence: Synthetic Transcript Sequence
atggggccgtggggttggaaacttagatggactgttgcccttctcctggcggcagcaggcaccgccgtcggagatcggtgtgaacgcaacgagttccagtgccaggacgggaagtgcatctcgtacaagtgggtctgcgacggttccgcggaatgtcaagatgggagcgacgagtcccaagaaacctgtctttcagtcacgtgcaagtccggtgatttttcctgcggcgggagggtcaatcggtgtattcctcaattttggcgctgtgatggacaagtcgattgtgacaatggatcggatgaacagggctgtccacctaagacttgttcccaagatgagtttaggtgccatgatggaaagtgtattagcagacaattcgtctgtgattcggacagagattgtctggacgggtcagatgaagcctcgtgtcccgtcctcacttgtgggccagcgtcgtttcagtgcaatagctccacctgcattccgcaactctgggcatgtgataatgatcccgattgcgaagatggttccgacgagtggccgcaacggtgtcgcggactgtacgtgtttcaaggagatagcagcccatgctcagcctttgaattccattgtctgtcaggagagtgtatacattccagctggcgatgtgatggggggccagactgtaaggataagagcgatgaagaaaactgcgcagtggcaacttgtcggccggatgaatttcaatgttctgatggtaactgtatccacggctcgcggcaatgcgatcgcgaatatgattgtaaggacatgtccgatgaggtgggatgtgtcaatgtgacgctttgcgagggtcctaacaagtttaagtgtcattcgggcgaatgtattaccttggacaaggtctgcaatatggctcgcgattgtagagattggtcggacgaaccaattaaggaatgcggcaccaatgagtgtctcgataacaatggtggttgttcccatgtctgcaatgatttgaaaataggggcagagtgtctctgccccgacggattccagctcgtggcccaacgacggtgtgaagatatagacgagtgccaggaccccgatacttgctcccaactgtgcgtgaaccttgaagggggatacaagtgccagtgtgaggaaggctttcaactggatccccacaccaaagcatgcaaggccgtgggctccatcgcttacctgttcttcactaatagacacgaagtcagaaaaatgaccctggatcggtccgaatacacctcccttattcccaatctgcgaaatgtggtggcgctcgataccgaggtcgcatccaaccgtatatactggtccgatctttcacagagaatgatctgctccactcaacttgacagagcgcatggagtgtcctcatacgataccgtcatttcacgcgatattcaggcacctgacggactggctgtggattggatccactcgaacatatactggacggacagcgtgcttggaacggtgtcggtcgcagacaccaaaggagtgaagcggaaaacgctgttccgggaaaacggtagcaagccaagagccatcgtcgtggacccagtgcacgggttcatgtattggactgattggggcaccccagcaaagattaagaagggaggcctgaatggggtggatatctactccctcgtgactgaaaacatccaatggcctaatggaattaccctggaccttttgtccggccggctttactgggtggatagcaaactccactcgattagctcaattgatgttaatgggggtaaccgtaagacgattctggaagatgagaagcgactggcccatccgttttcactcgctgtgtttgaagataaggtgttttggactgacatcatcaacgaagcaatattcagcgccaaccgactgaccggaagcgatgtgaatctcctggccgagaacctgttgtcgccagaagatatggtgctgttccataacctgactcaacctaggggagtgaactggtgtgagcgcaccactcttagcaacggaggctgccagtatctgtgcctgcctgcaccacagatcaaccctcatagcccaaaattcacttgtgcctgcccggatggaatgcttttggcacgcgacatgaggtcttgcctgaccgaagcagaagcagcggtggcaactcaggagacttccaccgttcgactgaaagtgtcgtcaaccgcagtgaggacccagcatactactaccagacccgtgcctgatacctcgcgacttccgggagccaccccagggctcacgacggtcgagattgtgaccatgagccatcaagcgctcggtgatgtcgcaggcaggggaaacgagaagaagccaagctccgtgcgcgcactcagcattgtcctgcctatagtgctgcttgtgtttctgtgtttgggagtgtttctgctgtggaaaaactggagactgaaaaacatcaattcaatcaacttcgacaaccccgtgtaccaaaagactaccgaggatgaagttcacatttgccataaccaagatggatactcgtacccctccagacagatggtgtcccttgaagatgatgtcgca

SEQ ID NO: 549 - DNA, 2580 bp, Artificial Sequence
  Description of Artificial Sequence: Synthetic Transcript Sequence
atgggcccttggggatggaagctccggtggaccgttgcactgctgcttgctgcggccggaaccgcggtgggagaccggtgtgaacgcaatgagtttcagtgccaggatggcaagtgtatttcttacaaatgggtgtgcgacgggtctgctgaatgccaggatggctccgacgagagccaggagacctgcttgagcgtgacatgtaagagtggtgatttttcctgtggagggagggtaaaccggtgtattcctcagttttggcggtgcgacggtcaagtggattgcgacaacggtagcgacgagcagggttgcccgcctaagacctgttctcaggacgagtttaggtgccacgacggcaaatgcattagtcggcagtttgtatgcgactccgaccgcgattgcctggatggctctgacgaggcttcctgccccgttctcacctgcggaccggccagctttcagtgcaatagtagcacctgtatcccacagctgtgggcctgcgataacgaccctgattgtgaagacgggtccgacgagtggcctcagcgttgtcgcggtttgtatgtgtttcagggcgacagtagcccttgttcggcctttgagtttcactgtttaagtggagagtgtatccacagtagctggcggtgcgatggcggtcctgactgtaaggacaagtctgatgaggagaattgcgccgtcgccacctgtcggcccgacgaattccagtgttcagacggaaactgcatccatgggagccgacagtgcgatagagagtacgattgtaaagacatgtcggacgaagttggttgtgtaaacgtgacattatgcgaaggacccaacaagtttaagtgtcatagcggggagtgtatcaccctggacaaagtgtgcaacatggctcgcgattgtcgtgactggagcgacgagccaatcaaggagtgtggaacaaacgagtgtctagataacaacggcggttgctcacatgtgtgcaatgatctcaaaatcggagcggagtgtctgtgccccgatggcttccaattggtggcacaaaggcggtgcgaggatattgacgagtgtcaggaccccgacacctgcagtcaactgtgcgtgaatctggaaggcggctacaagtgccagtgcgaagaggggtttcaattagaccctcacactaaggcctgcaaggccgtgggttcaattgcttacctattttttacaaatagacatgaggtgagaaaaatgacgctcgatcgctcggagtatacctctctgattcccaatttgcggaacgtggtcgccttggacaccgaggtcgccagtaatagaatctattggtccgacctcagccagcgcatgatctgcagcacacagttggaccgagcgcacggcgtgtcttcttatgatacagtgatctctcgcgatatccaggccccggatggactcgccgtggactggatccacagcaacatctactggacagactccgtgctgggaacagtttccgtagccgatactaaaggagtcaagagaaagacactgttccgcgagaatggcagcaagccccgcgccatagtggtagacccggtgcatggattcatgtactggaccgactgggggacgccggctaaaatcaaaaaagggggactcaatggtgtggatatctatagccttgtcacagagaacatccagtggccaaatggaattaccttagacctgctttccggaaggctttattgggtggactccaagctgcactcaataagcagtattgacgtcaacggaggtaacaggaagactattctggaggatgagaagaggctcgcgcaccccttctctcttgccgttttcgaggacaaggtgttttggactgacatcattaatgaggcaatattctccgctaacagactgaccgggtccgatgtgaaccttctcgctgagaacctcttaagtcctgaagacatggttttatttcacaacctcacacagcctcgcggggtgaactggtgtgaaagaaccacgttaagcaatggaggttgccagtatttgtgtttgccagccccacaaatcaatccacattcacccaaatttacttgcgcatgtccagacggaatgctccttgcgagggacatgcgctcctgcttaacggaagctgaggccgccgtcgccacccaagagacatccaccgtcaggctgaaggtgagcagtacggcagtgaggacccagcataccaccacccgtcctgtgcccgatactagtcggctccccggggccaccccaggactgaccacggtggaaatagttactatgagccaccaggccctcggagatgtggctggacggggaaatgaaaagaagccctctagcgtccgcgcactctcaattgtgctgcccatcgtgctcttggtgtttctgtgcctcggcgttttcctgctttggaaaaattggaggctgaagaatatcaattccatcaatttcgacaatcccgtgtaccagaaaaccactgaagatgaagttcatatttgtcacaaccaagatggctactcctacccttccaggcaaatggtctctttggaggacgatgttgct

SEQ ID NO: 550 - DNA, 2580 bp, Artificial Sequence
  Description of Artificial Sequence: Synthetic Transcript Sequence
atgggcccttggggatggaagctgagatggaccgtcgcccttctgcttgccgccgctggaactgccgttggagaccgctgcgagcgcaacgaatttcagtgccaggacggcaaatgcattagctacaagtgggtttgcgacggtagtgctgagtgccaggacggctctgatgagtcccaggagacttgcctctctgtgacttgcaagtccggtgactttagttgcggcggtagagtaaacagatgtatcccacagttttggcgctgcgacggccaagtggactgcgataacggtagcgacgaacagggctgcccccctaagacatgctcccaggatgagttccgttgccacgacggaaaatgcatttccagacaattcgtctgtgatagcgaccgcgactgcttggacggttctgatgaagcatcttgtcctgtgttgacatgcggacctgcttccttccaatgtaactcttctacctgtattccacaactgtgggcatgtgataacgatcctgactgcgaggatggctcagacgaatggccccaaaggtgcaggggtctctatgtgtttcagggagattcttccccatgctctgctttcgaatttcattgtctctccggcgagtgcattcatagctcctggcgttgcgatggcggtcccgattgtaaggacaagtccgacgaggagaactgcgctgtggctacttgccgtccagatgagttccagtgcagcgatggaaactgcatccacggatcccgtcagtgtgacagagaatacgactgtaaagatatgtcagatgaagtcggatgcgtgaatgtgaccctgtgtgagggacctaacaagtttaaatgccacagtggagaatgcatcacactcgacaaggtttgcaacatggcccgtgattgcagagactggtccgacgaacctattaaggagtgcggaaccaatgagtgcctcgacaacaacggcggatgctcacatgtctgtaatgatttgaagatcggtgccgaatgcctgtgtcctgacggctttcaactggtggcacagcgtaggtgcgaggacatcgacgagtgtcaagatccagacacttgctcccagctttgtgtgaatctcgagggaggatataagtgtcagtgtgaggaaggatttcagctcgaccctcatacaaaggcctgcaaggccgtgggatccatcgcctatctcttcttcaccaaccgccacgaagtcaggaagatgacacttgacagatcagagtacacatctctcatccccaacctcagaaacgtggttgcactcgacaccgaggtggccagcaataggatttactggtccgatctgtctcaacgtatgatatgttctactcagctggacagggcacacggcgtgtcctcttacgatacagtgatcagcagggatatccaagctcccgacggccttgcagtcgactggatccacagtaacatctactggactgactctgtgctcggcactgtctctgtcgcagatactaagggagttaagagaaaaaccctctttagggagaatggttctaagccaagagccattgtggtggatcccgtgcacggtttcatgtactggactgactggggaaccccagctaaaattaagaaaggaggcctgaatggtgtggacatctattcactggtaactgagaatatccagtggcctaatggaattacactcgacctcttgagtggcagactgtactgggtcgacagtaaattgcactctatatccagtatcgacgtcaacggcggaaacagaaagaccattttggaggacgaaaagcgcctcgcacaccccttttccctcgccgttttcgaagacaaagtcttttggaccgatatcataaacgaggctattttcagcgctaacaggcttaccggttccgatgtcaatctgctggctgaaaatttgctgagtcctgaggatatggtgctcttccataacttgacccagccacgtggtgttaactggtgcgagcgtaccaccctgtcaaacggtggctgtcagtacctttgcctgcccgcaccacaaattaatcctcacagtcccaaattcacatgtgcatgtcctgacggcatgctgctggcaagggacatgagaagttgtctgaccgaggctgaggctgcagttgccacacaggaaaccagcactgtccgcctcaaagtaagttcaaccgccgtgcgtacccagcacactactaccagaccagtgcccgatacttctcgcctccccggtgctacacccggcctcaccactgtggagattgtcacaatgtcccatcaggccttgggagacgtagctggtaggggaaatgagaagaagcccagctctgtcagagcactcagcatcgttcttcccatcgtcttgctggtctttctgtgcctgggagtctttctgctttggaagaactggcgtcttaaaaacattaactctatcaactttgacaacccagtttaccagaagacaacagaagacgaggtgcatatctgccataaccaggacggctactcctacccatccaggcaaatggtgagcctggaagatgacgtcgct

SEQ ID NO: 551 - DNA, 2580 bp, Artificial Sequence
  Description of Artificial Sequence: Synthetic Transcript Sequence
atgggcccgtgggggtggaagctccggtggactgtggccctgctccttgccgccgcaggaaccgcggtgggggaccggtgtgagcgcaacgaatttcaatgtcaggacggaaagtgcatcagctacaagtgggtgtgcgatggctcggcggaatgccaagacggctctgatgaaagccaggagacttgccttagcgtgacctgcaagtcaggagatttctcgtgtggagggcgcgtgaacagatgtatcccgcagttctggagatgcgatggtcaggtggactgcgataacggatccgacgaacaaggatgccctcctaagacctgctcacaggatgaattccgctgtcatgacgggaagtgcatctcaagacagttcgtctgtgactccgatcgcgattgccttgacggttcggatgaagcgtcctgccccgtgctcacgtgcggaccggcgagctttcagtgcaattcgtccacctgcattccgcaactgtgggcatgtgataatgatccagattgcgaggacggctcggacgagtggcctcagcggtgccggggcctgtacgtgttccagggcgattcctctccgtgctccgccttcgaattccattgcctgtctggggaatgtatccattcgtcatggcgctgtgacggtggaccagactgtaaggataaatcggacgaggaaaactgtgcggtggcgacttgccggccggatgagttccagtgcagcgacggcaactgcatccacggctccaggcaatgtgaccgggagtacgactgcaaggatatgtcggacgaagtggggtgcgtgaatgtcaccctgtgcgaaggccctaacaagtttaaatgccactcaggagagtgcatcactctggacaaggtttgcaatatggctcgagattgcagagattggtcagacgaaccgatcaaagagtgcggaaccaacgaatgcctcgataataacggcggttgttcacatgtgtgtaacgacctgaagataggcgcagagtgcttgtgccctgatggatttcaactcgtcgctcagcgcaggtgcgaggacatcgatgagtgccaggaccctgacacttgtagtcagttgtgcgtgaacttggagggaggatacaagtgccagtgcgaagaaggatttcagctggacccacacaccaaagcatgcaaagcggtgggatccatcgcttacctgttcttcacgaaccgccatgaggtgcgcaagatgacccttgatcgctccgagtatacgtcactcattccgaacctgcggaatgtggtggcactggataccgaagtcgccagcaataggatctattggagcgacctgagccagcgtatgatttgctccactcaattggacagggcccacggagtatccagctacgacactgtgatcagccgcgacatccaggcccctgacgggctggcagtggactggatccacagcaatatctactggacggattcggtgctcgggactgtctcggtggcggacaccaagggagttaaacggaaaaccctcttccgggaaaatggctcaaagccacgggccattgtcgtggacccggtccacggattcatgtactggaccgattggggaaccccagccaagatcaagaaaggaggactgaatggcgtggacatctacagcctggttaccgaaaacatccaatggccgaacggaatcactctcgacctcctctcgggacgactgtactgggtcgactcaaagttgcattctatctcaagcattgacgtgaacggaggaaacagaaagactatccttgaggatgaaaagaggctcgcccatccgttcagcctggccgtgttcgaggacaaagtcttttggaccgacatcatcaacgaagccatcttctccgctaatcgcctcacgggttcggacgtcaacctgctggccgagaacctgctgtcgccagaggacatggtgctgttccacaacctgactcaaccgcggggagtcaactggtgtgagaggactaccctgtcgaatggtggatgtcagtacctgtgcctgccagctccgcaaatcaacccccattccccaaaatttacttgcgcatgccccgatggaatgctgctggcgcgcgacatgcgctcctgcctcactgaagcagaggccgccgtcgcgacccaagaaacctccactgtcagactgaaggtgtcatcgactgctgtccggacccaacacaccaccacccggccggttccggataccagtagattgcccggcgcaaccccggggctgactactgtggaaattgtgactatgtcgcaccaggccttgggcgacgtggcgggtcgcggtaacgaaaagaagccatcgtcggtcagagccctttccatcgtgctcccgatcgtcctgctcgtgttcctttgtctgggagtgttcctgctctggaaaaactggagactgaagaatatcaacagcattaatttcgataaccccgtgtaccaaaagacgactgaagatgaagtgcacatctgccacaatcaggacggctactcctacccatcgcgccagatggtgtccctcgaggacgacgtcgct

SEQ ID NO: 552 - DNA, 2580 bp, Artificial Sequence
  Description of Artificial Sequence: Synthetic Transcript Sequence
atgggcccttgggggtggaaactccgctggacagtcgcactgctcttggcagccgctggtactgctgtgggcgatagatgcgagcggaacgaatttcaatgtcaggatggcaagtgtatttcttacaagtgggtgtgtgacggaagcgctgaatgtcaggatggctccgacgaatcgcaggagacgtgcttgtcggtgacttgcaaaagtggggatttttcctgtggaggtcgtgtcaatcgctgcattccacagttctggcgatgcgacgggcaggttgattgcgataacgggtcggacgaacagggatgcccgcctaaaacatgctctcaggacgagttccggtgccacgacggtaagtgtatcagccgccagtttgtctgcgattcggatagagactgcctcgacgggtcagacgaggcctcctgtcctgtgctgacctgtggaccagccagtttccaatgtaattcctcaacttgcattccccaactgtgggcttgcgataacgatcctgactgcgaggacggctctgatgagtggccccagcgctgccgtggcctctacgtctttcagggggattccagtccatgcagtgcctttgaattccactgtttgagcggggagtgcatccatagttcctggagatgtgacggcgggccagactgtaaggacaagtctgatgaggagaattgtgctgttgccacgtgccgccctgacgaattccagtgttctgacggtaattgcatccacggcagtagacaatgcgatcgggaatatgattgcaaggatatgagtgatgaggtcgggtgtgtgaacgtcacgctgtgcgagggtccaaataaatttaaatgtcattccggcgagtgtattactctggacaaagtgtgcaatatggccagggactgcagggattggtccgacgagccaataaaagaatgcggcactaatgaatgcctggataataacggcggctgttctcatgtgtgtaatgacctgaagatcggcgccgagtgcctgtgtccagacggattccagcttgtggctcaaagacggtgtgaagatatcgatgagtgtcaggacccagatacatgctcacaactttgtgtgaatttggagggcggttataaatgtcaatgcgaagaaggcttccagctcgatccccacaccaaagcctgcaaggccgtgggctccatcgcctacttgttcttcaccaatagacacgaggtgagaaaaatgactctcgatagatctgagtataccagcctcattccgaatctgcggaacgtcgtcgcgttggacacagaggtagccagtaatagaatatattggtcagacttgagtcagaggatgatttgcagtacccagcttgatagagcgcatggagtgagctcctatgacaccgtaatctcacgggacatccaggcgcccgacggtttagccgtggattggatacactctaatatctattggactgatagcgtgttggggacagtgagtgtcgccgatacaaagggggttaagcgaaaaaccctatttcgcgagaacgggagtaagcctagggccatagtagtagatcctgttcacggttttatgtactggaccgactggggaacccctgccaagatcaagaagggagggcttaacggtgtcgacatttactcacttgtcacagaaaacatccaatggccaaatggcatcacgctggacctgctaagcggcaggctgtactgggtggattccaaactccactccatttccagcatagacgtgaatggagggaacagaaaaaccatcctggaagatgagaaacgccttgcacacccgttctcattagcagtctttgaagacaaggttttttggactgacattattaatgaagccatcttttccgccaaccgacttaccggaagcgatgttaacctgcttgcggagaatcttctgagccccgaagacatggtactcttccacaacctgactcagccccgaggggtcaattggtgtgaaaggaccacccttagtaatggaggctgtcagtatctctgcctgccagccccccaaatcaatccacattccccaaagttcacctgcgcatgtcccgatgggatgctcttggctcgggatatgcggagttgcctgaccgaggccgaagcagctgtggctacccaggagacgtcgaccgttaggctgaaggtgtctagtacagccgtgaggacacaacacacaacaacaagaccagtgccagatacatctagattacctggggctacaccaggcttaaccacggtcgaaatcgtgaccatgtcacaccaggctctcggcgacgttgcaggacgcggcaacgaaaaaaagccaagttccgtcagggccctgagcatagtgctgcccattgtgctgcttgtgtttctgtgcctgggcgttttcctgctgtggaaaaactggaggctcaagaatatcaactctattaactttgacaacccagtataccagaagactacagaggatgaagtgcacatctgtcataatcaggacggttactcttatcctagccgccagatggtgagcctggaagatgatgtggct

SEQ ID NO: 553 - DNA, 2580 bp, Artificial Sequence
  Description of Artificial Sequence: Synthetic Transcript Sequence
atgggcccttggggatggaagctccgctggaccgtggccctcctgctcgccgcggctggcaccgccgtgggtgacagatgtgaacggaatgagttccaatgtcaagacggtaagtgcatttcatacaagtgggtgtgcgacgggtcagccgaatgtcaagatggcagcgacgaatcacaggagacgtgtctgtcggtgacctgcaaatcaggcgatttttcctgcggaggacgcgttaaccgctgcattccgcagttctggagatgtgatggccaagtcgactgcgacaacggatcggacgagcaggggtgcccgccgaaaacgtgctcgcaagacgaattccgctgccacgacggaaaatgcatcagcagacagtttgtctgtgattcggaccgggattgcttggatggttccgacgaggcaagttgccctgtgctcacctgtgggccggcatccttccagtgcaactccagcacctgcatcccgcagctgtgggcgtgtgacaacgacccggattgtgaggatggatcggatgagtggccgcaacgttgtcggggattgtacgtgttccaaggcgacagctccccttgctcagctttcgagtttcactgcctctcgggcgagtgcatccattcgtcgtggcgctgcgatggcggcccggactgtaaagataagtccgatgaggagaattgcgcggtggcaacttgtcggccggatgagttccagtgttccgacggaaactgcatccatgggtcccgccagtgcgaccgggaatacgactgcaaggatatgtcagacgaagtcggttgcgtcaatgtgaccctgtgcgagggacccaataagttcaagtgtcactctggagagtgtatcactcttgataaggtgtgcaacatggccagagattgccgcgattggagcgacgaacctattaaggagtgcggaaccaacgagtgcctcgacaataatggaggatgctctcatgtgtgcaacgatctcaagatcggtgccgaatgtctttgtccagacggatttcaactcgttgcgcagagacgctgtgaggacatcgatgaatgccaagatccggacacttgttctcaactgtgtgtgaacttggagggagggtacaaatgccagtgtgaggagggctttcaactggacccacacaccaaagcgtgcaaggcagtggggtccatcgcttatctgttcttcacgaataggcacgaggtgagaaagatgactctggatcgcagtgagtatacgtccctgatcccaaatctgcgcaacgtcgtggctctggacaccgaggtcgcttcaaaccgaatctactggtcggatctctcccagcgtatgatctgctctacccaactcgatagggcccatggagtctcaagctacgacaccgtgatttcccgcgacatccaggcgcccgacggactggccgtcgactggatccactccaacatctattggacggactccgtccttggaactgtcagcgtggcggacactaaaggagtcaagcggaaaaccctgtttcgggaaaacggatccaagcctagagccatcgtggtggaccctgtgcatgggtttatgtactggaccgattggggaaccccagcgaagatcaagaaaggcgggctcaacggagtggacatctactcactggttaccgagaacatccagtggcctaacgggattactctggatctcctgtcaggccgcctgtactgggtggactcgaagctccattcaatctcgtcaatcgatgtgaacggcggcaaccgcaagactatcctggaggacgaaaaacggctggcacaccctttctccctggccgtgtttgaggacaaagtgttctggactgatatcatcaatgaagcgatcttcagcgctaaccggctgaccggatccgatgtgaatctgctcgctgaaaaccttctgtccccagaagatatggtcctgttccacaacctgacccaacctaggggagttaattggtgtgagcgcaccaccctctcaaacggcggttgccagtacctctgtctcccggccccgcagatcaacccgcactccccgaaattcacctgcgcatgcccggacggaatgctgctggccagagacatgcgctcatgcctgaccgaggctgaagctgcagtggccactcaggaaacttcaacggtccggctgaaggtttcgagcactgctgtccggacccaacacactactactcgcccagtgccggacacgtcaagacttccgggagcaactccgggcctgactactgtcgagatcgtgaccatgtcacaccaagccctgggcgacgtggcaggtaggggcaatgaaaagaaaccgtcctccgtgcgggcgctgagcatcgtcctccctatcgtgcttctggtgttcctctgtctgggagtgttcctcttgtggaaaaactggcgcctgaagaacatcaattctatcaacttcgataacccggtgtaccagaaaaccaccgaggacgaagttcatatctgtcacaatcaggacggatacagctacccgtcgcggcagatggtgtcactggaagatgacgtcgca

SEQ ID NO: 554 - DNA, 2580 bp, Artificial Sequence
  Description of Artificial Sequence: Synthetic Transcript Sequence
atggggccgtggggttggaagctgcggtggaccgttgcactgctgctcgcggcggctgggactgcagtgggagatcgttgtgagcggaacgagttccagtgtcaggacggcaaatgtatttcttataagtgggtatgtgacggtagcgccgaatgtcaggatggctccgatgaaagtcaggaaacatgcctgtcagttacatgtaagagtggggatttctcttgtggggggcgtgttaatcggtgcatacctcaattttggcggtgcgacggacaggtcgattgcgacaacgggagcgacgagcagggatgtccccccaagacttgttctcaggatgagttcaggtgtcacgacggcaagtgcatttcccgccagttcgtttgcgattccgatcgagactgcttggacggctcagatgaagcgagctgtcctgtgctcacctgcgggccggcttcattccagtgtaactcgagcacctgtattccccagctctgggcgtgcgacaacgatcccgactgtgaagacgggagtgacgagtggccccagcgttgcaggggcctttacgtatttcaaggcgattcatctccttgttctgccttcgaatttcattgtcttagtggtgagtgcatccattcatcttggcggtgtgacgggggccccgactgtaaggacaagagtgatgaggagaattgtgcggtggccacctgtcggcccgacgagttccaatgtagcgatggaaattgtatccacgggagcaggcagtgtgacagagaatatgactgcaaggacatgagtgatgaggttggatgtgttaacgtcacgctttgcgaaggtcccaacaaatttaaatgccattccggcgaatgcattacactcgataaggtgtgtaatatggctcgggactgccgggactggtctgacgaacccattaaagagtgcggtactaatgagtgtttggacaacaacggaggttgctcgcacgtgtgtaatgacctcaaaatcggcgctgaatgtctttgtcccgacggcttccagctggttgcacagaggcgatgtgaggatattgatgagtgccaggatccggacacctgttcccaactttgcgtcaacctggagggaggctacaagtgccaatgcgaagaaggttttcagctcgatcctcataccaaggcttgcaaggcggtaggtagtattgcatacctgttctttactaatcgccacgaggtgagaaaaatgacacttgacagatcagagtacacctctctcattcctaatctgcgcaacgtggtggctctggatacagaagtcgccagcaacaggatctactggtctgacctgtcgcagagaatgatctgctcgactcagcttgaccgtgctcacggggttagctcctacgacacagtcatctcacgagatatccaggcccccgacggtttagctgtggattggattcacagcaacatctactggaccgacagcgtattaggaacggttagcgttgctgacactaagggtgtgaagagaaagacccttttccgcgagaacgggagtaagcccagggccatcgtggtcgatcctgttcatggattcatgtactggacagattggggaacccccgccaagatcaaaaagggcggactgaatggggtggatatctattccctggtgacggagaatatccaatggcctaatgggatcactctggacctcctctcaggccgcctctactgggtagacagtaagctacactcaatctcatctatcgatgtgaacgggggtaatcgaaagaccatactcgaagatgaaaagagactagcccacccattttctctggctgtgtttgaagacaaggtgttctggacagatatcattaacgaagctatctttagcgcgaatcggttgactggatcagacgtcaatctcctggcggagaatttgctgtcgccggaggatatggtactcttccacaaccttacacagcctagaggtgtcaattggtgcgaacggaccaccctttccaatggcggctgccagtacctttgcctgcctgccccccagatcaatccacattccccaaaatttacctgcgcctgtcctgatgggatgctgctcgcaagagacatgaggagctgtttaaccgaagcagaggctgccgtggcgacacaggagacgagcacggtaagactcaaggtttcgagtactgccgtgaggacgcaacatacgacaacacggcccgtccctgatactagccggcttcctggggcaacaccaggactgaccaccgtcgagattgtgacgatgtcacatcaggccctaggggacgtcgccggcagggggaacgagaagaagcccagttccgtgcgggcactttcaatagtgctccctatcgtgctactagtgtttctctgtttgggtgtgtttctgctgtggaaaaactggcgactgaagaacataaactcaatcaattttgataaccccgtctaccagaaaacaaccgaagacgaggttcacatttgccacaatcaggacgggtattcgtacccgagcagacagatggtctccctagaagacgacgtggca

SEQ ID NO: 555 - DNA, 2580 bp, Artificial Sequence
  Description of Artificial Sequence: Synthetic Transcript Sequence
atgggtccgtggggctggaagctccggtggaccgtggctcttcttcttgccgcagccggaactgcggtgggagacaggtgtgaaaggaacgaattccaatgtcaagatggtaaatgtatttcctacaaatgggtctgcgatggcagcgctgaatgtcaagacggatcagatgagtcacaggaaacctgcttgtcagtcacctgtaaatcaggtgatttttcttgcgggggtagggttaatcgctgtatccctcagttttggagatgcgatgggcaagtggattgtgataatggcagcgatgaacaaggttgtcccccgaaaacttgctcgcaagacgagttccgctgtcatgacggaaaatgtatctcgcgtcagttcgtctgtgattccgatagagactgcctggacggatcggatgaggcgtcatgtcctgttctcacttgtgggcctgcttcatttcagtgtaactcgtcgacttgtattccacaactttgggcatgtgacaatgatccggattgcgaagatgggagcgatgagtggccacaaagatgtagaggactttatgtgtttcagggggactcatctccttgcagcgcattcgaatttcactgtctttcaggagagtgcatccactcgagctggcgctgcgacggtggcccagactgtaaagataaaagcgatgaggaaaactgtgcagtggctacttgtcgccctgacgagttccaatgctccgatggaaattgcatccatggatcgagacagtgcgaccgggaatacgactgcaaggatatgagcgatgaagtcggatgtgtcaacgtgactctgtgtgagggccctaacaagtttaagtgccattccggagagtgtattactctcgataaggtttgtaatatggcccgggactgtagggactggtccgacgagcccattaaggaatgtggtactaacgaatgcctcgacaataatggaggttgttcgcatgtgtgtaacgaccttaagattggggcggagtgcctttgtccagacggttttcagctggtggcacaacggaggtgcgaagatattgatgaatgccaggatcctgatacctgctcgcagctttgcgtgaacctcgagggcgggtacaagtgtcaatgtgaagagggatttcagctggatccacataccaaggcatgcaaggccgtggggtcgattgcttacctgtttttcacgaacaggcatgaagtgcgcaagatgacgcttgatcgctcagaatacacgtcgctcattcctaatttgaggaacgtagtcgcacttgatactgaagtggcttccaaccgaatctattggtccgatctctcccaacgaatgatctgctcaactcaacttgatcgggcacatggagtgtcatcgtacgataccgtgatctcacgcgatatccaagcacccgatgggctggcagtggattggattcacagcaatatctactggactgactccgtccttggtaccgtgtccgtcgccgacaccaagggtgtcaagagaaagactctgtttcgcgaaaatggaagcaagccccgagcgattgtggtggatcctgtgcacggatttatgtactggacggattggggtacccctgccaaaatcaagaagggtggactgaatggcgtcgacatatacagcctggtaaccgaaaacatacaatggccgaacggaattaccctggatttgctctcgggcaggctctactgggtggattcgaagctgcatagcattagttcgattgacgtgaacggtgggaaccgtaagaccatactggaggatgagaagcgacttgctcatcctttctccttggcggtttttgaagataaggtgttctggacggacatcattaatgaagcaatcttctccgcaaacagactcacgggatcggacgtcaaccttttggccgaaaatctcctttccccagaagatatggtcttgttccataatctcactcagccgcggggtgtgaattggtgtgaacgaacgaccctgtcaaacggcggatgtcaatacctttgccttccagctccacagattaatccacacagccctaagttcacttgtgcgtgccctgatggaatgcttcttgcaagggatatgcggtcgtgtctgactgaagcagaagccgccgtggcaacccaggagacttccactgtccgcctcaaagtgtcatcaaccgcggtccgaacccagcacaccaccactagacctgtcccagatacctcacggctgccaggagcaacccctgggctgaccaccgtggagattgtgacgatgtcgcaccaggcactgggagatgtggccgggaggggaaacgagaaaaagccttcctccgtacgcgccctgtctatagtgctgcctatcgtccttctcgtgtttctttgtcttggagtgtttctgttgtggaagaattggcgactgaaaaacatcaactcaattaactttgacaacccggtgtaccagaaaacgaccgaggacgaggtccatatctgtcataaccaggacggatactcctaccccagccgtcaaatggtgtcgctcgaggacgatgtggca

SEQ ID NO: 556 - DNA, 2580 bp, Artificial Sequence
  Description of Artificial Sequence: Synthetic Transcript Sequence
atggggccgtgggggtggaaactgcgctggaccgtggctctgctcctcgctgctgcaggcactgcagttggggacaggtgtgagagaaacgaatttcagtgtcaggatgggaagtgcattagttataaatgggtctgcgacggatcggccgaatgtcaggacgggagtgacgagtctcaggagacttgcctgtctgtgacctgcaaatccggcgatttctcatgtgggggacgcgtaaataggtgcatcccacagttctggagatgtgatgggcaggtggactgtgacaacggttccgacgaacagggctgccctcccaaaacgtgctctcaggacgaattcaggtgccacgacgggaaatgtatttctcgccagttcgtgtgtgactcagatcgggattgcctggacgggagcgacgaggcatcttgcccagtcctcacctgcggtcctgcctccttccagtgcaatagttcaacctgcatcccgcagttatgggcctgtgataacgaccccgactgtgaggacggctcggacgagtggccccagaggtgccgggggctgtacgtgttccagggggatagctcgccatgctctgctttcgaattccactgtctctccggagagtgtatccacagctcctggaggtgtgatggtggtcccgactgcaaggataagagcgacgaggagaactgtgctgtggcaacatgccgtcctgacgagttccagtgttctgatggcaattgcatacacggcagtaggcagtgtgacagggagtacgactgcaaagatatgagcgatgaggtcggctgcgtcaatgtgacactgtgtgagggcccgaacaagttcaaatgccattctggggaatgcatcacactggacaaagtgtgcaatatggccagagactgcagggattggtccgatgagcccattaaagagtgcggaaccaatgagtgtctcgataataatgggggttgctcacacgtgtgcaatgacctgaaaattggcgctgagtgcctgtgcccggacgggttccagttagttgcccagcgcagatgcgaagacattgacgaatgtcaggatccagatacatgttcccaactgtgtgtgaacctggagggagggtataaatgccagtgcgaggagggcttccagttggatccacacacaaaggcatgtaaggctgttggaagtatcgcctaccttttttttaccaaccgccacgaagtgagaaagatgactcttgaccgatccgagtatacctcactgattcctaatctgcgaaacgtagtggctctcgacaccgaagtggcatcaaaccgtatctactggagtgatctgtctcagcggatgatttgttcaacacagttggaccgcgcccacggagtttccagctacgacaccgtgattagtcgcgacatccaggcacccgatggtctcgcagttgactggattcactcgaatatctattggacggacagtgtgttggggacagtgtcagtggcggacaccaagggcgtgaagcggaagactttgttccgagagaacgggagcaagccgcgggcaatcgtcgtagatcccgtccatgggtttatgtattggaccgattggggtacaccagccaagattaaaaagggcggcctgaacggcgtggacatctactcccttgttacagaaaatattcagtggcccaacggaatcaccctcgacctactgagcgggcgcctgtattgggtggactccaagctccactcgatctcttccatcgacgtgaacgggggaaacaggaagaccattctcgaagatgagaagagactcgcccatcccttttcccttgcagtttttgaagacaaggtgttttggaccgatatcattaacgaggccatctttagtgctaatagactgaccggctccgatgttaacctgctggcggagaatctgctgtctccagaggacatggtactgttccataatttgacacagcccagaggcgtcaattggtgtgaacgtacgacgctgtctaacggcggctgccagtacctgtgtctacccgctccgcagatcaatcctcatagcccaaaatttacctgtgcatgccctgacggcatgttgctagctagggacatgagatcctgtctgactgaggctgaggcagccgtggctacccaggagacttctacggttcgattaaaggttagctctaccgccgttagaacccagcataccactactcgtccagtgcctgacacatcccggttgcctggagcaactccggggctgactactgtcgagattgtgacaatgagccaccaggccttgggagacgtggccggtaggggaaatgagaaaaagccatcctctgtgagagctctcagcattgtgcttccaatcgtgctgctcgttttcctatgtctcggcgtgttcttactctggaaaaattggaggctgaagaacataaacagtattaacttcgataatcctgtctatcagaaaaccacagaggacgaggtacacatctgccacaatcaagatgggtattcctacccatccagacagatggtgtccttggaagacgatgtggct

SEQ ID NO: 557 - DNA, 2580 bp, Artificial Sequence
  Description of Artificial Sequence: Synthetic Transcript Sequence
atgggtccctggggatggaagcttcgctggactgtcgccttgctgttggctgccgcaggaaccgctgtgggcgataggtgcgagcgcaatgaattccaatgtcaagacggaaaatgtattagctataagtgggtctgtgatggaagtgcggagtgtcaggatggaagcgacgagtcccaggaaacctgcctttctgtaacctgcaaaagcggagatttcagctgcggaggtagagtgaacaggtgcataccacagttttggagatgcgatggccaagtagattgcgacaatggctccgacgagcaaggttgccctccaaaaacctgctcccaggatgaattccgctgtcacgacggtaagtgcatatcacgccaattcgtttgcgatagcgacagagactgtcttgatggatccgacgaagcgtcatgtcccgtgctgacttgtggcccggcgtcttttcagtgcaatagttcaacatgcatcccacaactttgggcatgtgacaacgatccagactgcgaggatggttcagacgaatggccccaacgctgcaggggtctgtacgtattccaaggtgatagttctccttgctcagccttcgaatttcactgtctctctggtgaatgtatacactcctcttggagatgtgacggcggtccagattgcaaggacaaaagcgatgaggagaactgcgcggttgcaacctgccgcccagacgagtttcagtgctccgacggcaactgcattcacggctcaagacagtgtgacagagaatatgattgtaaggacatgagtgatgaggtaggctgcgttaacgttaccctgtgcgaaggtcctaacaaattcaagtgtcactctggcgagtgcattaccctcgataaagtttgcaacatggccagggattgcagggactggagtgacgagcccattaaagagtgcggcactaacgagtgcctggacaacaatggcggatgttcccatgtgtgtaacgacctgaagattggagctgagtgtctctgtcccgatggttttcaactggtcgctcagcgccgctgcgaagacatcgatgagtgtcaggaccccgatacatgctcccagctgtgtgtaaacctcgaaggtggatacaagtgtcaatgcgaggaaggcttccaactcgacccgcacactaaagcctgcaaagctgtgggatcaatcgcttacttgtttttcaccaaccgccacgaggtcaggaagatgaccctggacaggtctgaatacaccagcctgatccccaacctgcgcaacgtcgttgctctggatacggaagttgcatccaataggatttattggagcgatctctcccagagaatgatctgttctactcagctggaccgcgcccacggagtcagtagctacgatactgtcattagtagggatattcaggcgccagatggccttgcagtagattggatccacagcaacatttactggacggactcagttctcggtacagtgtccgtcgccgatactaaaggagttaaacgcaaaactttgtttagagagaacggttctaagcccagggccattgttgtcgaccctgttcacggattcatgtactggacggattggggcactcccgccaagatcaagaagggaggattgaacggagtggatatctacagcctggtcacggagaatatccaatggcccaacggaatcacgctcgacctcctttccggcaggctgtattgggtagatagcaagctgcactccatttctagcatcgatgtcaacggcggtaaccgcaagacgattctcgaagatgagaagcgccttgcccaccctttctccttggccgttttcgaggacaaggtgttttggactgatattatcaacgaagcaatattctccgccaatagactgactggctccgatgtgaatctgctggccgagaacctgctgtctccagaggatatggttctctttcacaacttgacccaacctagaggtgtgaattggtgcgagagaacaaccctgtcaaacggcggttgtcagtatctgtgtctccccgctccacaaattaacccacactccccgaagttcacatgtgcttgtccggatggaatgctgctggcaagagacatgcgcagttgcttgacagaggcggaggcagccgttgccactcaggaaactagcaccgtcagactcaaagtctcatccactgcagtaagaacgcagcacacgaccacccgcccggtcccagacaccagccgcttgcctggcgcgacccctggcctgaccactgtcgaaatcgtgactatgtcccaccaagctctgggagacgtggccggtagaggcaacgaaaagaagccctcttcagtgagagcgctgtctatcgtcctgcccatcgtcctcttggtcttcctttgccttggcgtattcctgctctggaagaactggaggctcaagaacatcaattcaatcaactttgacaaccccgtgtaccagaagactactgaagacgaggttcacatttgtcacaaccaggatggatactcctacccatcaaggcagatggtgagcttggaagacgatgtcgct

SEQ ID NO: 558 - DNA, 2580 bp, Artificial Sequence
  Description of Artificial Sequence: Synthetic Transcript Sequence
atgggtccttggggctggaaactgaggtggacagtcgctcttctgctggccgcagccggtaccgctgtgggcgacagatgcgagaggaatgaatttcagtgtcaggacggaaaatgcatctcctacaaatgggtgtgcgacggctccgccgaatgtcaggatgggtctgacgagtcacaagaaacttgtctgagcgtgacatgcaagtccggagatttctcctgcggtgggcgggtcaaccggtgcatccctcagttttggagatgtgacgggcaagtcgactgtgacaatggaagcgacgaacaggggtgccctcccaagacctgctcccaggatgagttcagatgccacgatggaaagtgcatctcacgccagtttgtttgtgatagcgatcgggattgtcttgacggctcggacgaggcctcttgccccgttcttacatgcggacctgcctctttccaatgtaactcgtctacttgcattcctcagctctgggcctgcgacaatgatccggattgcgaagacggcagcgacgaatggccccagcggtgccgcggtctatacgtctttcagggcgattcatccccatgctccgccttcgaattccactgcctgagcggagagtgcattcattcttcatggcgatgcgacggcggccccgactgcaaagacaagtcagacgaggagaattgcgctgtcgctacttgtaggcctgacgaatttcagtgttccgatgggaactgtatccatgggtctagacagtgcgatagagagtacgactgcaaggatatgagcgacgaggtggggtgtgtaaacgtcactctgtgcgaagggccaaacaagtttaaatgccattcgggagagtgtattactttagacaaagtctgcaacatggcgcgagattgtagggactggtctgacgagcctataaaagagtgtgggactaatgaatgtctcgacaacaacggagggtgtagccacgtgtgtaacgatcttaagatcggggctgaatgtctctgtcccgacgggttccagctcgtggcgcagcgaaggtgcgaggacatcgacgagtgccaagatccagacacctgttcccagctgtgtgttaatctggaggggggatataaatgccagtgtgaagaagggtttcagctcgacccgcataccaaagcctgcaaggctgtcggctcgatcgcttatctgttctttactaacaggcatgaggtgcgcaagatgaccctggacaggtctgaatataccagcctgatcccgaacctgcgcaacgtagtcgctctggacaccgaagtggcaagcaatagaatttattggagtgatctgtctcagcgaatgatctgttcaacccagctcgaccgcgcccatggggtctcttcatatgacaccgtcatctctcgagacattcaggcacccgacggcctcgcagtggactggattcattccaacatatactggactgacagtgtccttggcactgtgagcgtggctgataccaagggtgtgaagcggaagactctctttagggaaaatgggtccaaacctcgggcaatcgtggtggacccagtgcatggctttatgtactggactgattgggggaccccggcaaagatcaagaaaggaggtctgaacggcgtggatatatattccctggtcacagagaatattcagtggcccaacggaattactctggatctcttatcaggccgattgtattgggtggactctaagctgcactcaatttcttcaatcgacgtgaacggcggaaacagaaagaccatcttagaagatgagaaacgtttggcccatccctttagcctggccgtgttcgaggacaaggtgttttggaccgatatcattaatgaggccattttctccgcgaatcgcctgactggaagcgatgtcaaccttctggctgaaaacctcttatcgcctgaggatatggtcctgttccacaatctgacccagccccggggagtgaactggtgtgaacggacaactctatccaacggtggctgtcagtatctctgtctccccgctccccagattaaccctcactccccaaagttcacgtgtgcttgcccagatggcatgctcctggccagggacatgcgctcttgcctcacagaggccgaggcagctgtcgcaacccaggagacgtctactgtccgccttaaagtgtcttctacagcggtacgcacccagcacactaccacacgccccgtgcccgatacatcaaggcttcctggcgccacccccggtctcaccaccgtcgaaatcgtgaccatgtcccaccaggccttgggagatgttgctgggcgtgggaatgaaaagaaaccctcttccgtgcgggcgttgagcatagtacttcccatcgtgttgctcgtgttcctatgcctcggcgtgttcctgctctggaagaactggagactgaaaaacattaactcaatcaatttcgacaatccagtgtaccaaaagaccacagaggatgaggtgcacatctgccataatcaggatggttacagctacccttcaaggcagatggttagcctagaggatgacgtggct

SEQ ID NO: 559 - DNA, 2580 bp, Artificial Sequence
  Description of Artificial Sequence: Synthetic Transcript Sequence
atgggtccttggggctggaagctgaggtggactgtggccctccttctagctgctgccgggaccgccgtgggggaccgatgcgagagaaatgagtttcagtgtcaggatggcaaatgcataagttataagtgggtgtgtgacggcagtgcagaatgccaggatgggtctgatgagagtcaggagacttgcctgtctgtcacctgtaaatctggcgacttttcctgcggcggacgggttaatcgctgcattccacagttctggaggtgtgacggccaggtggattgcgacaacggcagtgacgaacaaggctgtcctcctaagacctgttcacaggatgaatttcggtgccatgacggcaagtgtatctcccgacagttcgtctgcgactcagatcgagattgtctagatggttctgacgaggccagctgccctgtgctgacatgcggcccagcttcattccagtgcaactctagcacatgcattccacagctgtgggcttgcgacaatgacccagactgtgaggacggcagcgacgagtggccacagcgctgccgcggcttgtacgtcttccagggggactcttctccatgctccgcctttgagtttcattgcctctctggggagtgcattcattccagctggcgatgcgatggcggcccagattgcaaggacaagtcagatgaggaaaactgcgccgtcgccacctgcaggcccgacgaatttcagtgcagtgacggcaactgcattcacggctctcgccagtgcgatagggagtacgattgcaaagatatgagtgacgaggtcgggtgtgtgaacgtcactttgtgcgagggccccaataagtttaagtgtcacagtggcgagtgtatcaccctggataaggtgtgtaatatggctagagattgtcgcgactggtctgacgagcccatcaaagaatgcggcacaaacgagtgcctggacaacaacgggggatgctcacacgtctgtaatgacctcaaaatcggcgccgaatgcctgtgcccagacggttttcagctggtcgcccagagacgatgcgaagacattgatgaatgccaagacccagatacctgcagtcaactctgtgttaatctggaaggagggtataaatgtcagtgtgaagaagggtttcagttggacccccataccaaggcctgtaaggcagtcggatctattgcctacctattcttcacaaatcgtcatgaagtgcgcaagatgaccctggacaggagtgagtatacaagtctgattccaaacctacgcaatgtggtggccttagataccgaagtggccagcaatcgcatctactggtccgacctatctcagcgcatgatttgtagtactcagctggacagggctcacggcgtgagtagttacgataccgtcatttccagagatatccaggcccctgacgggctcgctgtggattggattcactctaatatttactggacagactccgtgctaggcaccgtttctgtggcagacacaaaaggcgtcaagaggaaaaccctgtttagagagaatggttccaaaccccgcgctattgtcgtggatccagttcacgggttcatgtactggactgattggggcacccctgctaagattaaaaaaggtggcctgaatggcgtggatatttatagcttagtgaccgagaacatccagtggcctaatggaattacactggacctgctgtctgggcggctgtactgggtcgatagcaagctgcattcaataagctcaatagacgtcaatgggggcaatagaaaaacaatattagaagatgagaagcgccttgcccaccctttttccctcgctgtgtttgaggataaggtgttctggaccgatataataaacgaagctatcttctccgccaacagactgacagggtccgacgtgaacctgctggccgaaaatctgctgtctcctgaggacatggtgctgtttcacaatctgacccaaccccgaggcgtgaactggtgcgaaaggaccacactctccaacgggggctgccagtatctatgtttacccgccccccaaatcaatcctcacagccccaaattcacttgcgcttgccccgacggcatgctgctggctagagatatgcggtcctgtctgactgaagctgaagctgccgtcgctacccaggagactagtaccgtgagactgaaggtgagctctactgcagtgcggactcagcacactacaaccaggcccgtccctgatacctctcgcctgcctggggcaacccccggactaaccacagtggagatcgtgacaatgagccatcaagctctgggggatgttgccgggcgggggaacgaaaagaaaccatcatccgtgcgggccctgtcaatcgttttaccaatcgttttattggtattcctatgcctgggagtgtttctcctgtggaagaattggagactgaaaaatattaatagcatcaactttgacaaccctgtgtatcagaagacaactgaagatgaagtgcatatttgccataaccaagacggctactcatatccttccaggcaaatggtttctctcgaggatgatgtcgcc

SEQ ID NO: 560 - DNA, 2580 bp, Artificial Sequence
  Description of Artificial Sequence: Synthetic Transcript Sequence
atgggtccatgggggtggaagttgagatggaccgtcgcacttcttcttgccgcagccggcactgctgtcggtgatagatgcgaacggaatgaattccagtgtcaggatgggaaatgcattagctacaaatgggtgtgcgatggctcagcggaatgtcaggatggttccgatgagtcgcaagaaacctgcctgtccgtcacctgtaagtccggggatttctcgtgtggagggagagtgaacagatgcatacctcagttttggcgttgtgatggacaggtcgattgtgacaacggaagcgacgaacaagggtgcccccctaagacctgttcacaggatgaatttagatgtcacgatggtaagtgtattagccggcaattcgtgtgtgactcggatcgcgactgtctcgatggttcggacgaagcatcctgtcctgtgcttacttgtggacctgcgtcgtttcagtgtaactcctccacttgtataccccagctctgggcatgcgacaatgatccagattgcgaggatggctccgatgagtggcctcaacgctgccgagggctttacgtgttccagggcgattcgtccccctgctccgcctttgaatttcactgcctttccggcgagtgcatccattcgtcctggagatgcgatggtgggccggattgtaaggataagtccgacgaagaaaactgcgcagtggcaacgtgtcgcccagacgagttccagtgcagcgatggaaactgtattcatggctcgagacaatgtgaccgcgaatacgactgtaaagatatgtcggacgaagtgggatgcgtgaatgtcaccctgtgtgagggccccaacaagttcaaatgtcatagcggtgaatgtataactctggacaaggtgtgcaacatggccagagattgcagagattggtccgatgaaccgatcaaagaatgcggcaccaacgaatgtcttgacaacaatggtggttgttcacacgtttgcaatgatcttaagattggtgcagaatgtctgtgcccagacggatttcaacttgtggcccaaaggagatgcgaggacatcgacgagtgtcaagatcctgatacgtgtagccagctttgtgtcaatctcgaaggcggatacaagtgccaatgtgaggaaggattccaacttgacccccataccaaagcatgcaaggcagtgggatcgattgcctacttgtttttcaccaaccgccacgaagtgcgaaaaatgacgcttgataggtcagaatacacgtcgttgatcccaaacctgcggaatgtggtagcgctggacactgaagtggcctcgaataggatctactggtccgacctgtcccaaaggatgatttgctccactcaactggatagagcccacggagtctcgtcctatgataccgtgatatccagggatatacaggcgccggatggcctggccgtcgattggattcactccaacatatactggacggactctgtgcttggaaccgtgtcggtggcagacactaagggagtcaagagaaaaacgctgtttagagaaaacggctccaaaccacgcgcgattgtggtggatccagtgcacggatttatgtactggacggattgggggactccagctaagatcaaaaagggcggactcaatggtgtggacatttactctctggtcaccgaaaacatacaatggcctaacgggataacgctggatctgctctccggaaggctgtattgggtggacagcaagctgcactcgatttcctctatcgatgtgaacggtggtaacagaaagactatcttggaggatgaaaaacgactggctcatcctttcagcctggcagtgtttgaggataaggttttctggaccgacattatcaacgaagcaatcttttcggcaaatcggctcaccggatcggatgtgaaccttctggcagaaaacttgctttctcccgaggacatggtgctgttccataacctgacccagcctcgtggtgtgaattggtgtgagcgtactactctttcgaacggcggctgtcagtacttgtgccttcctgcccctcaaatcaacccacactcgcctaaattcacttgtgcatgtcctgacggcatgctgcttgccagagatatgagatcgtgtctgactgaagcagaggccgccgtcgccacccaggagactagcaccgtcagactgaaagtgtcgtcaacggcggtgcggacccagcatactactaccagaccagtcccagataccagccgactgccaggggccacccccgggctcaccactgtcgagatcgtcactatgtcccatcaagcacttggtgacgtggccggccgagggaacgagaaaaaaccctcatcggtccgcgcgctgagcattgtcctccctatcgtgctccttgtgtttctttgtcttggagtctttcttctttggaagaattggcggctgaagaacatcaatagcataaactttgacaatccagtctaccaaaagaccactgaggacgaagtccacatttgtcataatcaggatggatactcgtacccaagccggcagatggtcagtctcgaggacgacgtggcg

SEQ ID NO: 561 - DNA, 2580 bp, Artificial Sequence
  Description of Artificial Sequence: Synthetic Transcript Sequence
atgggtccctggggctggaagcttcgctggaccgtcgccttgctacttgccgcagcaggcacggcagtgggagaccggtgtgagcgaaatgaattccagtgtcaggatgggaaatgtatctcctacaagtgggtgtgcgatggaagcgcggagtgccaggacggaagcgacgagagtcaggagacatgcctgtcagtaacctgcaaatcgggagactttagctgcggtggccgtgtaaaccgatgcataccccaattctggcgctgcgatggacaggtggattgcgataatggcagcgatgagcagggatgtcccccaaagacttgctcgcaggatgaattcaggtgtcatgatggcaagtgcatatcacgccagttcgtgtgcgactcagatcgtgactgcttggacgggagtgatgaagcttcctgccctgtgctaacatgcggcccggctagttttcagtgcaacagttcaacttgtatcccgcagctgtgggcttgtgataacgatccggactgcgaggatgggtcagatgagtggccacagcgctgcaggggtttgtatgtgtttcagggcgattcgagtccgtgctcggccttcgagttccactgtctgtccggcgagtgcatccattcatcctggcgttgcgacggaggacccgactgcaaagacaagagcgacgaggagaactgcgctgtggcaacgtgccgccccgacgagtttcagtgcagtgacggaaactgtatccacgggagccgtcagtgcgacagagaatatgattgcaaagacatgtcggacgaggtgggatgcgtgaacgtgacgctgtgcgaggggcctaacaaatttaaatgtcacagtggtgagtgcataacgctggacaaagtctgtaatatggcccgcgattgtcgcgactggagcgatgagccaatcaaggagtgcggcaccaacgagtgccttgacaataacggtggatgctcccacgtctgcaacgacctgaagatcggcgccgagtgcctgtgccccgacggctttcagctggtggcccaaaggaggtgcgaggatattgacgagtgccaggaccccgacacatgtagccagctgtgtgtcaacctcgaaggcggctacaaatgccagtgtgaggagggattccagttggatccgcataccaaggcgtgcaaggcagtgggctcaatagcctatctcttctttaccaatcgacatgaggtccgcaagatgacacttgaccgtagtgaatacacatcgctaatcccgaatctgcgcaatgtggtggctctagacacagaggtagccagtaataggatttattggtcggatttgagtcagaggatgatctgcagcacacagctggatagagcgcacggcgttagtagctatgacactgtcatcagccgagacatccaggcgcctgatggattggcagtggactggatccattctaacatttattggaccgacagtgtgctgggtaccgtgtccgtggctgacaccaagggcgtcaagcgcaaaaccctattcagggagaacggctcgaagccccgagcaatcgtggtggatcccgttcatggcttcatgtactggacagattggggtacgcccgcgaagattaagaagggcggcctaaacggggtagatatatattccttggttaccgaaaacatacagtggccgaatggaataacattggatttgctgtccggacgcctgtactgggtggatagtaaactgcactccatttcctctattgatgttaatgggggaaacagaaagaccatcttggaagatgaaaagcgcttggcgcaccccttcagcctcgccgtctttgaggacaaggtattctggaccgatataatcaatgaagctatcttcagtgccaaccggttgacaggttcagacgtgaacctgctggccgaaaaccttctatctccagaggacatggtcttgttccacaatcttactcagccacgtggcgtgaattggtgtgagcgaacgacactgagtaatggtggatgccagtatctgtgcttgccggccccacagattaacccgcacagcccgaagttcacctgcgcctgccccgatggtatgctgctggcccgagatatgcgctcgtgcctcacagaggcggaggccgcagttgccacccaagagacgtccactgttcgcctgaaggtcagttcaaccgctgtccgaactcagcacactaccacgcgacccgtccccgatacatcacggcttcctggtgccacccccggcctgacaacggtcgaaatagtgactatgagccatcaggccctgggagatgtcgcaggccggggcaatgagaagaagccctcatccgtcagggctctgagtatcgttctgccgatcgtgctgctggtgtttctatgccttggcgttttcctcctgtggaagaattggagattaaagaatataaacagcattaactttgataatcctgtgtaccagaaaacgaccgaagatgaagtgcatatctgccataaccaggatggctactcctacccatctcgccagatggtgtcattggaagatgacgtcgca

SEQ ID NO: 562 - DNA, 2580 bp, Artificial Sequence
  Description of Artificial Sequence: Synthetic Transcript Sequence
atgggtccctggggatggaaactccggtggaccgtggcactcctgttggcggccgcaggaaccgctgtgggtgatcggtgcgaacgcaacgagtttcaatgccaggatggaaaatgcatttcatacaagtgggtgtgtgacggttcagccgagtgtcaagacggatcggatgaatcacaagagacttgtctttccgtgacctgtaagtccggggactttagctgtgggggtcgggtcaacagatgcattccgcagttttggcgatgtgatggtcaggtcgattgtgacaatggctcagatgagcaggggtgtcccccaaagacctgttcacaagatgaatttagatgtcacgatggtaagtgcatctcacgccaattcgtgtgcgattctgatcgtgattgtctggacggatcggacgaagcatcgtgtccagtgcttacctgtggccctgcatcgttccagtgcaactcgagcacctgtatcccacaactctgggcctgcgataacgatcccgactgtgaggatgggtctgatgaatggccgcagcgatgtcgcggactgtacgtgttccaaggagatagcagcccctgctcggcctttgagtttcattgtctgtcgggagaatgtatccattcctcgtggcgatgcgatggcggcccggattgcaaagataaatcggatgaggagaactgtgcagttgcaacctgtaggccagacgaatttcagtgttccgatggaaactgcatacacggcagccgccagtgcgacagagagtacgactgtaaagacatgtcggatgaagtggggtgtgtgaacgtgaccttgtgtgaagggccgaacaagtttaagtgtcacagcggggaatgtatcaccctggacaaggtctgtaatatggcacgcgactgtagagactggtccgacgaaccaattaaggagtgtgggactaatgagtgcctcgacaacaatggcggttgttcccatgtgtgcaacgatttgaagataggcgcagaatgcttgtgtcccgatggctttcagctggtcgcgcaacgaagatgcgaggatattgatgaatgccaggatccagatacttgtagccaactttgcgtgaatttggaaggcgggtacaagtgtcagtgcgaagaaggattccaactggatcctcataccaaggcctgcaaagcagtgggatccattgcatatctgttctttactaaccggcatgaagtgagaaagatgacgctggatcgctcggagtatacgtcactgattcccaacctgcgcaacgttgtggcactggacactgaggtggcgtcgaacagaatctactggtccgacctttcgcagcggatgatttgtagcactcaactggatagagcgcatggagtgtcgagctacgatactgtcatctccagagacatccaagcaccggatggactcgctgtggattggattcattccaacatttactggactgattccgtgcttggaactgtgtcggtggccgataccaagggtgtcaaacgaaagacccttttcagggaaaatggctcgaagcctcgagcaatcgtggtggacccggtgcacggttttatgtactggactgactggggcacccctgccaagattaagaagggaggtcttaacggagttgacatatactcgctcgtgacggaaaacatccaatggcctaacggaattaccctcgatttgctttcgggacgtctttactgggtggactccaaactgcactccatctcgagcatcgatgtcaacggtgggaaccgaaaaactatccttgaagatgaaaagaggcttgcacatcctttcagcctcgcggtgtttgaagataaagtgttctggaccgacatcataaacgaagctatattctccgcgaataggttgactggctcggacgtcaatcttctcgccgaaaacttgttgagccccgaggacatggttctcttccataacctcactcagcctcgtggagttaattggtgtgaaagaaccaccttgtcaaatggaggttgtcaatacctgtgtctgcctgccccacagattaaccctcattccccaaagttcacgtgtgcgtgtcccgacgggatgcttcttgcacgtgacatgcgctcctgtctgaccgaagcggaggcagccgtggcaactcaagagacgtcaactgtccgcctcaaggtttcatcgacggcagtgcgcacccaacacactaccacccgaccggtgcctgatactagccgcctcccaggcgccaccccgggtctgaccaccgtcgagattgtgacgatgtcacatcaggctctgggagatgtggcagggcgaggaaatgaaaagaagccatcctctgtgcgcgctctttccattgtgcttcctattgtcttgcttgtgtttctttgtcttggggtgtttctgctgtggaagaactggcggctgaagaacattaactcgatcaattttgacaaccctgtctaccagaaaaccactgaggacgaagtgcacatttgtcataaccaggacggatactcatatccgtcgcgccaaatggtttcgctggaggatgacgtggca

SEQ ID NO: 563 - DNA, 2580 bp, Artificial Sequence
  Description of Artificial Sequence: Synthetic Transcript Sequence
atgggaccttggggatggaagcttcggtggacggtagctctgctactagcagcagccggtaccgccgtgggcgaccgctgcgagaggaatgagtttcagtgtcaagatggcaaatgtatctcatacaaatgggtgtgcgacggcagcgcagagtgtcaggatggatctgacgagtcacaggagacttgcttatcagtcacttgtaaaagtggcgactttagctgtggaggacgggtcaataggtgcatcccccagttttggagatgcgatggacaggttgactgtgacaacggatccgatgaacagggatgtccccccaagacgtgctctcaagacgagtttcggtgccatgatgggaagtgtatttcacgccagtttgtatgtgatagcgatcgcgattgtctcgacggatctgacgaggcctcttgccccgtgctaacctgtggccctgcttctttccagtgtaactcttccacatgtataccccaactctgggcgtgtgacaatgacccagattgcgaggacgggtctgacgaatggccacagaggtgtaggggcctctatgtgtttcagggagattcaagtccttgctccgcctttgaattccactgcctttctggagaatgtattcatagttcatggcgatgtgatggcggtccagattgcaaggataagtccgatgaagagaactgcgccgtcgcgacctgcaggcctgatgagtttcagtgctctgacggtaattgtattcacggatcccgccagtgcgatcgggagtacgactgcaaggatatgtctgatgaagtgggatgtgtgaatgtcaccctatgtgagggtcccaataaattcaagtgccacagcggagaatgtatcacacttgataaagtttgtaacatggccagggattgtcgtgactggagtgatgaacccataaaggaatgcggtacaaacgaatgcctggacaacaacggcgggtgttcacacgtgtgcaatgacctgaagataggagcagagtgcctgtgcccagatggatttcagctcgtggctcagagacgttgtgaggacatcgacgaatgccaagatccagacacatgttctcagctatgtgttaatctcgagggaggctataagtgtcaatgtgaggaaggcttccagctggatccacatacgaaggcctgcaaggctgtgggatccatcgcatatctcttttttaccaatcggcatgaagttcgtaagatgaccctcgaccgttctgagtatacatcgttgataccgaatctcagaaacgtcgtggcactcgacaccgaagtcgcttcaaatcgaatttactggagcgacttgagtcaacgcatgatatgttctacacaactggacagagcacacggtgtcagctcttacgacacggtgatctctcgtgacatccaggcgcccgatggcctcgccgtggactggattcactctaatatttactggactgactctgtgctgggcaccgtctctgtggccgacaccaagggggtaaaaaggaaaacgcttttcagggaaaatggcagtaaacccagggccatcgtggtggatccagtccacggcttcatgtattggacggactggggaacaccggcaaagatcaaaaaaggaggtctaaacggagtggacatttattctcttgtcacagaaaacattcaatggccaaatggcattacgctggatctgctgtctggcagactttattgggtcgacagcaaactacactccattagctccatcgacgtgaacggcggcaatagaaaaacgatcctcgaagatgagaaaaggttggcccatcctttctccctcgctgtatttgaggacaaggtgttctggacggatattataaatgaggccattttctctgctaacaggttaaccggttctgatgtgaacctgcttgcagagaacctcttgtcccctgaggatatggtgctattccacaacctgactcagcctcggggtgttaattggtgtgagcggaccacgttatccaacggggggtgccagtatttgtgtctgccagctcctcagattaacccacattcccctaaattcacttgtgcctgcccggatgggatgctgttagcacgggatatgagatcctgtcttaccgaagcggaagcggcagttgccactcaggaaacctccacggtgaggctgaaagtttcctcgactgccgtgcgtacccagcacaccaccacgcggcctgtgccagatacttcccgattaccaggggcgacacccgggctgaccacagtggagatcgtgaccatgagccatcaagccttaggcgacgtcgccgggaggggcaatgaaaagaagccctccagcgtgcgggcattgtccattgttttaccaatcgtcttgctagtgttcctgtgtttaggggtatttctgctgtggaaaaattggcgcttgaagaacataaatagcattaacttcgacaaccccgtgtatcagaaaactactgaagacgaagttcacatatgtcataatcaggacggctactcctacccatcccggcagatggtgagccttgaggacgacgttgca

SEQ ID NO: 564 - DNA, 2580 bp, Artificial Sequence
  Description of Artificial Sequence: Synthetic Transcript Sequence
atgggaccgtggggttggaaactgcggtggactgttgcactgttgctggccgcagccggaactgcagtgggggaccgctgcgaaaggaacgaatttcaatgccaggacggaaagtgcatttcgtacaaatgggtgtgcgacggaagtgccgaatgccaagatggatcggacgagtcacaggaaacctgtctgtcggtgacctgcaaatcgggtgacttttcatgcggcggtagggtcaatcgttgtatcccccaattctggcggtgtgacggacaagtggattgtgataacgggtccgacgagcagggatgcccgccaaagacctgctcccaggacgagttccgctgccacgacgggaagtgcatcagccgccagtttgtgtgcgacagcgaccgcgactgcctcgatgggagcgacgaagcaagctgtccagtgctgacttgcggtccggccagcttccagtgcaactcttcgacttgtattccacagctttgggcgtgcgacaacgatccagattgcgaagatggatcagacgaatggccgcagaggtgtcgcggactgtacgtctttcagggggactcgtccccgtgcagcgcctttgaattccattgcttgtccggcgaatgcatccattcatcgtggcggtgcgatggaggccctgattgcaaagacaagtccgacgaggagaactgtgccgtggccacctgtagaccagatgagttccagtgctcagacggaaactgcatccatggcagccggcagtgcgacagagagtacgactgtaaggacatgagcgatgaagtgggttgcgtcaacgtgactctctgcgaggggcccaataagttcaagtgccattcgggagaatgcattactctggacaaggtctgcaacatggccagagattgcagagactggtcagacgagccgattaaggagtgtggcactaacgagtgcctcgataacaatggaggatgctcccacgtgtgcaacgacctgaaaatcggggctgagtgcctgtgccctgacggattccaactcgtggcccagcgccggtgcgaggacatcgacgagtgtcaagaccctgacacctgctcccaactctgcgtgaacctcgagggagggtacaagtgccagtgcgaggaggggttccagctggacccccatacgaaagcctgcaaagccgtcggaagcatcgcgtaccttttcttcaccaaccggcacgaggtgaggaaaatgactctggaccggtcggaatacacgtcactcattccgaacctcaggaatgtcgtggctctcgataccgaggtcgcgtcaaatcggatctactggtcagatctttcccaacgcatgatctgttcaactcagcttgaccgcgctcatggcgtgtcatcctacgacaccgtgattagccgcgatatccaggctccggatggtctggctgtggattggatccactcgaacatctactggactgactcggtgctcgggactgtgtccgtggccgacactaagggagtcaagcgaaagactctgttcagagaaaacgggtcgaagccacgcgccatcgtggtcgatccagtccatggcttcatgtactggaccgactggggcactccggccaagatcaagaaaggaggacttaacggcgtggatatctattcgctcgtcactgagaacatccaatggccgaatggtatcaccctggatctgctctcgggacggctctactgggtggatagcaagctccacagcatctcctctattgacgtgaacggcggtaatcgaaagactatactcgaggatgaaaaaagactcgcccatccattctccctcgcagtgtttgaggacaaggtcttttggaccgatatcattaatgaagccatctttagcgcaaatcgcctgaccggctccgatgtgaacctgctggccgaaaatctcttgtcgccagaagatatggtgctctttcataaccttacccagccgcggggagtgaactggtgtgagcggactaccctttcaaatggtggatgtcagtacctctgccttcctgcgccgcagatcaacccccactccccaaagttcacttgcgcctgcccggatgggatgctgctcgcccgcgatatgcgctcgtgtctgaccgaggccgaagcagccgtggcgactcaggagacgtccacggtgagactcaaggtgtccagcaccgccgtcagaacccagcacactaccacccgcccagtgccggacacgtctcggcttccaggcgcgaccccgggccttaccactgtcgaaatcgtgactatgagccaccaagccctcggtgatgtcgcgggacgcggtaacgagaagaaaccgtcctcggtccgagccttgtccatcgtcctgccgatcgttctcctggtgttcctgtgcctcggtgtgttcttgctgtggaagaattggcggttgaaaaacatcaattccatcaacttcgacaatccggtgtaccagaaaactacggaggatgaagtgcatatctgccacaaccaagatggatactcgtacccttcgcgacagatggtcagcctcgaggacgatgtggca

SEQ ID NO: 565 - DNA, 2580 bp, Artificial Sequence
  Description of Artificial Sequence: Synthetic Transcript Sequence
atgggaccttgggggtggaagctgcgttggaccgtcgcacttcttcttgccgctgcaggcactgcagtgggcgatcgctgtgagagaaacgaattccaatgtcaggatggaaaatgtatttcgtacaagtgggtgtgtgatggaagcgccgaatgccaggacggttccgacgaatcacaagagacttgtctttccgtcacgtgtaagtcaggtgatttcagctgcggcgggagggtgaaccgttgtattccccaattttggcgatgtgacggccaagtggactgtgacaatggatcggatgaacaaggatgtcctccaaagacttgcagccaggatgagtttagatgtcatgatggaaaatgcatttccagacagtttgtctgtgactcagaccgggattgtcttgatggctcggacgaagcctcatgtccggtgctcacgtgtggacccgcgtcttttcaatgcaacagctcgacttgcattcctcagctctgggcgtgcgataacgatcctgattgtgaggatggatccgatgaatggccccagcgctgtcgcggactgtacgtgtttcagggagactcaagcccatgttcggcattcgaattccactgtctgagcggggaatgtattcatagcagctggcggtgcgatggaggacctgactgtaaggataagtccgacgaagaaaactgtgcagtggcaacctgtcgccctgatgaatttcagtgtagcgatggaaactgtattcatggttcacgtcaatgtgaccgggagtatgattgtaaggatatgtctgatgaagtcgggtgtgttaatgtgactctctgtgagggacctaacaagtttaagtgtcactcaggggagtgcattactttggataaggtttgcaatatggcacgcgactgtcgcgattggtccgatgaaccaattaaggaatgcggaactaacgagtgtctggataacaatgggggatgttcgcatgtgtgtaatgacctcaaaatcggggcggaatgcctttgcccagacggttttcaacttgtggcacaaaggcgctgcgaagatattgatgaatgccaagatcccgacacgtgctcgcaactctgtgtgaacctcgaaggcggatacaagtgccagtgcgaagaaggttttcaactggacccacataccaaggcatgcaaggcagtggggagcattgcataccttttctttactaatagacatgaagtccggaaaatgacgcttgacagatcagagtatacttcgttgattcccaacttgaggaatgtggtggcactggataccgaggtcgcttcaaacaggatttactggtctgatttgtcgcagcggatgatctgttccacccagcttgatagggcccacggagtctcttcctacgatactgtgatttcgcgcgacattcaagcacctgacggactcgcagtcgattggatacattcgaatatctactggactgattcagtgctgggaaccgtgtcggtggcagacaccaagggtgtcaaaagaaagactctgtttcgggaaaatggaagcaaacctcgagcaatagtggtggacccggtgcacggatttatgtactggaccgattggggaaccccggcaaagataaagaagggcggtctgaacggtgtggacatctactccctggtcaccgaaaacattcaatggcctaacggaatcaccctggatcttctgagcggtagactttactgggtggatagcaagctccactcgatctcgtcaattgatgtcaatgggggaaatcgtaagaccatattggaggacgagaagcgacttgctcatcctttctccctggcagtctttgaagataaggtcttttggactgatatcattaacgaagcaatcttttcagcaaataggctgactggatcagatgtcaatctgctggccgaaaatctgttgtccccagaagatatggtcctcttccataaccttacccagcctagaggagtgaactggtgtgagaggacgacgctgtcgaacggtggatgccagtacctgtgtctccctgcgccacagattaaccctcactcccctaaattcacttgtgcctgtcctgatggcatgctgctggcacgtgatatgcgatcttgccttaccgaagctgaggcggctgtcgcaactcaggaaacctctactgtgagactcaaggtgtcctcgactgcagtccggactcaacacaccacgacccgacctgtccctgacacctcgcgcctgcccggagcaactccagggcttactacggtggaaattgtgaccatgagccatcaggcgttgggggacgtcgcaggtcgtggtaacgagaagaaaccttcatcggtgcgagcgcttagcattgtgcttccgattgtgctgctggtgttcctttgtctgggcgtgtttctgctttggaagaattggcggcttaagaacattaactccatcaactttgataaccccgtgtaccagaaaaccactgaggacgaagttcatatctgtcataaccaggacggatactcgtacccatcgcggcagatggtgtcactggaagatgacgtcgcg

SEQ ID NO: 566 - DNA, 2580 bp, Artificial Sequence
  Description of Artificial Sequence: Synthetic Transcript Sequence
atggggccatggggatggaagctccgttggaccgtggctctgcttctggccgcagccggcactgctgtgggcgacaggtgcgagagaaacgagttccagtgtcaggacggtaagtgtatcagctacaaatgggtctgtgatggcagcgccgaatgccaagatggtagtgacgaatcccaagaaacgtgtctgtctgtgacctgcaagagcggagacttttcttgcggtggtcgtgttaaccgctgcataccgcaattctggcgctgtgacgggcaggtggactgtgacaacgggagcgatgagcaggggtgtcccccaaaaacctgcagccaggatgaatttaggtgccatgacggcaaatgcatcagccgccagttcgtctgcgacagcgaccgggattgcctggatggcagtgacgaggcatcgtgtcctgtactgacatgtggaccggctagcttccagtgcaacagctctacctgtataccccagctgtgggcctgcgacaatgatcccgattgcgaggacggttcagacgagtggcctcagcgatgtagaggcctctacgtttttcagggggactcaagtccctgcagtgcctttgaattccattgcctgtcaggagagtgcatccactcaagttggaggtgcgacgggggtcctgattgtaaggacaagagcgacgaagagaattgcgccgtagctacttgtcggccagatgagttccaatgcagtgatgggaactgtattcacggctcacggcagtgtgacagggaatatgattgtaaggatatgtccgacgaagttggttgcgtcaacgttaccctctgcgagggccctaacaaattcaagtgccacagcggagaatgtatcactctggacaaggtgtgcaatatggcgcgggactgccgcgattggtccgatgagccaataaaagaatgtggcaccaatgaatgtctggacaataacggtggctgcagtcatgtctgcaacgacctgaaaatcggagccgaatgtctgtgcccagatggttttcagctggtggcacagcgccggtgcgaggacatcgacgaatgtcaggatcccgatacctgcagtcaactgtgtgtcaatctggaggggggttataagtgtcagtgcgaggagggattccagttggacccccatactaaagcttgcaaggcagtcgggagcatcgcgtacctgtttttcacgaacagacacgaggtgcggaaaatgacacttgaccgctcagagtatacctccttaatccctaatctcaggaacgtggtggccctggataccgaagtggccagtaaccgcatctactggtcagacttaagccagagaatgatttgctctacgcaactggatcgcgcacatggtgtttcctcctacgacacggtcatatcccgtgacattcaagcacccgacggattagccgtagactggatccactctaacatttactggacggattcagtgctgggtacagtgtctgtcgcagatactaaaggcgtgaagagaaaaaccctgtttcgagagaacgggagtaagcctcgcgcaatcgtggtcgaccccgtccacggctttatgtattggacagactggggcacccccgccaagataaagaagggtggtctgaatggcgtggatatttattctcttgtgactgagaatattcagtggccgaacggaatcactctggatctgctgagtggacgtttgtattgggtagatagcaagctgcactcaatatcctccatagatgtaaatggaggaaatagaaagacaatcctcgaggacgaaaagaggcttgctcatcctttttccctggctgtgttcgaagacaaagtattctggacggatataattaacgaggccatcttcagcgcaaaccgcctgaccggtagcgacgtaaacctgctggccgagaatttgctctctcctgaggatatggtgttgttccataacctgactcagcctcggggcgttaattggtgtgagcgcaccacattgtccaacggcgggtgccagtacctttgcctccccgctcctcagataaacccacattcacctaaattcacgtgcgcgtgcccggatggcatgctgttggcacgagacatgaggagctgtttgaccgaagccgaagcagcggtagccacccaggagacatcaaccgtgcgcctgaaggtttcttccaccgctgtccgaacccagcacaccactacaaggccagtcccagacacttcaagactgccaggtgccacccctggcctgaccacagtggagatcgtcactatgtcgcaccaagcgctaggcgacgtagctggcagaggtaatgagaaaaaaccctcatctgttcgggcgctgtcaattgtcttacccatcgtgcttctggtctttttatgtctcggcgtgttcctattgtggaaaaactggaggctcaaaaatataaacagcataaattttgataacccagtctaccagaagacaacagaggatgaggtgcacatctgtcataatcaggacggctacagctacccatctcgccagatggtaagtctggaggacgatgtggcc

SEQ ID NO: 567 - DNA, 2580 bp, Artificial Sequence
  Description of Artificial Sequence: Synthetic Transcript Sequence
atgggcccatggggctggaagctcagatggaccgttgccctactcctggctgcggccgggactgctgtgggcgaccggtgcgaacgaaacgagtttcagtgtcaagacggaaaatgcattagctacaagtgggtctgcgacggatccgcagagtgccaggatggcagcgatgaatcccaggagacttgcttatccgttacctgcaagtctggagattttagttgcggcggaagggtgaacagatgcatcccacagttttggaggtgcgatgggcaagtggattgtgataacgggagcgacgaacagggatgtcctcccaaaacttgcagccaagacgaattccgctgtcacgacggaaagtgcatcagtcgtcaattcgtctgtgatagtgaccgcgactgtcttgatgggtccgatgaagcttcttgcccagtcttgacatgcggtccagctagctttcagtgcaactcgtctacttgtatcccacagctgtgggcttgtgataatgatccagactgtgaggatggaagcgatgaatggcctcaaaggtgccgcggactctacgtgttccagggagatagtagcccttgctccgccttcgagtttcattgccttagcggagagtgcatccactcgagctggcgctgtgatggcggacccgattgcaaggataaaagcgatgaagaaaactgcgcggtcgcgacctgccgaccagacgaattccaatgttctgacggcaactgtatccatggatcgaggcaatgcgatagggagtacgattgcaaggatatgagcgatgaggtgggatgtgtgaacgtgaccctctgtgagggaccaaataaattcaaatgtcatagtggagaatgcatcacacttgacaaggtgtgtaacatggccagggactgccgcgactggtctgacgagccgatcaaggaatgcggaaccaacgaatgcctcgacaacaacggaggatgctctcacgtctgtaacgacttgaaaattggagccgagtgcctctgccctgatgggttccagctggtggcccagagacggtgtgaagatatcgacgaatgccaagacccagacacctgcagtcaactgtgcgtcaatctggagggggggtacaagtgtcagtgcgaggaaggcttccagcttgatccccatacaaaggcttgtaaagccgtgggaagcattgcttacctgttcttcaccaatagacatgaggtgagaaaaatgaccttggataggtcagaatacacctcactgatacctaacctgcgcaacgtggtggctctggacaccgaagttgcatctaaccgcatttactggtcagacctctctcagcggatgatatgcagcacacagctggacagagcacacggtgtatccagctacgacaccgtgattagcagagatattcaggcacctgacggcctggccgtcgactggatccacagcaacatctattggacggactctgtcctgggtaccgtctctgtcgctgatacaaagggcgtcaaaaggaagacactgttcagggagaacggcagcaaaccacgagccatagtagtcgacccagtccatgggtttatgtactggaccgattggggtactcccgcaaagatcaaaaagggcggcctgaacggcgtcgacatctacagccttgtgaccgagaacattcaatggccaaatgggattacccttgatctgctgtctggaagactatactgggtggattctaagttgcattcaatctcaagcatcgacgtgaacggcggaaaccgcaagaccattcttgaagatgaaaagcgcctcgcacaccccttctccctcgcagttttcgaggataaagtattctggaccgatatcattaacgaggctatcttttccgcaaaccgattgacgggcagcgacgttaacctgttggcagaaaaccttctgtcccctgaggacatggttctgtttcacaaccttacacaacctagaggcgtcaattggtgtgaaaggactactttaagcaacggcggatgccaatatctgtgtctgccagctccccagatcaacccgcatagtcctaaattcacatgcgcttgtcccgacgggatgctgcttgctcgcgatatgcgatcttgcttaaccgaggccgaagccgctgtagccacccaagaaacctcgaccgttagacttaaagtttcctctacagctgtgagaacccaacacaccaccaccaggccagtgcctgatacaagccgcctccctggtgccacacccggccttaccactgtagaaatcgtcacaatgtcccaccaagcactgggagatgtggccggccgtggtaacgaaaagaagcccagtagtgtgcgcgcgctctctattgtgctgccaattgttcttttggtgtttttgtgcctgggagtgtttctgctctggaagaactggaggctcaaaaacatcaacagcataaactttgataaccctgtgtaccaaaagacaaccgaagacgaggtccacatttgtcacaaccaggacggctacagttaccccagtaggcagatggtctcactggaagatgacgtggcc

SEQ ID NO: 568 - DNA, 2580 bp, Artificial Sequence
  Description of Artificial Sequence: Synthetic Transcript Sequence
atgggcccctggggatggaaactgcgctggaccgtagccctgttgctggcagcagccggaacagccgttggcgaccgttgtgaaaggaacgagtttcaatgccaggacggaaagtgtatatcatacaagtgggtgtgtgacgggtccgccgagtgtcaggatggcagcgatgagtcccaggagacatgcctttccgtgacttgcaagtctggcgatttctcctgcgggggtcgtgtcaaccgatgtatcccccagttctggcggtgtgatgggcaggttgattgcgacaatggttcggatgagcagggttgtcctccaaagacctgctctcaagatgagttccggtgccacgatggaaagtgcatatcacgccagttcgtttgcgattcggatagggactgtcttgatggctcggatgaggcaagctgtccagtgctgacatgtggacctgcttcttttcagtgtaacagctcaacttgcatcccccagctctgggcgtgtgataatgatccggattgcgaggatggctccgacgagtggccacagagatgcagaggcctttatgtgttccaaggtgacagttccccttgcagcgcctttgagttccactgcttatccggcgagtgtattcacagcagctggcgttgcgacggagggccggattgtaaagataaatcggatgaagagaactgcgcggtggcgacctgccggcccgatgagtttcagtgttcagatggaaattgcatccacggaagtcggcagtgtgatagggagtatgactgtaaggatatgtctgatgaggtcggctgcgtcaacgttaccctctgtgagggacctaacaagtttaaatgccactctggggagtgtattaccttggacaaagtatgcaacatggcacgagactgtagggactggtcagacgaaccaatcaaggaatgcggaaccaatgagtgtcttgataacaacggcggctgttcccatgtttgcaatgacttaaagatcggcgccgaatgtctttgccccgatggttttcagctcgttgcccagcgccggtgcgaggacatcgacgaatgtcaagacccagacacctgttcacagttatgtgtcaatctggaggggggttacaaatgccagtgcgaggaaggctttcagctggatccacacacaaaagcttgcaaagcggttgggtcaattgcgtatctctttttcaccaatcggcacgaagtccgcaaaatgaccttggatagatccgaatatacaagcctgataccaaatctgaggaatgtggtcgcacttgatacagaggtggcgagtaatagaatttattggagcgatctgagccagcgtatgatctgttcaacccaactggatagagcccatggggtttcttcgtacgacacagtgatatctcgggacattcaggcacccgacggtctcgcagtcgattggatacacagcaacatatattggacagactcggttctggggacagtcagcgtcgcagatactaagggcgtaaagcgcaagactctgtttcgggagaatggtagcaagccgagagctatcgtggttgatccggtgcacggtttcatgtattggactgattggggaacgccagccaagattaagaaagggggcctgaatggtgtggatatttactccctggttacagagaatatccagtggccaaacggaatcaccctcgatctgctgtccggtcgactctattgggtggatagcaaactccactcgatctcatctattgacgtcaacggtggaaatcggaaaaccattctcgaagatgaaaagaggcttgcccaccctttcagccttgctgtgtttgaggacaaagtgttttggacagacatcatcaatgaggccattttctctgccaatcgcttgaccgggagcgatgtgaacttgctggctgaaaatttactgtcacctgaggatatggtgctctttcataatttgacccagcctcgtggcgtaaactggtgtgaaagaacaaccttatcaaatgggggctgtcagtacctatgccttccagcgccacaaattaatccacacagccctaagtttacctgtgcgtgccctgatgggatgctgctagctcgagatatgcggagctgtttgaccgaggcagaagccgccgtagcgacgcaggagacgtccactgttcggctgaaagtgagtagtaccgccgtgagaacccaacataccactacacgccctgttcctgacacttctaggctgcctggcgcgacgccgggtcttaccaccgtagagatagtcacgatgagtcaccaggcactgggcgatgtcgcgggacggggaaacgaaaagaagcccagtagtgttcgtgctctgagcatcgtcttacccatcgtactgctagtgtttctatgtctcggagtattcctgctgtggaaaaactggcggctcaagaacatcaatagtattaacttcgataatccagtgtaccagaaaactactgaggacgaggtgcatatttgtcacaaccaggatggatacagctatccttccagacagatggtgtccctggaagatgacgtggct

SEQ ID NO: 569 - DNA, 2580 bp, Artificial Sequence
  Description of Artificial Sequence: Synthetic Transcript Sequence
atggggccatggggctggaaacttcgatggaccgtcgcccttcttctggctgcagctggtaccgcagtgggagatcgatgtgaaagaaacgaatttcaatgtcaggatggtaagtgtatctcatacaagtgggtgtgcgatggctccgctgaatgtcaagatgggtccgacgagtcacaagaaacctgcctttccgtgacctgtaaatcaggagacttttcatgtgggggccgagtgaataggtgtattccgcaattttggcggtgtgatggacaagtggattgcgataacggttcggacgaacaaggatgtcctcctaagacttgcagccaggacgaatttcggtgtcatgatggaaaatgtatttcacgccagtttgtgtgtgacagcgatcgcgattgtcttgatggtagcgatgaagctagctgccccgtgctgacctgtggacctgcatcatttcaatgcaactcgtcaacctgtattccacagctttgggcatgcgacaacgatccagattgtgaagatggctccgatgagtggcctcagcggtgtaggggcctttacgtctttcaaggcgattcgtcgccatgcagcgcgttcgagtttcactgtctgtccggggaatgcatccattcctcatggaggtgcgatggagggccggattgtaaagataagtccgatgaggagaattgtgcagtcgcaacttgtcggcctgacgagtttcagtgttctgatggaaactgtatccatggttcacggcaatgtgacagggaatacgactgtaaggacatgagcgatgaggtgggatgtgtcaatgttactctgtgcgaaggacccaacaagttcaagtgtcattccggtgagtgcatcaccttggacaaggtgtgtaacatggcccgggattgtcgcgactggtcggacgagcctattaaggaatgcggcacgaatgagtgccttgataacaatgggggctgttcccacgtgtgcaatgatctgaagattggggccgaatgtttgtgccctgacggatttcaactggtggcacagagaagatgtgaggatattgacgagtgtcaagatcctgatacttgcagccaactgtgtgtgaacttggaaggtggatacaaatgccaatgcgaagaaggtttccaactcgatcctcataccaaggcctgcaaggcagtgggctccatcgcatacctcttctttactaaccgacatgaagtgagaaagatgacccttgatcgttcagagtacacctcgctgatccctaaccttcgcaacgtggtggcactggatacggaagtggcatcgaatcgcatttactggtccgatctttctcaaagaatgatttgctcgactcaacttgacagggcacacggcgtgtccagctacgacaccgtcatatctcgggacattcaagcccctgacggtctggcggtggattggattcacagcaatatctactggaccgactcggtcctgggtacggtttcagttgctgataccaagggagtgaagcgtaagaccctttttcgggagaacgggagcaaacccagggcaatcgtcgtggacccggtgcatgggttcatgtactggaccgattggggaaccccagccaagattaagaagggaggactgaacggggtcgacatatactcactcgtcaccgaaaacatccagtggccaaacggaataactctggatcttctttccggtaggctttactgggttgactccaaactgcattccatttcttcgattgatgtgaatggtgggaaccgcaagaccatccttgaggacgagaaacggctggcacatccattctcgctggccgtttttgaagataaagtcttttggaccgacatcataaatgaggcgattttctctgcaaaccgccttaccggatccgatgtgaatctgctggcagaaaacctgctttccccagaagatatggtgcttttccataatcttactcagccgagaggtgtgaattggtgcgaaaggaccactctgagcaatggaggatgtcagtacctgtgtttgcctgcacctcaaatcaaccctcattcgcctaagttcacctgtgcttgtccggatggtatgctgttggcgagagacatgaggtcgtgccttaccgaagccgaggcagctgtggcaacccaggaaacttcaactgtgcggctgaaggtatcgtccaccgctgtcaggactcagcatactaccacgcggccagtgcctgacacctcacgcctgcctggagcaaccccaggattgactaccgtggagattgtgaccatgagccaccaggcactgggggacgtcgcgggaaggggtaacgagaagaaaccatcctccgtgcgcgcactgtcaatagtcctgccaattgtgttgctggtctttctttgcctcggggtctttctgctctggaagaattggagacttaagaacattaacagcatcaacttcgataatcccgtgtaccaaaagacgaccgaagatgaagtccatatctgtcataatcaggatggatactcatatccttcccgccaaatggtttcgcttgaggacgatgtggcc

SEQ ID NO: 570 - DNA, 2580 bp, Artificial Sequence
  Description of Artificial Sequence: Synthetic Transcript Sequence
atgggaccatggggttggaaattaaggtggactgttgctcttttattagctgcagcaggaactgcagttggtgatcgatgtgaaaggaatgaattccaatgtcaagatggtaaatgtattagttataaatgggtgtgtgatggatctgcagaatgtcaagatggaagtgatgaatcacaagagacatgtctttctgttacatgtaaaagtggagatttttcatgtggaggacgagtaaacagatgtattcctcaattctggcgttgtgatggtcaagtagattgtgataacggatctgatgaacaaggatgcccacctaaaacttgttcacaagatgaatttcgttgtcatgatggtaagtgtatttcaagacaatttgtttgtgattctgatagagattgtcttgatggttcagatgaagctagttgtccagtattaacctgtggaccagcatcattccaatgtaattcatctacatgtattccacaattatgggcatgtgataacgatccagattgtgaagatggttctgatgaatggccacaacgatgtagaggtttatatgttttccaaggagactcaagtccttgttcggcttttgaatttcattgtctatccggtgaatgtattcattcatcttggagatgtgatggaggaccagattgtaaggataaatcagatgaagaaaattgtgcagtagctacttgtcgtccagatgaattccaatgtagtgacggaaattgtatccacggatcaagacaatgtgatagagaatacgactgtaaagatatgtcagatgaagttggatgtgtgaatgttacattgtgtgagggaccaaataaattcaaatgtcactctggagaatgtattactttagataaggtttgtaatatggcaagagattgtagagattggagtgatgaaccaataaaagaatgtggaacaaatgagtgtttagacaataatggaggatgttctcatgtttgtaatgatttaaagataggtgctgaatgtttatgccctgatggttttcaacttgttgcacaacgaagatgtgaagacattgatgaatgtcaagatcctgatacctgtagccaattatgtgttaatttagaaggtggatataagtgtcaatgtgaagaaggatttcaattggatcctcatactaaagcatgtaaggcagtcggaagtatagcttatctttttttcacaaatagacatgaagttagaaagatgacacttgatagatctgaatatacatctcttatacctaatcttagaaatgttgtagcattagatactgaagtagcttccaatagaatatattggtcggatttatcacagagaatgatttgttctacccaattagatcgtgctcatggagtttcctcatatgacacagtaattagtagagacattcaagcaccagatggattagctgtagattggatacactcaaatatttattggactgattctgtattaggaacagttagtgtggctgatactaaaggagttaaaagaaaaacactttttagagaaaatggatctaaaccacgagcaattgtagtggatcctgtacatggttttatgtattggacagactggggtacacctgctaaaattaaaaaaggaggacttaatggagttgatatttattcattagtaactgaaaatattcaatggccaaatggtattacgcttgatcttctttcaggacgtttatattgggttgattctaaacttcatagtatttctagtattgatgtaaatggtggaaatagaaaaactattttagaggatgaaaaaagattagcccatccatttagtttagctgttttcgaagataaggttttctggactgatattattaatgaagcaattttttcagctaatcgtcttacaggatcagatgttaatcttttagctgaaaatttattatcgcctgaagatatggttttgtttcataatcttactcaaccaagaggagtaaactggtgtgaaagaactactctttcaaatggtggatgtcaatatttgtgtttgccagcaccacaaattaatccacattcacctaaatttacttgtgcatgtccagatgggatgttgttagcaagagacatgagatcatgtctaactgaagcagaagctgctgttgctacacaagaaacttctacagttagacttaaagtttcttcaactgcagttagaactcaacatacaactacaagaccagttcctgatacatcaagattaccaggagctacaccaggacttacaactgttgaaattgttacaatgtcacaccaagctttaggtgatgttgcaggacgtggaaatgaaaaaaaaccatcttctgttagagcattatctattgttttaccaatagttttattagtattcttatgtttaggagttttcttactttggaagaattggagacttaaaaatattaatagtattaattttgacaacccagtttatcaaaaaacaacagaagatgaagttcatatctgtcataaccaagatggatactcatatccatctagacagatggtatctttagaagatgacgtagca

SEQ ID NO: 571 - DNA, 2580 bp, Artificial Sequence
  Description of Artificial Sequence: Synthetic Transcript Sequence
atggggccttgggggtggaaactgcgctggacagtggctctcctactggctgctgcaggtacggccgtaggcgatagatgcgaacgcaacgagtttcaatgccaggacgggaagtgtatttcttacaagtgggtctgcgacggatccgctgaatgccaagatggctcggatgaatcacaggaaacctgcctgtcggtgacatgcaagtcaggcgacttctcttgtggcggcagggtaaaccgatgcataccccaattctggcggtgtgatggtcaggtcgactgcgacaacggcagcgatgagcagggatgcccaccgaaaacctgtagccaggatgagtttcggtgtcatgatgggaagtgcatctcaaggcagttcgtgtgcgacagcgaccgtgactgcttagacgggtctgatgaggcgtcttgtccagttctgacctgcggccctgcatcatttcagtgcaacagcagtacgtgtatccctcagctgtgggcctgtgataacgatcccgattgtgaggacggaagtgacgagtggccacagcggtgtagaggcctgtatgtgtttcaaggagactcgtcaccttgctctgcctttgagtttcattgccttagcggggaatgcatacacagcagctggcggtgtgacggcggacctgactgtaaggacaaatcagatgaggagaactgcgcagtggcgacctgcagacccgatgaatttcagtgtagtgatggcaactgcatccacggctcacgacaatgcgaccgggaatatgactgcaaggatatgagcgatgaagttggatgcgttaacgttactttgtgcgagggccctaataagtttaagtgtcactcaggcgagtgtatcacactggacaaggtgtgtaacatggctagagattgccgagattggagtgacgagccgatcaaggagtgtggcaccaacgagtgtctagataacaacgggggttgcagtcacgtgtgtaacgacctgaagattggggccgaatgtctgtgccccgatggcttccagctggtcgcccaaaggcgctgcgaggacattgatgaatgccaggacccagatacctgttcccaattgtgcgttaacctcgagggaggctacaaatgtcagtgcgaggaaggttttcagctggatccccacacaaaggcttgtaaggcagtgggcagcattgcttacctcttctttactaaccgacacgaagttagaaaaatgacattagatagaagcgaatatacgtccctgatccctaacttgaggaatgtggtggccctggatactgaagtagcttcaaaccgtatctactggtctgatctgtcacagaggatgatttgcagcactcaactggacagggcccatggcgtatcctcatatgacactgtgatcagccgcgacatacaagcacccgacgggcttgcggtggattggatacatagcaatatctactggaccgattcagttctcggtaccgttagcgttgcagataccaagggagtgaagagaaagactctgttccgtgagaacgggtctaagcctcgggctattgtggtggaccctgtgcacggctttatgtattggacagactggggcacacccgcgaaaattaagaaaggtggtttgaacggtgtggacatctattcccttgtgacggaaaacatacagtggcccaacggcatcacccttgacctattatccggtaggctctactgggttgacagtaagcttcatagtataagcagcatcgatgtgaacggcggcaaccgtaagaccattctggaagacgaaaaacgccttgctcatcccttctctctggccgtgtttgaagataaagtcttctggactgatataatcaacgaagcaattttcagtgccaaccgcctgacagggtcagacgtaaacctgctggctgaaaacctgctgagcccagaggatatggtgctgttccacaatctcacacaacctcgcggagtaaattggtgcgaaagaacgaccctttctaacggcggctgccagtatttgtgcttgcctgctccccaaattaacccacactcacctaaattcacttgtgcatgcccggatgggatgttgctggcccgggacatgcggagctgtctcactgaggccgaggccgcagtggccacacaggaaaccagcaccgtcaggttgaaagtatcctcaactgccgttagaacccagcacacaacgacaaggccagttccggacacatcccgcctacctggggccactcccggcctgacaactgttgagattgtgacaatgtctcaccaagcgctcggtgacgtcgccgggaggggcaacgagaaaaaaccttcctcagtgcgggctttatcgatagttttgcccatcgtgcttctggtgtttctgtgtctcggggtgttcctcctttggaagaattggagactcaagaatatcaactcaataaatttcgataaccctgtctatcagaagacaacagaggacgaagttcacatctgtcacaatcaggacggctactcttaccccagtcgccagatggtttcattggaagacgacgtcgcc

SEQ ID NO: 572 - DNA, 2580 bp, Artificial Sequence
  Description of Artificial Sequence: Synthetic Transcript Sequence
atgggaccgtggggctggaagctccgctggactgtcgcgctgctgctggcagcggctggaaccgccgtgggggatcgttgtgagcgaaacgaattccaatgccaggacggcaagtgcatttcctataagtgggtgtgcgacggttccgccgagtgccaagacggatcggatgaatcgcaggagacttgcctttccgtgacttgtaagtcgggagacttcagctgcggaggccgggtcaatcggtgcattccacagttttggcggtgcgacggtcaagtggactgcgataacggatccgacgagcagggctgcccgccgaaaacttgctcgcaggacgaatttcgctgccacgatggtaaatgcatctcgcggcaatttgtgtgcgactcggacagggactgcctggacggatcggacgaagcctcgtgccctgtgcttacctgcggcccggcatcatttcaatgcaactcctcgacctgcatccctcaactgtgggcctgcgataatgatccggattgcgaggatggaagcgacgaatggccgcaacggtgtcgggggttgtacgtgttccagggagattcatcgccctgttcggccttcgagttccattgtctgtcaggtgaatgtattcactcatcgtggcgctgcgacggaggcccggattgtaaggataaatcagatgaggaaaattgtgcggtggccacttgtcgccccgatgagttccaatgctccgacggaaactgcattcacggaagccggcagtgtgaccgcgaatacgactgcaaagacatgtcggacgaagtgggatgcgtgaatgtgactctgtgcgaagggccgaacaagttcaagtgccattcaggggaatgcatcactctggacaaagtgtgcaacatggcccgggattgtcgggactggtcggatgaaccaatcaaggaatgcgggaccaatgaatgcctggataacaacggggggtgctcacacgtgtgtaacgacctcaagatcggtgcggaatgcctgtgccctgatggtttccagctggtggcccaacgccggtgcgaagatattgatgaatgtcaagatccagacacctgctcccagctgtgtgtgaacctggagggaggatacaagtgccagtgtgaggaaggttttcagctcgacccgcacaccaaggcctgtaaggccgtgggatccatcgcttacctcttcttcaccaatcggcacgaggtccggaagatgactttggacagatccgaatacaccagcttgatcccgaacctcaggaacgtcgtggcgctggatactgaggtcgcatcaaacagaatttactggtcggatctctcacagcggatgatctgctccactcagctcgaccgggcgcacggggtgtcgagctacgacaccgtgatctcccgcgacatccaggctccagacggactcgctgtcgactggatccattcgaacatctactggactgattccgtcctggggaccgtttcggtcgccgacaccaagggagtgaagcggaaaactctcttccgggaaaatgggagcaaaccgcgggccatcgtggtggatccagtgcacggattcatgtactggaccgactggggcactcctgcgaagatcaagaaggggggactgaacggagttgatatctactccctcgtcaccgaaaacattcagtggcccaatggaataactctggacttgctctcaggcagactctactgggtggactcgaagctgcactccatcagctccatcgacgtgaatggcggaaaccgcaagactattttggaggatgagaaacggctggcacacccgttttctctggcggtgttcgaagataaagtgttttggacggacattatcaacgaagccatcttcagcgccaatagactgaccgggagcgatgtgaacctcctcgccgaaaacctgctgagcccggaagatatggtgctcttccataacctgacccaacctcggggagtcaactggtgtgaacgaaccaccctgtcgaacggaggatgccagtacctctgtttgccagccccgcagatcaacccgcactcgccgaagttcacttgcgcatgtcctgacggaatgctgctggcccgcgacatgcgctcgtgcctgacggaagcggaggccgccgtggcaacccaagagactagcactgtgagactgaaagtctcaagcaccgcggtgaggactcagcacaccaccactagacctgtgcccgacacctccagactccccggagccacgccgggactgactactgtggaaatcgtcacgatgtcgcaccaagcactgggagacgtggcgggcagaggcaacgagaaaaaaccatcgtcagtccgcgccctctccatcgtcctcccgatcgtgctgctcgtgttcttgtgcttgggcgtgttcctgctgtggaaaaactggcgccttaagaacatcaattccatcaattttgacaacccggtgtatcaaaagaccactgaggatgaagtacatatctgccataaccaagacggatactcgtacccatccagacaaatggtgtcgctcgaggacgatgttgcc

SEQ ID NO: 573 - DNA, 2580 bp, Artificial Sequence
  Description of Artificial Sequence: Synthetic Transcript Sequence
atgggtccttgggggtggaaactgcgctggacagtcgccttgctgctcgccgctgcgggcacagccgtgggggatcgatgtgaaagaaatgaatttcagtgccaggacgggaaatgcattagttataaatgggtctgtgatggatccgctgagtgccaggacggatcagatgagtcccaagaaacatgtctcagtgtcacctgcaagtcgggggactttagctgcggcggaagagtgaatagatgcattccccagttctggagatgtgatggccaggttgactgtgacaatggcagcgacgagcagggctgtcccccaaagacctgttcacaggatgaattcagatgccacgatggcaagtgtatctctaggcaatttgtgtgcgactctgaccgtgactgtctggacggatccgatgaagcatcctgccccgtgcttacgtgtggcccggcgagcttccaatgcaattcctctacttgcatcccacagctgtgggcctgcgacaatgaccccgattgtgaggacggttcggatgagtggccacagagatgtcgcggactctatgtatttcaaggggatagtagcccctgttctgcattcgaattccactgtttgagcggcgaatgcatccatagctcctggcgatgcgacggggggcctgactgtaaagacaagtctgacgaagagaattgcgccgtggctacatgtcggccggacgagttccagtgctcagatggcaattgcatacatggaagccggcagtgtgatcgggagtacgactgcaaggatatgtcagacgaggtaggatgtgtgaatgtgacactctgcgaaggccccaacaagttcaaatgtcacagcggtgagtgtataaccctggataaggtgtgtaatatggcccgcgattgtcgcgattggagcgatgagcctatcaaggagtgtggtacaaacgaatgcttggacaataacggaggttgctcacatgtgtgtaatgacctgaaaataggcgccgagtgtctttgcccagacggtttccagttggttgctcaacgtcgatgcgaagacatcgacgagtgccaagacccggacacctgtagccagctgtgtgttaatctcgagggtggttacaaatgtcagtgcgaagagggctttcaacttgacccacacaccaaagcctgcaaggcagttggatcaatcgcatacctgttctttactaaccgacacgaggtgcgaaagatgacgctggaccgatccgagtataccagtctgattcctaacctcagaaatgtggtggcccttgacaccgaggtagcgtctaaccgtatctattggagcgatctgtcccagcgcatgatatgctccacacagttggatagagcccacggtgtctcaagttatgacacagtgatcagcagggacatacaagcaccggacggactggctgttgactggatccattccaacatctattggacagactctgtcctcggcactgtcagcgtggccgacacaaagggtgtaaaacggaagacgctcttccgggaaaacgggtccaaaccccgggcaatcgtggtcgacccggtgcacggctttatgtactggacagactggggaacaccggccaagattaagaaaggcggcttgaatggtgtggacatatactccctggtaacggagaacatccagtggccgaacggcataaccctcgacctgctctcaggcaggctctactgggtggactctaaactgcatagtatctcatcaattgatgtgaacggcgggaatagaaagaccatactggaagatgagaaacgactagcgcatcctttctcgcttgccgtgtttgaggacaaagtcttctggactgacattattaatgaggctatcttctccgctaaccggctcaccggatccgatgttaacctactggccgagaacttactgtcacccgaagacatggtactctttcacaacctgactcagcctcggggcgtgaattggtgcgaaaggactaccttgagtaacggaggttgccagtacttgtgtctccccgccccccagatcaatccccattcccctaaatttacatgtgcttgtcccgacgggatgttactcgcaagagatatgcgtagttgcttgacagaggccgaggctgcagtagcaacgcaggagactagcacggtcagattgaaggtctcgtctacggccgttaggacccagcacactaccacaagaccagtgccggatacaagcagattaccaggggctacccccggcctcactaccgtcgagatagtaacaatgtcacatcaggccttgggcgatgtagcaggcagaggcaatgaaaaaaagccatccagcgtgcgagcactctcaatcgtgctccctatcgttctcctcgtttttctgtgcttgggagtttttctgctttggaaaaattggcgactaaaaaacatcaactcgattaatttcgataaccctgtgtatcagaagacaactgaagacgaggtgcacatctgccacaaccaggacggctattcctacccctcgcggcagatggtaagtttagaggatgacgtcgct

SEQ ID NO: 574 - DNA, 2580 bp, Artificial Sequence
  Description of Artificial Sequence: Synthetic Transcript Sequence
atgggcccctggggatggaaattacgttggacagttgcgctgctgcttgccgccgcgggtaccgcggttggcgaccggtgtgaaaggaatgagttccagtgtcaagacggaaaatgtatcagctacaaatgggtctgcgatggatccgcggagtgccaggacggaagcgatgaatcccaggaaacctgtctaagcgtgacatgcaaaagtggagatttttcatgcggcggacgggtcaaccgctgcattccacagttttggcggtgcgatgggcaagtcgactgtgacaatggctctgatgagcagggttgccctccaaagacctgtagccaggacgaattccgctgccatgacggaaagtgtatctcaaggcagttcgtgtgcgatagtgacagggattgcctggatgggtcggacgaggcttcctgcccggtgcttacttgtggccccgctagctttcagtgcaatagtagcacgtgcattccacaactgtgggcatgtgataacgatccagactgcgaggatggatctgatgagtggccccagcggtgtcgcggactgtatgtgtttcagggtgactccagtccctgctccgccttcgaatttcactgtctgagtggagaatgtatccactcgagttggagatgtgatggggggcctgattgcaaagacaagagtgatgaggagaattgtgcagttgcaacttgccggcctgacgaatttcaatgcagtgacggaaactgcatccatggcagccggcagtgcgatcgggagtacgattgtaaagatatgtcagatgaagtggggtgcgttaacgtgaccctttgtgagggccctaacaagtttaagtgccatagtggggagtgcatcactctggataaagtctgtaatatggcaagagattgtcgtgattggtcagatgagccaatcaaagaatgtgggaccaacgaatgcctggacaataacggcggatgctcgcatgtctgtaatgacctgaagattggtgctgaatgtttgtgtccagatggcttccagctagtggcccaacggcggtgcgaggatatagacgagtgccaggacccagatacctgttctcagctgtgcgttaacctcgaggggggctacaagtgtcagtgcgaggagggatttcagcttgatccgcacactaaagcttgtaaagcggtcggatccatcgcatatttgtttttcacgaacaggcatgaagtccgcaagatgaccctggatagatccgagtatactagtcttatacctaatctgcgaaatgttgtagcgctcgacacggaagtggcctctaatcgcatctattggagcgatttgtctcaacgcatgatttgttccacccagttggatagggcacacggggtcagctcatatgacaccgtgatctcccgggacatccaggctccggacggattggctgttgactggattcacagtaacatttactggaccgactccgtcctagggacggtgagtgtggcggacactaaaggcgtgaaacggaaaaccctgttccgcgaaaatgggagcaaaccccgcgctatcgtggtagacccagtgcacggttttatgtactggactgactggggcacaccagccaagattaaaaaaggtggtctgaatggggtggatatttattccttagtgaccgaaaatattcagtggcccaatggaatcaccctggatcttctgagcggtaggctctactgggtggactcaaaactgcactcaatttcctccatagacgtgaatggtggtaaccgcaagactattcttgaggatgagaagagacttgcacaccctttttcccttgcagtttttgaggacaaggttttttggacagacataattaatgaggctatattttccgctaacagactcacagggagcgacgttaacctcttggcagagaatttgctgagtcctgaggatatggtgctctttcacaacttgacacaaccaagaggagtgaattggtgcgagaggactacgctcagcaacggaggctgtcagtacctttgcctaccagccccacaaattaatccccattcccctaagttcacctgcgcttgtccagatggaatgcttcttgcccgggacatgagatcttgcctcaccgaagccgaagcagccgtagctacccaggagacgtctactgtgagacttaaagtctctagtactgccgtgcgcacccagcacacgacgacacggcctgtcccagatacgtctaggttacctggtgctacacctggcctgacaacagtcgagattgttaccatgagccatcaagcccttggggatgtggcaggcaggggtaacgaaaagaagcctagtagcgtgagggcgctctccattgttcttccaatagttctgctggtgttcctgtgcctcggtgtattcctgctatggaaaaactggcgattgaagaatatcaactccatcaattttgataatcccgtgtaccagaagacaactgaagacgaagtccacatctgtcataatcaggacggctattcctatccctccagacagatggtgtctctggaagatgacgtggct

SEQ ID NO: 575 - DNA, 2580 bp, Artificial Sequence
  Description of Artificial Sequence: Synthetic Transcript Sequence
atggggccctggggatggaagttgcggtggaccgtggcattgctcctggcagccgcaggaaccgccgtgggagatagatgtgaacgcaacgaattccaatgtcaggacggcaagtgtatttcctacaagtgggtgtgtgatgggtcggcggagtgtcaggacggatccgatgagagccaagagacttgcctgtcggtcacctgtaaatccggagatttctcgtgtggtggtcgcgtgaataggtgtattcctcagttctggcggtgtgatggacaagtcgattgcgataatggatcggatgaacaaggatgccctccgaaaacctgcagccaggacgagtttagatgtcatgatggcaagtgtatctccagacagtttgtctgtgattcagatcgggattgtctggatgggtccgacgaagcgtcgtgccctgtgcttacttgtggccccgcttcctttcaatgcaactcctcgacctgcattccccaactgtgggcatgcgacaatgatcccgattgcgaggacggatcggatgagtggccgcaaagatgccgcggactttatgtgtttcaaggtgattcctcaccatgctcggcgtttgaatttcactgtctgtccggagaatgtattcatagcagctggcgctgtgatggaggaccagattgtaaagacaagtcggacgaggagaactgtgcggtcgctacgtgtagaccggatgaatttcaatgtagtgatggcaactgtatacatggttcccgtcaatgcgatcgagaatacgattgtaaggacatgtcagatgaggttggatgcgtgaacgtcactctctgcgagggtcctaacaagtttaagtgccattccggagagtgcattaccctcgataaggtgtgtaacatggccagggattgtcgggattggtccgatgagccaatcaaggagtgcggaacgaacgaatgtctggacaacaatggcggatgttcacacgtttgcaacgatctgaagattggcgcggaatgcctgtgcccagatggattccagctcgtggcacagagacgatgtgaagatatcgacgaatgtcaagatccagacacgtgttcccagctctgtgtgaaccttgagggtggttacaagtgccaatgcgaagaaggatttcagctcgacccacacactaaggcatgtaaagcggtcggttccatcgcatatctctttttcacgaaccgacatgaggtccgaaagatgacgctcgacaggtcggaatacaccagcttgataccaaaccttagaaatgttgtggctcttgacactgaagtggcctcgaaccgaatctactggagcgacctttcccagagaatgatttgctcaacccagctggatcgggctcatggtgtgtcctcctatgataccgtcatttcgcgggatattcaagcacctgatgggcttgcagtcgactggattcacagcaacatttactggactgactcagtgcttggaaccgtgagcgtggctgatactaaaggtgtcaagcggaaaaccctttttagagaaaacgggtcaaaacctagggcgatcgtggtggatcctgtgcatggttttatgtactggaccgattggggcacccctgccaagattaagaagggtggacttaatggcgtggacatatactcgcttgtgactgagaacattcagtggccaaacggcataactctggatttgctttcgggaagattgtactgggtggactcgaagttgcatagcatttcttcgattgacgtcaacggaggcaatcggaaaaccattctggaagatgagaagaggcttgcccatccgttttcactcgcagtctttgaagataaggtcttttggactgatatcattaacgaggccatcttctccgcaaacaggcttactgggtcagacgtgaatctcctggccgagaacctgttgtcgccagaagatatggtcctgtttcacaaccttactcagccaagaggtgtgaactggtgtgaacgcactaccctttccaacggcggctgccaatacctgtgccttcctgcaccgcagattaatccccattcaccaaagttcacctgcgcctgtccggatggaatgcttctggcacgagatatgcgctcgtgtttgaccgaagccgaagccgccgtggcgactcaggaaacttccactgtgcggttgaaggtgtcgagcactgcggtgcggacgcaacacactaccactcggcccgtgcctgacacttccagactcccgggggcaaccccaggtctgactaccgtcgagattgtcactatgtcgcaccaggcactgggcgacgtggccggacgcggcaacgaaaagaaaccttcatcggttcgtgccctgagcattgtgctgcctatcgtgcttcttgtctttctttgtctgggggtgttccttctgtggaagaattggcggctgaaaaacatcaactcgatcaattttgataacccggtctaccaaaagaccacggaagatgaggtgcatatatgtcacaatcaggatggttactcgtacccctcacggcaaatggtgtcgctggaagatgacgtggca

SEQ ID NO: 576 - DNA, 2580 bp, Artificial Sequence
  Description of Artificial Sequence: Synthetic Transcript Sequence
atgggaccgtggggctggaagttgcgctggacggtggcccttcttctcgccgccgcaggtactgccgtcggggaccgctgcgagcggaatgagttccaatgccaagacggaaagtgtatctcgtataagtgggtgtgcgacgggagcgctgaatgccaagatgggtcagacgagtcccaggaaacttgcctgagcgtgacttgcaagagcggagatttctcgtgtggtggtcgggtgaataggtgcatccctcagttctggagatgcgacgggcaggtggactgcgataatggaagcgacgagcaaggctgcccgcccaagacttgctcacaagacgagttcagatgccacgacggcaaatgcatatcacggcagttcgtgtgtgattcagacagagattgcctggacggatcagacgaagcatcctgcccggtgctgacttgcgggccggcttccttccagtgtaatagctcaacttgcatcccgcagctgtgggcgtgtgacaatgatcctgactgcgaagatggatccgacgaatggccgcaacggtgcagaggactctacgtgtttcagggagattcaagcccctgctcggcctttgagttccattgtctgtcaggtgaatgcatccactcttcgtggcgctgcgacggtggacccgactgcaaggacaaatccgatgaagaaaactgcgccgtggccacctgccgcccggacgagtttcagtgttcagacggcaactgcattcatggaagccgacagtgcgatcgcgaatacgattgcaaagatatgagcgatgaagtgggatgcgtcaacgtcaccctgtgtgaaggacccaataagttcaagtgccatagcggagagtgtatcactctggacaaggtctgcaacatggctagagactgtcgcgattggagcgatgaaccgattaaggaatgcggaactaacgaatgtctggataacaacggagggtgttcccatgtgtgcaacgatctgaaaatcggagctgaatgcctgtgtccagacggattccaactcgtggcgcagcgccggtgcgaggatatcgatgaatgccaggacccagacacctgttcacaactgtgcgtcaacctcgagggaggctacaaatgccagtgtgaagagggtttccagctggacccacataccaaggcgtgcaaagcggtcggctcgatcgcctacttgttctttacgaaccgacacgaagtcagaaagatgaccctggaccgctcagagtataccagccttatcccgaatctgagaaatgtggtcgcactggataccgaagtcgcctccaatcgcatatactggtcagaccttagccaacggatgatctgttcgacccagctggaccgggctcacggagtgagctcctacgacaccgttatctcgagggacatccaagcgccggatggattggcggtggactggatccactccaacatatactggaccgactcagtgctgggaaccgtgtccgtggccgatactaagggagttaagcgcaagaccctgttccgggaaaacgggagcaagccaagagcgatagtggtggacccggtccacggttttatgtactggactgattggggaactccagcaaagattaagaagggcggactcaacggcgtggacatttacagcctggtgactgagaatatccaatggccgaacggaatcactctggatctgctttcggggcggctctattgggtggattcaaagctgcactcgatctcttcaatcgatgtgaatgggggtaataggaaaactatcctcgaggacgaaaaacgcctcgcccatcctttctccttggcagtctttgaggacaaagtgttctggaccgacatcataaacgaagctatcttttcggcaaaccggctgaccggctccgacgtgaacttgctggcggagaacctcctttcgccagaggacatggtcctcttccacaatctgactcagccacgcggcgtcaattggtgcgagaggaccactctctccaacgggggctgccagtacctttgtctccccgctcctcagatcaacccacactcgcctaagttcacctgtgcgtgccctgatggaatgctgttggcgagagacatgcggtcctgcctgaccgaggcagaggctgccgtggcaacgcaagaaacctcaacggtgaggttgaaagtctcgtcgactgccgtgaggacccagcacaccactacccggcctgttcccgataccagccgactgccgggagccactcctggactgaccactgtcgaaattgtgaccatgtcccatcaggccttgggcgatgtcgccgggagaggaaatgagaagaagccgtcgtcggtgcgcgccctgtccatcgtcctgccgatcgtgcttctcgttttcctgtgcctgggcgtctttctcctctggaagaattggcgcctcaagaacattaactcgatcaacttcgacaaccctgtgtaccagaaaacgacggaggatgaagtgcacatctgccacaaccaggacgggtactcgtacccatcccgacagatggtgtccctcgaagatgacgtggct

SEQ ID NO: 577 - DNA, 2580 bp, Artificial Sequence
  Description of Artificial Sequence: Synthetic Transcript Sequence
atgggaccatgggggtggaaacttcgatggaccgtggcactcctgctggccgccgcggggaccgcggtgggagacaggtgcgagcgaaacgagtttcagtgccaggacggcaagtgtatctcctacaagtgggtctgcgacggctcggcagaatgtcaagacgggtcagatgagtcccaggaaacctgcctgtccgtgacttgcaagagcggagacttctcctgcggagggcgggtcaaccgctgcattccgcagttctggaggtgcgatggacaagtggactgtgacaacggatctgacgagcaggggtgcccgccgaaaacctgctcccaagatgaatttcgctgccatgacggtaagtgcatctccaggcaatttgtgtgtgactccgaccgggactgcctggacggatcggacgaagcctcctgcccagtgctgacttgtggcccggcgagcttccaatgcaattcgtcgacctgcatcccgcagttgtgggcttgcgacaacgacccagactgcgaggatggatccgacgaatggcctcagagatgcagaggactctacgtgtttcagggagacagctcgccgtgctcggcattcgagtttcactgcctgtcgggagagtgcatccactcgtcatggagatgcgacggcggacctgattgcaaggacaagtcggatgaggagaattgcgccgtggccacctgtcggccagatgaatttcagtgttcggacggaaattgcatccacggctcgcgccagtgcgaccgcgagtacgattgcaaagacatgagcgatgaagtgggatgtgttaacgtgaccctgtgcgagggtccgaacaagttcaagtgccattcaggggaatgtatcacgctggataaggtgtgtaacatggctagggactgtcgggattggagcgatgaacccatcaaggaatgcggaactaacgaatgccttgataacaacggcggctgtagccacgtctgcaacgatctgaagatcggagctgagtgcctctgcccggacggttttcagctggtggcacaacgccggtgcgaggacatcgatgaatgtcaggaccctgacacttgctcacagctgtgtgtgaacctggaaggcggttacaaatgccagtgtgaagaggggttccagctcgatccacacacgaaggcctgcaaggccgtgggctccattgcctacttgtttttcaccaatcgccacgaggttagaaagatgactctcgacagatccgagtacacttccttgatccctaatctccggaacgtggtggccctcgataccgaggtggcgagcaaccgtatctactggtccgacctctcacaacgcatgatctgctcaacccagctcgaccgggcgcatggagtgtcatcatacgacaccgtcatctcaagggacatccaagctccagatggactggcggtcgactggatccactcgaatatctactggaccgattcagtgcttggcacggtcagcgtggcggataccaagggggtgaagcggaaaactctcttcagagaaaacggaagtaaacctcgggccatcgtggtggacccggtgcatggatttatgtactggaccgactggggaacgccggccaaaatcaaaaaggggggcctgaacggagtcgatatctattcactggtgaccgagaatatccagtggcctaacggcataaccctcgatctgctgtcaggacgcctgtattgggttgattcaaagttgcactccatttcgtccatcgatgtgaacggaggtaataggaaaaccattctggaagatgaaaaaaggcttgctcacccgttttcattggccgtgtttgaggacaaggtgttctggactgacataatcaacgaagcaatcttttccgctaatcggctgaccggaagcgacgtcaatcttctggcggaaaacctgctgagcccggaggacatggtcctgttccacaaccttacccagccgcgcggagtcaactggtgcgaacggactactctgtccaatggaggatgccaatacctttgcttgccggcaccgcaaatcaacccccacagcccaaaattcacctgcgcgtgcccagacggaatgctgctggcaagagatatgcgctcctgtctgaccgaggctgaagccgcggtggcaactcaggagactagcaccgtgcggcttaaggtgtcctccaccgcagtgagaacccagcacaccaccactcgccctgtgccggatacctcgcggcttccaggagctactccaggcctcacgacggtggagatcgtgaccatgtcgcatcaagccctgggagacgtcgccggaagaggaaatgagaagaaaccgagctccgtgagagccctgagcatcgtgctgccgattgtcctcctggtctttctttgccttggcgtctttctcctctggaagaactggcggctgaagaacatcaactccatcaactttgataatccggtctaccaaaagactaccgaggacgaagtgcacatttgccacaaccaagacggttactcctacccgtcccggcaaatggtttcgctggaagatgatgttgca

SEQ ID NO: 578 - DNA, 2580 bp, Artificial Sequence
  Description of Artificial Sequence: Synthetic Transcript Sequence
atgggaccctgggggtggaagctgcgatggacggtggccttgctgcttgccgcagccggcactgccgttggcgacaggtgcgagagaaacgagttccagtgtcaggacggcaagtgcatttcctacaagtgggtgtgcgatggttccgctgagtgccaggatggctcggatgagagtcaggaaacttgtcttagtgtaacttgtaagtctggcgacttttcctgcggaggccgagtgaatcgctgcattccccagttttggcggtgcgatggccaggttgattgtgacaacggatccgacgagcagggctgtcccccaaagacctgctcacaggacgagttccgatgtcacgacggcaaatgtatatccaggcagtttgtgtgcgactcagaccgggattgtctggacggctccgacgaagcgtcctgccccgtgctgacctgcggccccgccagctttcagtgcaattcctccacctgtattccacagttatgggcctgcgataatgatccggactgcgaggatggttcggacgaatggcctcagaggtgcaggggactgtatgtgttccagggcgatagctctccctgtagtgcatttgagtttcactgcttaagcggggagtgtatccacagttcctggcgctgcgatgggggtcctgactgtaaagataaatctgatgaggagaattgcgccgtcgctacctgccgcccagacgagttccagtgcagtgatggaaattgtatccacgggtctaggcagtgcgaccgagagtacgactgcaaagatatgagcgatgaggtgggctgtgtgaacgtgacactgtgcgaaggacccaacaagtttaagtgccattccggagaatgcatcaccctggataaagtatgcaacatggctagggattgtcgcgactggtcggatgagcccattaaagaatgcggtacgaacgagtgtttagataacaacggaggctgtagtcacgtgtgtaacgacctgaagataggggccgaatgcctctgccctgacggtttccagctggtcgctcagaggaggtgtgaagatatcgacgaatgtcaggatcccgacacatgttcccagttatgcgtgaacctcgagggaggatataagtgtcagtgcgaagaggggtttcagttagatccccataccaaagcgtgcaaggctgtaggaagcattgcttatctgttctttaccaatagacatgaagtcaggaagatgacgcttgacagatctgaatatacctctctgatccccaacctcaggaacgtcgtggctctcgatacagaggttgcatctaacaggatctactggagcgacctgtcccagcgcatgatctgtagtacgcaactggaccgtgcgcatggagtgtccagctacgacactgtcatcagccgcgacatccaagcccccgatggattggcagttgactggatccattccaacatctactggactgattccgtgctgggcactgtgagcgttgcagataccaagggtgttaagcgtaagaccctgtttcgtgaaaacggtagcaagccgcgggccatcgtagtggaccctgtacacggctttatgtattggacagattggggaaccccagccaagataaaaaaaggtgggttgaacggtgttgacatttatagcctggttacggagaatatccagtggccaaacgggatcacccttgacctgctgtccggccgcctatactgggtggattccaagctccactcaatttcttccatcgacgttaacggaggcaaccgtaaaaccattctggaggacgagaaaagattagcccaccctttcagcctcgctgtgtttgaggataaggtgttctggaccgacattattaatgaagccatcttttcggccaatagactcacaggtagcgacgtgaaccttctggctgagaaccttctaagccctgaagatatggttcttttccataacctgacccagcctagaggtgtaaattggtgcgagaggactactctctctaatggtggctgtcagtatctatgcctacctgcaccacagatcaatccccattccccaaaatttacctgcgcatgcccggatggaatgctgcttgcacgcgacatgcggtcatgcctgacggaggctgaggccgccgtggccacacaggagacaagcaccgtgaggctgaaagtgagctcgactgcagtcaggacccaacacaccactacccgcccagtacctgatacctccagactgccaggtgctactccgggtcttacaaccgtcgagattgtgacaatgtcccatcaggccttgggtgacgttgcgggcaggggaaacgaaaagaagccttccagcgtgagagcgctgtccatcgtgctgcccatcgtactcctggtgtttctgtgtctaggagtgttcctcttatggaaaaactggcgattgaagaatataaatagtatcaattttgataacccggtgtaccaaaaaacaaccgaagacgaagtccatatttgccataaccaggacggctatagctatcctagtaggcagatggtcagcttggaggatgatgttgct

SEQ ID NO: 579 - DNA, 2580 bp, Artificial Sequence
  Description of Artificial Sequence: Synthetic Transcript Sequence
atggggccctggggttggaagctccgatggaccgtcgctctgctgctggcagccgctggcaccgccgtgggtgaccgctgtgaaaggaatgagttccagtgccaagatggaaagtgcatcagttacaagtgggtctgtgatggctcggccgagtgtcaagacggcagcgatgagagccaagagacttgcttatcagttacatgcaagtccggagacttcagttgcggcggcagagtcaatcggtgcattcctcagttctggaggtgtgacgggcaggtggactgcgataacggctctgatgagcaggggtgtccgccaaagacctgttcgcaggacgaattcaggtgtcacgatggtaaatgcatcagccgacagtttgtctgtgactctgacagggactgtctggatggcagcgacgaggccagttgtcccgtactgacctgtgggccagccagcttccagtgcaacagtagcacctgtatcccacagttgtgggcctgtgacaacgaccccgactgcgaagacgggagtgacgaatggcctcagcgctgtagaggcctttacgtatttcagggcgatagcagcccatgttcagcttttgagttccactgcttgtcaggcgagtgcatccactcctcatggagatgtgatggtggaccagactgcaaggataaatcggacgaggaaaattgtgctgtcgcaacctgcaggccggacgagttccagtgctccgacgggaactgtatacacggctctcggcagtgcgacagagagtatgattgcaaagatatgtccgatgaagtaggctgtgtaaatgtaaccttgtgcgaggggccaaacaagtttaagtgccactctggtgagtgcatcactctagacaaagtgtgtaatatggctagagactgcagggattggtctgatgaacccatcaaagagtgtgggacaaatgaatgcctggacaacaatggcggctgcagccatgtgtgcaatgacttgaagattggtgccgagtgtttatgcccggatgggtttcagctcgtggcccagcgtcgttgcgaagacatcgatgagtgtcaggatcccgacacatgtagccagctatgcgtaaacctggaagggggctacaagtgtcagtgcgaggaggggttccaacttgatccacacaccaaagcatgcaaggccgtgggatcaattgcctacttgtttttcaccaaccggcacgaggtgcggaagatgacactggatcggtctgaatatacctcactgatacctaatctaaggaacgtggtggcgctggacactgaagtggccagcaaccggatctactggtcagacctcagccagagaatgatatgtagcacccagctagacagggcacacggagtttcttcatatgacactgtaatttcccgggacattcaggccccagatggcctggcggtggactggatccacagtaacatatactggaccgatagtgtgctaggaaccgtttccgtggccgatactaaaggagtgaaaaggaagactttgttccgggaaaatggaagcaagccgcgagcgattgtggttgacccagttcacggcttcatgtattggaccgattggggcaccccggccaagatcaagaagggaggcttgaacggcgttgatatctacagtttggtgaccgagaatatacagtggcctaacggaatcacactggacctcctcagcggcagactgtattgggttgatagcaagctacattctatctcaagtatcgacgtcaacgggggcaaccggaaaacaatcttggaggacgagaagcggctcgcccaccctttttcactagccgtctttgaagacaaggtgttttggactgatatcattaacgaggccatattttccgcgaatcggctgactggcagtgatgtgaatctgctcgcggagaacctgctgagccctgaagacatggttctatttcataacctcacacaaccccgaggggtcaactggtgcgagaggacaacactgagcaacggcggatgtcagtacctgtgcctgccagctccccagatcaaccctcactcgccgaaattcacctgcgcttgcccagatgggatgctcctcgctagggatatgaggtcctgtctgactgaagcagaagccgctgttgccacacaagaaacctctactgtcagactgaaggtttccagcaccgccgtccggactcagcacactacaactcgtccagttccagacacgtcccgcttaccaggagcaaccccgggcctgaccacggttgaaattgtgactatgagccatcaggccttgggggatgtagctggacgcgggaatgaaaaaaaaccatcttccgtgcgggctttatctatcgtgctacctatcgtgctcctggtgtttctctgtctgggagtctttctcctctggaagaattggagattgaaaaatatcaattcaatcaattttgataaccctgtctaccagaagacaactgaggacgaagtccacatctgtcacaatcaggacggctactcctatcctagcagacagatggtcagcctagaggatgacgtcgcc

SEQ ID NO: 580 - DNA, 2580 bp, Artificial Sequence
  Description of Artificial Sequence: Synthetic Transcript Sequence
atgggaccatggggttggaaattgaggtggaccgttgccctactgcttgctgccgcgggaactgccgtgggagatcgctgtgaaaggaacgagttccagtgtcaggacgggaagtgcatctcctacaagtgggtgtgtgatgggagcgctgaatgtcaagacggctccgatgaaagccaggaaacgtgccttagtgtgacatgcaaatctggcgacttcagctgtggggggagagtgaatagatgtataccacagttttggaggtgcgacggccaggtggattgtgacaacgggtccgacgagcagggttgcccgcctaagacgtgttctcaggacgagtttcgttgtcatgacggaaaatgtattagccgtcaatttgtctgtgacagtgaccgggactgccttgatgggtccgatgaggcaagctgcccggttttgacttgtgggcccgcctctttccagtgcaactcgtccacatgtattcctcaactttgggcctgcgataatgacccggactgcgaagacggaagcgacgagtggcctcagcgatgtcgggggttatatgttttccagggcgatagctcaccttgtagcgccttcgagttccattgtctcagcggagaatgtattcactccagttggagatgtgacggagggcccgactgtaaggacaagagcgacgaggaaaactgcgctgtggcaacatgcagacccgatgagtttcagtgtagcgacggtaactgtatccacggttccagacagtgcgatcgcgaatatgactgcaaggacatgagtgatgaagtcgggtgcgtgaacgtgacgttgtgtgagggcccaaataagtttaaatgtcactccggagagtgtatcacacttgacaaagtatgcaatatggcacgggactgtagagattggtctgatgaacccatcaaggagtgtggaactaacgaatgcctggataataacgggggctgttctcacgtttgcaacgatctaaagattggcgcagaatgcctatgccctgacggattccaactggtggcacaacggcgctgtgaagatatagacgagtgccaggatccagacacctgcagccagctgtgcgtgaacctcgagggtgggtacaagtgtcaatgtgaagaggggttccagctggacccccatacaaaggcttgcaaagccgtcggctctatcgcctatctctttttcaccaacaggcacgaagtgagaaaaatgacgctggatcgctcagaatacacgtccctcattcctaacctgcgaaatgttgtggcactcgatacggaggttgcgtcaaataggatttattggtcagacctgtcccagaggatgatctgtagcactcagcttgatcgggcccacggagtaagttcttatgatacagtgatcagccgggacatccaagctccagatgggcttgccgttgactggatccattccaatatctactggacggattcagtgttgggaaccgtgtctgttgcagacacaaaaggtgtgaagaggaaaaccttgttcagggaaaacggctcgaagcctcgagccatcgttgtggaccccgtccatggttttatgtactggaccgattggggcacacctgccaagatcaagaaaggaggactcaacggagtagacatctattccctcgtgaccgaaaacattcagtggccgaatggcatcaccctggatctgctctccggccgcctgtactgggtggattccaaactgcattcaatttcttccattgacgtcaacggtgggaaccgaaaaactatcctcgaggacgagaaacggctggcccatcctttctccctagctgtgtttgaggacaaagtgttctggaccgacatcattaacgaagcaatattttctgccaatcgcctgaccggttccgacgtgaatcttttggcagaaaatctgctgagcccagaggacatggtgttgttccataacctcacacagcctaggggcgttaactggtgtgagcgcaccactctgtccaatggcggctgccaatatttatgtcttcctgccccacagatcaacccacactctccgaaattcacctgtgcttgtccagacggaatgctcctcgctagggatatgagatcctgtctgacagaggcagaggccgcggttgccacacaggagacatctaccgtacgtttgaaagtcagcagcacagcagtgcggacacagcacacaaccacccgacctgtgcccgacaccagtaggttacccggagctactccgggcctaaccactgttgagattgtaaccatgtctcatcaggccctcggcgatgtcgctgggagagggaatgagaaaaaaccaagcagtgttcgggccctatcaatcgtcctgccaatcgtgctgctggtttttctatgtcttggagtgttcctcttatggaagaactggcggcttaaaaatattaacagtatcaatttcgacaacccggtgtaccaaaagacaacagaagatgaggtgcacatttgtcataatcaagatggatactcgtacccaagcaggcagatggtatcgcttgaggatgatgtggcc

SEQ ID NO: 581 - DNA, 2580 bp, Artificial Sequence
  Description of Artificial Sequence: Synthetic Transcript Sequence
atggggccgtggggatggaaactcaggtggacggtcgcccttctgttggcggcagcgggaactgccgtgggtgacaggtgtgaacgcaatgagttccagtgccaagatggaaagtgcatctcttataagtgggtctgcgacggctcggcagagtgtcaagacggatcggacgagtcgcaagaaacgtgtctgtcagtcacctgtaagtccggagacttcagctgtggaggcagggtgaatcgctgtatcccccagttctggcgatgcgacggccaagtggactgcgacaacggaagcgacgaacagggctgcccacctaagacctgtagccaggatgagttccgctgtcacgatggaaaatgtatctcacggcagttcgtctgcgacagcgatcgggattgtctcgatggttcggacgaggcgtcctgccccgtcctgacctgcgggccggcatcgttccagtgcaactcaagcacctgcatccctcaactttgggcatgtgataatgacccggactgcgaagatggctcagatgagtggccgcaacgttgccggggcttgtacgtgttccagggagactcgagcccctgctcagcgttcgaatttcactgcctgtccggcgagtgcattcatagctcatggagatgcgacggcggacctgactgcaaggataaatcggacgaagaaaattgcgcagtggccacctgccgcccagatgaatttcagtgctccgacggcaattgcattcatggatcgcgccagtgcgatcgggagtacgactgtaaagacatgtcagacgaggtgggatgcgtgaacgtgaccctgtgcgaaggccctaataagttcaagtgccattcgggtgaatgcatcactctcgataaggtctgtaacatggcccgcgactgtcgcgattggagcgatgaaccgatcaaggaatgcggtactaacgaatgcctggacaataatgggggctgctcccacgtgtgcaacgacctgaagatcggagccgagtgcctttgcccggacggatttcaacttgtggcacagagaaggtgcgaggacatcgacgagtgccaagatccggacacttgttcccagctgtgtgtcaacctggagggcggttacaaatgtcaatgcgaggagggcttccaactggatccacataccaaggcgtgcaaagccgtcggaagcattgcgtaccttttctttacgaaccggcatgaagtgcgcaagatgactcttgatcggtccgagtacacctccctgatcccaaacctgcggaacgtcgtggccctggacactgaagtcgcaagcaatcgcatctactggtccgacctgtcgcaacggatgatatgctccacccaattggacagagcgcacggggtatccagctacgacaccgttatttcgcgcgatattcaggcaccggacggactggccgtggactggatccactcgaacatctactggactgactcagtcctcggtactgtgtcagtggccgatactaaaggagtcaagcgcaaaacgctctttcgtgagaatggaagcaagccgcgcgcgattgtggtggaccccgtccacggatttatgtactggaccgattggggaaccccggccaagataaagaaaggcgggctgaacggcgtggacatctacagcctggtgaccgagaatatccaatggcctaacggaattaccctggaccttctgtcgggaagattgtactgggtggactcaaagctgcactctatctcatcgatcgacgtgaacggaggtaaccgcaagaccatcctggaagatgaaaagcgactggcacacccgttcagcctcgcggtgttcgaagataaggtgttttggaccgacatcatcaacgaagcaattttcagtgcgaatcgcctgactggttctgacgtgaacctcttggcggaaaacctcctgtccccggaagatatggtgctgttccacaacctcactcagccgagaggagtgaactggtgtgagagaaccaccctgtcaaacggaggatgtcagtacctttgcctgccagcccctcagatcaacccccattccccaaagtttacgtgtgcttgtcctgatggaatgctgctcgcccgggatatgcggagctgcctgaccgaggccgaagcagccgtcgcgactcaggaaacgtcaactgtgcgcctgaaggtttcgtcgactgccgtgcggacccagcacactactacccgcccggtgccggatacctccaggctgccgggagctaccccaggcctgactaccgtggaaattgtcactatgtcccaccaagccctgggagacgtggcggggaggggcaatgagaaaaagccttcgtccgtgcgggccctgtcgatcgtgctgccaatcgtgctgctggtgttcctgtgcttgggagtctttctcctgtggaagaattggcggctgaagaacattaacagcatcaattttgacaacccggtgtaccagaaaactactgaggatgaggtgcatatctgccacaatcaagacggatactcgtacccctcccgccagatggtgtcgctggaggacgatgtggct

SEQ ID NO: 582 - DNA, 2580 bp, Artificial Sequence
  Description of Artificial Sequence: Synthetic Transcript Sequence
atgggaccgtggggatggaagttgcgttggactgtcgccctcctgttggctgccgccggtactgccgtcggtgaccgctgcgagcgaaacgagttccagtgccaggatggtaagtgcatcagctacaagtgggtttgtgatggaagcgcggagtgtcaggatggatctgatgagtctcaggagacctgcttgtccgtcacctgcaagtccggtgacttctcctgcggtggccgtgtgaaccggtgcatcccgcagttctggcgttgcgatggtcaggtggactgcgacaacggttccgacgagcagggatgcccgcccaagacgtgctcacaggacgagttccgctgccacgacggcaaatgtatcagccgtcagttcgtgtgcgactctgatcgcgattgtttggacggctctgacgaggcttcgtgcccggttctcacgtgcgggcctgcctccttccaatgcaacagctctacctgtattccccagttgtgggcctgcgacaatgaccccgattgcgaggacggtagtgacgagtggccccaacgctgtcgaggtctctatgtcttccagggcgattccagcccttgctccgccttcgagtttcattgtctcagcggtgagtgcattcacagctcctggcgttgtgacggtggtcccgactgcaaggataagtctgatgaggaaaactgcgccgtcgcgacatgcagaccagacgaatttcaatgctcggatggtaactgcatccacggttcccgccaatgtgaccgcgagtacgactgcaaggatatgagtgacgaggttggctgcgtgaacgttacactctgtgagggtcctaataaattcaagtgtcactccggcgaatgcatcaccttggacaaggtctgtaacatggcgagggattgcagggactggagcgatgagcccattaaggagtgcggcaccaacgagtgtctcgataacaacggtggctgctctcacgtctgcaacgacctcaagatcggtgcagagtgcctgtgcccggatggtttccagctcgtcgcccagcgccgatgcgaggatatcgatgagtgccaagatcccgatacttgctctcagctctgcgttaatctagaaggtggttacaagtgtcagtgcgaggaaggtttccagctggacccccacacgaaggcttgcaaagcggttggttcaatcgcttaccttttcttcaccaatcgccacgaggtaagaaagatgacattggatagatccgagtataccagcctcatcccgaatctgaggaacgtcgtggctcttgataccgaagttgctagtaaccggatttactggtctgacctcagtcagcggatgatctgcagcacccagctggacagagcccatggtgtcagcagctacgacactgtcatttctcgtgacatccaggcccctgatggacttgccgtcgattggatccactcgaatatctactggaccgattccgttctgggcaccgtcagtgtcgcggacacaaagggagttaagagaaagactcttttccgtgagaacgggtccaagccccgagccatcgtggtcgatccggtccacggctttatgtattggaccgattggggaacccctgctaagatcaagaagggcgggctgaacggcgtcgatatctattctctcgtcaccgagaacatccaatggcccaacggtatcactcttgacttactttcgggtcgtctctactgggttgattctaagctgcattctatctccagcattgacgttaacggtggtaatcggaagactatcctggaggatgagaaacgtctcgcccatcctttctccctggcagtgtttgaagacaaggtgttttggacggacatcatcaacgaagcaattttctcggctaatcgtctgaccggctctgacgtcaaccttctcgccgaaaatctcctgtcgcccgaggatatggtgttgttccacaacctcacccagcctcgaggagttaactggtgcgagagaacgacgttgtctaatggtgggtgccagtacctctgccttcctgcccctcagatcaacccgcactccccgaagttcacctgtgcttgtcctgatggtatgctgctcgcccgagatatgcgttcctgcttgacagaggccgaggctgcggtcgcgactcaggagacctccaccgtaagactgaaggtctccagtacagccgtccgcacccagcacaccactacccgtccggtccctgatacttcccgcctacctggggcaacgcctggactgacaaccgttgagatcgtcactatgtcccatcaggcccttggagacgtcgctggaagaggcaacgagaagaagccgtcctcagtgcgcgccctaagcatcgtgttgcctatcgtcttgctcgtgttcttgtgcctcggggtgtttcttctgtggaagaactggcgcctgaagaacattaactcaattaacttcgataatcccgtctatcaaaagaccaccgaggacgaggttcacatctgtcataaccaggatggttacagttatccgagtcgccagatggtctcgttggaagacgacgtcgcg

SEQ ID NO: 583 - DNA, 2580 bp, Artificial Sequence
  Description of Artificial Sequence: Synthetic Transcript Sequence
atgggtccctggggctggaagctgcggtggacggtagcactcctcctggccgcagcaggaaccgcagtgggcgaccggtgcgaacggaacgagtttcagtgtcaagatggaaaatgcatttcgtacaaatgggtctgcgacgggtcggcggagtgccaggacggatctgatgaatcacaggagacttgtctttccgtcacttgcaagtccggagatttctcgtgcggaggacgcgttaatagatgtatcccccaattttggcgttgcgatggacaggtggactgcgacaatggctcagatgaacaggggtgtcctccaaagacttgttcacaagatgaattccgctgccatgatggcaagtgcatctcaaggcagttcgtgtgcgattcggatagagactgcctggacggaagcgatgaggcttcgtgcccggtgctgacttgtggcccagcctcgttccagtgcaattcgtccacttgtatccctcaattgtgggcgtgcgataatgatccagactgcgaggacggctccgatgagtggccccaacgctgcagaggactctacgtgttccagggagactctagcccgtgctccgccttcgaatttcattgcctcagcggagaatgcattcattcgagctggcggtgcgacggaggccctgattgcaaggacaaatccgacgaggaaaactgcgctgtggccacttgccgcccggacgagtttcaatgctcagacgggaactgcatccatgggtcgcggcagtgcgatcgcgaatacgactgtaaggatatgtccgatgaagtgggatgcgtgaatgtcaccctgtgcgaaggaccgaacaaattcaagtgccactccggagagtgcataaccttggataaagtatgcaacatggctcgggactgcagggactggtccgacgaacccatcaaggaatgtggaactaacgaatgtctggacaataacggaggatgcagccacgtctgtaacgatctgaagatcggcgctgagtgcctgtgtccggatgggttccagcttgtagcccaaaggcggtgcgaggacatcgacgaatgccaagaccctgacacctgttcccagctttgcgtcaacctggaaggaggatacaagtgtcaatgcgaggaaggattccagctggacccacacaccaaggcatgtaaagccgtgggaagtatcgcgtacctgttcttcaccaaccggcacgaagttcggaagatgaccttggacaggagcgaatacacttccctgatcccaaacctgcgcaatgtggtggccctggatactgaggttgcctcgaataggatttactggtccgatctgtctcagcgcatgatctgtagcacccagttggaccgggctcatggcgtgtcatcctacgacactgtcatatctcgcgacatccaagcgccggacggactggcggtggattggatccactcgaatatctactggaccgactccgtgcttgggacggtttcagtggccgacaccaaaggtgtgaagcgcaagaccctctttagagaaaacggctcgaagccacgcgctatcgtcgtcgacccggttcatggcttcatgtactggacggactggggtactcccgcgaagatcaagaaggggggcctgaatggagtggatatctatagccttgtgactgaaaacatccaatggccgaacggaataacgctggacctgctgtcgggccgtctctactgggtcgactcaaagctgcacagcatctcgtcaattgatgtcaatggaggtaatcgcaaaaccatcctcgaggacgagaaacggctggcccacccattttccctggccgtgtttgaggataaggtgttttggaccgacattatcaacgaagcgatcttttccgccaatcgactcactgggtcggacgtgaaccttctggccgagaaccttctctcaccggaggacatggtgctgttccacaatctcacccagccgagaggtgtgaactggtgtgaacgtaccactctgtcgaacggcggatgccaatacctttgcctgccggctccacagatcaacccgcactctccgaaattcacctgtgcatgcccagacggaatgctgttggcccgcgatatgaggtcttgtctgacggaggccgaggccgctgtggcaacccaggaaacttccaccgtcagattgaaggtgagctcaacggcagtccgaacccagcacactactacccggcccgtcccggatactagccgcctgccgggagccactcccggactgactacggtggaaatcgtcaccatgtcacatcaggcccttggagacgtggcaggtcgcggaaacgagaagaagccctcatccgtgagagccctgtcgatcgtgctcccgatcgtgttgcttgtgttcctctgcctcggcgtgttcctgttgtggaagaactggcggctgaagaacatcaactcgattaactttgataaccctgtctaccagaaaaccactgaggacgaggtccacatctgtcacaatcaggacggttatagctacccgtcccgccaaatggtttccttggaagatgatgtggcg

SEQ ID NO: 584 - DNA, 2580 bp, Artificial Sequence
  Description of Artificial Sequence: Synthetic Transcript Sequence
atggggccgtgggggtggaaacttcgatggaccgttgcactgctgttggcggctgcggggactgcggtcggggatcggtgtgagagaaacgaattccaatgccaggacggaaagtgcatctcgtacaagtgggtctgcgacggatccgccgaatgccaggatggctccgatgagagtcaggaaacttgcctgtcggtgacttgcaagagcggggacttttcttgtggaggacgcgtgaaccgatgtatcccacaattctggcggtgcgatggtcaagttgactgcgacaatggatccgacgaacagggatgccctcctaagacgtgctcacaagatgaatttcggtgccacgatggcaagtgtatctcgcgccagttcgtgtgtgatagcgatcgggactgcctcgacggctccgacgaggcttcatgcccggtgctgacctgcggaccggcctcgttccagtgcaattcctccacgtgcatcccgcaattgtgggcgtgtgacaatgatcccgattgcgaggacgggtcagatgaatggccgcaacgctgccggggactgtacgtgttccagggggattcctcgccgtgtagcgcattcgagttccattgcctctcaggcgaatgcatccactcgagctggagatgcgacggtggaccggactgtaaggataagtcggacgaggaaaactgtgctgtggccacgtgccgccctgatgagttccagtgctcagacggcaattgcatccatggatccaggcaatgtgacagggagtacgattgcaaggacatgtcggacgaagtcggctgcgtgaacgtgactctttgcgagggacctaataagtttaagtgccactcgggagagtgcatcaccctcgacaaggtgtgcaatatggcgcgcgactgccgggactggtcagacgagccaatcaaggaatgtggcactaatgaatgcctcgacaacaatggaggatgttcgcacgtttgcaatgatctcaaaatcggcgctgaatgtttgtgcccagacggttttcagttggtggcgcagcgccgatgcgaagacatcgatgaatgccaagacccggatacttgctcacagctctgtgtgaatttggaaggaggctacaagtgccaatgcgaggaaggattccaactggatccgcataccaaagcctgcaaggccgtgggatcaatcgcatatctgttcttcaccaaccggcacgaagtgcgcaagatgaccctggaccgctccgaatacacctccctcatccctaacctccgcaatgtcgtggccctggacaccgaagtggcctccaaccggatctattggtccgatctgtcccagcggatgatctgtagcacccagttggatagggctcacggagtgtcgtcttacgacaccgtcatctcgcgcgatatccaggcgccggatggactggcggtggactggatccatagcaacatctactggaccgattcggtgctcggtactgtgtcagtggccgatactaagggagtaaagcgcaagaccttgtttcgcgaaaacggatccaaaccgcgggccatcgtcgtggaccctgtgcatggctttatgtactggactgattggggtacgccggccaaaatcaagaagggtggcctgaacggcgtggacatatactcgttggtgaccgaaaacatccagtggcctaacggcattactctggatctcctctcgggcaggctgtactgggtggattcgaaactgcactcgatctcatccatcgacgtgaacggaggaaacagaaagaccatccttgaagacgagaaacgcctcgcccacccgttttccctcgcagtgtttgaggataaagtcttttggaccgacatcatcaacgaagccatcttctccgcaaatcggctgactgggtcggacgtgaacctgctcgccgagaacctgctgtcgccggaagatatggtgctcttccacaacctcacccaaccgagaggcgtgaactggtgcgaacggaccactctctcgaatggcggatgccagtacctttgtctgccggcccctcagatcaatccccacagcccaaaattcacctgcgcctgcccggacggaatgcttcttgcgagagatatgcgcagctgcttgacggaagcggaggctgcggtcgccactcaagaaacttcgaccgtgcggttgaaggtgagctccactgccgtccgcacgcagcacaccactactcggccagtgcccgacacttctcgtttgccaggcgcgactcccggcctgactacggttgagatcgtgactatgtcccaccaagccctgggagacgtggcaggaagaggaaacgaaaagaaaccatcctccgtgcgggcgctctccatcgtcctgcctatcgtgctgctggtttttctgtgcctgggagtgttcctgctgtggaagaattggagactcaagaacatcaattcgatcaatttcgacaaccccgtgtaccaaaagactaccgaagacgaggtgcacatctgccacaaccaggatggctactcgtacccttccagacaaatggtttcactcgaggatgacgttgcg

SEQ ID NO: 585 - DNA, 2580 bp, Artificial Sequence
  Description of Artificial Sequence: Synthetic Transcript Sequence
atgggcccttgggggtggaagctccgatggactgtggcattactgctggctgccgctgggaccgctgtgggcgatcgatgtgagagaaatgaatttcagtgccaagacggcaagtgcattagttacaaatgggtatgcgacggttccgcagaatgtcaggatggctctgacgagagtcaagagacctgtctgtcagtgacttgtaagtctggagatttctcctgcggaggtagagttaacaggtgcattccgcagttctggcgatgtgacggccaggttgactgcgacaatggatccgacgagcagggctgtcccccaaagacctgtagccaggatgaatttcgctgccatgatggaaaatgtattagccgccagtttgtttgcgacagcgatcgtgattgtctggatggctccgatgaagcaagctgccctgtgttgacatgcggcccggcttccttccagtgcaactcctcaacctgtattccccagctatgggcgtgcgataatgatccagattgtgaggatgggtccgacgagtggcctcaacgctgccgagggctgtatgtcttccagggcgactcttccccctgttctgcttttgagtttcactgtctgtctggagagtgcatacatagctcttggcgttgtgacgggggcccggactgtaaggataagagcgatgaggagaattgtgctgttgctacctgtcgcccagacgagttccaatgcagcgacggaaactgcattcacgggtcgcgccagtgtgacagagaatacgactgcaaggacatgtcggatgaagtgggatgcgtgaatgtgaccctttgtgaaggccctaacaagttcaaatgtcactcgggcgaatgcattactttggacaaagtgtgcaatatggctagagactgccgggattggtccgacgaaccgattaaggagtgcggaaccaatgagtgcctcgacaataacggcggttgctcccacgtctgtaatgatcttaagataggagcagagtgtttatgccccgacggatttcagttggtggcacagcgtagatgcgaggacatcgacgagtgtcaggaccctgacacttgctctcaactgtgcgtcaacttagaaggtggttacaaatgccagtgtgaagaaggatttcagctcgatcctcataccaaggcttgtaaggccgtgggatccattgcttatctgttctttaccaacagacacgaagtgcgtaagatgacactggatcgctctgaatacactagcttgatccctaatctgcgcaacgtggtggctctcgacactgaggtggccagcaaccgcatctattggagtgacctgagccagagaatgatctgctcgactcagctcgatcgtgcccatggagttagctcttatgacacagtcatctcacgggatatacaagccccggacgggctcgcagttgattggatccactcaaacatctactggaccgattcagtgttgggaacagtgtccgtggccgataccaagggagttaaacggaaaaccctgtttagggagaatggctcgaagcccagggcgatagtcgtggaccccgttcacgggttcatgtactggaccgattggggcacacccgctaaaattaagaagggtggcctcaatggcgtggacatttacagtctggtgacagagaacatacagtggcccaacggaatcactctggacttactcagtggcaggctttactgggtcgattccaaattgcattccatatcaagcattgatgtgaacggaggcaaccgcaagaccatactagaagatgagaaacggctggcacaccctttttctctcgcagtgttcgaggacaaagtattctggaccgatataattaacgaggcaatcttttccgccaacagactgacgggatcggatgttaacttgttggcggaaaacctgctgtccccggaggatatggtgctatttcacaacctgacacagcctcgcggcgtcaattggtgcgaacggacaaccctttcaaatggtggatgccagtatctctgcctgcccgctccacaaatcaacccccactcaccgaaatttacttgcgcatgcccagacggaatgttactggccagggacatgagaagctgtctgacagaggctgaggctgctgtcgcgacacaggagacctccaccgttcgcctcaaggtaagctctacagcggtgcgcactcagcatacaacaactcgaccagtgcccgatacctcgcgattgcccggcgctacccctggcttaacaactgtagagatcgtgacaatgtcccaccaggctttgggcgatgtcgctgggcggggcaacgagaaaaaaccttcttctgtccgagctctctcaattgtattgcctattgtgctgctggtgttcttgtgtctcggggtcttcctgctgtggaaaaactggaggctgaaaaacataaactccattaatttcgataatcccgtctaccagaaaacaaccgaggatgaagtgcatatctgccacaatcaagacggctactcttacccctccaggcagatggtttctctggaggacgacgttgct

SEQ ID NO: 586 - DNA, 2580 bp, Artificial Sequence
  Description of Artificial Sequence: Synthetic Transcript Sequence
atggggccctggggatggaagctgaggtggactgtcgctctgcttcttgcggcagccgggacagcggtcggcgatcggtgtgagcgcaacgagttccagtgccaggatgggaagtgtattagctataagtgggtgtgtgacgggtccgccgagtgccaggacggcagcgatgaatcacaagagacgtgcctaagtgttacctgcaagagcggcgactttagctgtgggggtcgcgtgaaccggtgcataccacagttctggcggtgcgacggccaagttgattgtgacaatggcagtgatgaacagggatgccctccaaaaacatgtagccaggacgagtttcgatgccacgacggcaagtgcatttcgcgccagtttgtttgcgactcagaccgcgactgtctggatggcagtgacgaagccagctgccccgttctgacttgcggccccgcatcctttcaatgtaattccagtacttgtatccctcagctgtgggcgtgcgacaacgacccggattgcgaggatggaagcgatgaatggccccagcggtgtaggggcctctacgttttccagggagactcaagcccgtgtagtgcattcgagtttcactgccttagtggagaatgcatccacagtagttggagatgtgacgggggtcccgactgtaaggacaagtcagatgaagaaaattgtgctgtcgccacgtgccggccagacgagtttcagtgcagtgatgggaattgcatccacggaagcaggcaatgcgatagggaatatgattgtaaagatatgtctgacgaggtgggttgtgtaaatgtgactctttgcgaaggcccaaataagtttaaatgtcattcaggcgaatgtatcaccctggacaaggtctgtaacatggctcgcgactgtcgcgactggagcgacgagccaattaaggagtgtggtaccaatgaatgcctcgataataatggtgggtgttcccacgtctgcaatgatctgaagattggagcggagtgcctgtgcccagacggttttcagctggtggcccagcggagatgtgaagacatagatgagtgccaggatccagatacctgttcacaactctgtgtgaatctggagggggggtataagtgtcagtgcgaggaaggcttccagctggatccacacacaaaggcctgtaaggccgtgggctcgatagcctacctcttcttcaccaaccgtcatgaagtgagaaaaatgaccttggatcggagtgagtacacatcactcattccaaacctccgaaacgtggtggccctggatacggaggttgcttccaaccgcatttattggagcgacctaagccagcggatgatatgttcgacgcaactggatagagctcatggcgtaagctcttacgacacagtgatttccagggatatacaagcgccggacggattggccgtggactggatccactcaaatatctattggacagacagcgtgctgggcacagtgagcgttgcagacaccaaaggagtgaagagaaaaacattattccgcgagaacgggtcaaagcccagggcaattgtagtggatcctgttcatggattcatgtactggaccgactggggaacacctgcaaagataaagaagggtggtcttaacggagtggacatctactccttggtcacggagaacatccaatggcccaacggcattaccttggacctgctttctggacgcctgtattgggttgactcaaagctgcacagtatctcttcgattgacgtgaatgggggcaatcggaagacgattctggaagacgagaaacgtttggcacaccctttctcattagcggtgttcgaagacaaagttttctggacagacattatcaatgaggccatttttagcgcaaaccgacttactggctctgatgtaaacttgctggccgaaaacctccttagtcctgaagatatggtactgttccataatctgacccagccgagaggggtcaactggtgcgaacgcacaacattgtccaatggcggatgtcagtacctctgcctgccggccccccagattaatcctcactctccaaagttcacctgcgcttgccctgatggaatgcttctagctagggatatgcgatcctgtctcaccgaagccgaagctgctgtggccactcaagaaacgagcactgtccgtctgaaggtgagctctacagcagtgcgtacacagcacaccacaacccgccctgtgcccgacacgtcccggctaccgggagcaacaccagggttgaccactgtggaaattgtgaccatgtcccaccaggctctcggcgatgtggctgggcggggaaatgaaaagaagccctcttctgtacgggcgctgtccattgttctgcccattgtcctcctcgtgtttctgtgcctcggcgtgtttctgctctggaagaattggaggctaaagaacataaacagtattaattttgacaaccctgtctaccagaagaccaccgaggatgaggtccacatctgccataatcaggacggatattcataccccagccgacagatggtgtctctggaggacgacgtggct

SEQ ID NO: 587 - DNA, 2580 bp, Artificial Sequence
  Description of Artificial Sequence: Synthetic Transcript Sequence
atggggccgtggggttggaaactccggtggaccgtcgccctgctgctggccgcggcaggaactgccgtgggagacaggtgcgaacggaacgagttccaatgccaggacggaaagtgtatttcctacaagtgggtgtgcgacggatccgcagaatgccaagatggtagcgacgaaagccaggaaacgtgcctctccgttacctgcaagtcgggagatttctcatgtggagggcgagtgaatcggtgtatcccccaattttggagatgcgatggacaggtcgactgcgacaacggctccgatgagcaaggatgccctcccaaaacgtgctcgcaagatgagttccggtgccatgatggaaaatgcattagccgccagtttgtgtgcgacagcgaccgggactgcctggacggctcggacgaagcctcatgtcccgtgttgacctgtggcccggcgtccttccagtgcaactcgtcaacctgcatcccgcaactgtgggcctgcgacaacgacccggattgcgaggatgggagcgacgagtggccccagcgctgccgcggactctacgtgttccagggagacagctcgccgtgttcggccttcgaattccactgcctgtcgggcgaatgcatccacagctcctggaggtgcgatgggggaccagactgcaaggataaatccgacgaagagaactgcgccgtggccacctgtagaccagatgagttccaatgttcagacggtaactgcatccacggctcacgccaatgtgaccgcgaatacgattgcaaagacatgtcggatgaggtgggatgcgtcaatgtgactctgtgcgagggccctaacaaattcaaatgccattccggtgaatgcatcaccctggacaaggtgtgcaatatggcacgggactgtagggactggagcgacgaaccaatcaaggaatgcggaactaacgaatgtctcgataacaacggaggatgcagccacgtgtgtaacgatctgaagatcggcgcggagtgcttgtgtcctgatggattccaactggtggcccagagacgctgcgaggacattgacgaatgtcaggatccagatacctgctcccagctgtgcgtaaatctcgaggggggatataagtgccagtgcgaggaaggcttccagctcgatccgcatacgaaagcatgcaaggccgtgggaagcattgcctatctgttcttcaccaaccggcacgaagtgcgcaagatgaccctcgacaggagcgagtacacctccctgatcccgaacctgcggaacgtggtggcactcgatactgaagtcgccagcaaccgcatctactggagcgacctgtcccaacggatgatctgttccacccagctggatagagctcatggcgtctcgagctacgacactgtgatctcgcgcgacatacaggcccctgatggtttggccgttgattggatccactccaacatttactggaccgactcggtgctgggtaccgtgtcggttgccgatactaagggggtgaagcgcaagaccttgttcagagaaaacggaagtaaaccgcgcgccattgtggtggatccggtccacgggttcatgtactggactgactggggcacccccgcgaagatcaaaaaaggaggactgaatggagtggatatctacagcctcgtgactgagaatatccaatggcctaatggaatcaccctggatctcctctcaggacgcttgtactgggtggatagcaagctccactcgatctcgtcgatcgatgtcaatggaggaaaccgaaaaacgatccttgaagatgagaagagattggcgcatccattctctttggctgtgttcgaggacaaagtcttttggactgacatcatcaacgaagctatcttttcggcgaacagactcactgggtctgacgtgaatcttctggcggaaaacctcctctcaccagaggatatggtgctcttccacaatctgacccagcctcggggtgtgaattggtgtgaaaggacgactctgagcaacggtggatgtcagtacctctgtctccctgccccgcagatcaatccgcactcccccaaattcacttgcgcgtgccctgacggcatgctgctggcccgcgacatgcgctcctgcctcactgaagccgaagcagcggtcgcgacccaggagacttccaccgtgcgactcaaagtctcaagcaccgccgtgcgcactcaacacaccactactcggccggttcctgacacctcccgcctgccgggcgctaccccgggactgaccactgtggaaatcgtgacgatgtcccaccaggcgctgggagacgtggctggacgtggaaacgagaagaagccatcttccgtgagagcactgagcatcgtgctccccatcgtgctcctggtctttctgtgcctcggagtgtttctgctctggaagaactggagactgaagaacatcaacagcattaacttcgacaacccagtgtatcaaaagaccactgaagatgaagtccacatctgccacaatcaggatggatactcgtacccgtcacgccagatggtgtcactcgaggacgatgtggcc

SEQ ID NO: 588 - DNA, 2580 bp, Artificial Sequence
  Description of Artificial Sequence: Synthetic Transcript Sequence
atggggccgtggggctggaagcttcggtggacagtggcactgcttctggctgccgcaggaactgccgtgggcgatcgctgcgaacggaacgagttccagtgccaggacggaaagtgtatcagctataagtgggtgtgtgatggtagcgccgaatgtcaagatggatccgatgagagccaggaaacatgcctctcagtcacttgcaagagtggagacttttcttgcggaggtcgggtgaaccgctgcatcccacagttctggcgatgtgacggtcaggtcgattgtgacaatggatctgatgagcagggatgtcctcctaagacctgttctcaggatgagttccggtgccacgacggtaagtgcatctcacggcagtttgtgtgtgactctgaccgagattgtcttgacggatcagatgaggcaagctgtcccgtcttgacttgcggccccgctagcttccagtgcaattcatcaacatgtataccccagctgtgggcctgtgacaacgaccctgattgtgaagacgggtccgacgaatggcctcaaaggtgccgggggttatacgtgttccagggcgactccagcccttgctccgcttttgagttccactgtctgtctggcgagtgcatccactcgtcctggaggtgcgacggaggcccagactgcaaagataaatcagatgaggaaaattgcgccgtggccacctgtagaccggatgagttccaatgttcagatggcaattgtattcatggcagcaggcagtgcgacagggaatacgactgcaaagacatgagcgacgaagtgggctgcgtgaatgtgacgctgtgcgaaggccctaacaagtttaaatgccattccggggagtgtattactcttgataaggtttgcaacatggcccgggattgtcgagactggagcgatgagcccatcaaagagtgtggcaccaatgagtgtctggacaataacgggggatgctctcatgtgtgcaatgacctgaaaatcggggctgaatgcttgtgcccagatgggttccaactcgtcgcgcagaggaggtgtgaagatatagacgagtgccaggaccctgatacttgctcccaactatgcgttaacctggaagggggctacaaatgccagtgtgaggaaggtttccaactcgatccccataccaaggcctgtaaagctgtcggcagcatcgcttatttgttctttaccaacagacacgaagtgcgtaagatgaccttggatcgctccgaatacactagcttaattccaaacctccgcaacgtggtggccctggataccgaggttgcttctaaccgcatttactggtctgatttatcccagagaatgatctgctcaacacagcttgacagggcccacggggtctcaagctacgacactgttatctcacgcgacattcaagctcccgatggcttggccgtggactggatacactcaaacatctattggactgactcagtactggggacggtctccgtggcagatacgaagggagtgaaacgcaagaccttattccgggagaatggcagcaagcctcgtgccatcgtggtggaccccgtacacgggtttatgtactggactgactggggtacacccgctaagatcaagaaaggcgggctgaatggggtcgatatctactctcttgtcactgagaacatccagtggcccaatgggatcacgcttgaccttctgtcagggaggctgtactgggtagattccaaactgcatagcatcagttccattgacgtgaacggcggtaatcgaaagaccattttagaggacgaaaagaggctcgcccaccccttttctctggctgtctttgaggacaaggtgttctggacagatatcatcaacgaagctatcttctctgctaacaggctgacaggcagtgatgtgaatctgcttgctgagaacctgcttagcccggaggatatggtgctgtttcacaacctcacgcaacctcgaggcgtgaactggtgcgaaaggacaacgctgtcgaacgggggctgccagtacttatgtctgcccgcccctcaaatcaaccctcattcccccaagtttacctgcgcctgtcccgacggtatgttgttggcacgcgacatgcgctcatgccttactgaggcagaggccgccgtggccacccaggagactagcacagttcgactgaaggtgtcatctacagcggttaggacccagcacacgaccacgagacccgttcctgacacctcaagattacccggtgccacacctggcctcaccaccgtagaaatcgtcacaatgagtcaccaggcccttggcgatgtcgccgggcgcgggaacgagaaaaaaccatccagtgtgagggctctgtccattgtgctgccaatagtccttctagtgttcctttgcctcggggtgttcctcctgtggaagaactggaggctcaaaaatattaactctatcaattttgacaatccagtgtaccagaagacaactgaggacgaggtgcacatctgtcacaatcaggatgggtactcatacccttctagacagatggtctcactcgaagacgacgtggct

SEQ ID NO: 589 - DNA, 2580 bp, Artificial Sequence
  Description of Artificial Sequence: Synthetic Transcript Sequence
atgggcccatggggctggaaactgcgctggactgtagctcttctgctggcagccgcagggactgcagtaggagatcgttgtgaacgcaatgagtttcagtgccaggatgggaagtgcatctcttataaatgggtgtgcgacggctctgccgagtgccaggacggatcagacgaatctcaagaaacatgcttgagcgttacttgtaaaagcggcgatttcagctgcggagggagggttaacaggtgtattccacagttctggagatgtgatggacaggtggattgcgataacgggtccgacgagcaggggtgccctcccaaaacctgcagccaggatgaattcagatgccacgacggcaaatgtattagtcggcagttcgtttgtgattctgatcgggattgtctcgacgggtcagacgaggcgtcgtgtcctgtgctgacctgcggtccggcctcgtttcagtgcaatagcagcacctgtattccccagctgtgggcctgcgataacgacccagactgcgaggatgggtctgatgagtggccccagcgctgccgaggcctttacgtctttcagggggattccagcccttgctctgcttttgagttccactgtctaagcggggagtgtatccacagcagttggcgttgcgatggcggccccgattgtaaagacaagagcgacgaagaaaactgtgcggtggctacctgccgccccgacgagtttcagtgctcagacggcaactgtatccatgggtccagacagtgcgatcgagagtacgactgcaaagatatgtcagacgaggttggatgtgtcaacgtgacgctgtgtgaaggcccaaacaagttcaagtgtcacagcggcgaatgcatcacactggataaggtctgcaatatggcaagggactgtcgagactggagcgatgaacccataaaggagtgcgggacgaacgaatgtttagacaataacggaggatgctcacacgtgtgtaatgacctgaaaatcggcgcagagtgcctgtgccccgacggatttcagctggtcgcacaaaggcgttgtgaagacatagacgaatgccaggatcccgatacttgctcacagctgtgcgtaaatctcgagggcggatacaaatgccagtgcgaggaagggtttcagctggatccacataccaaggcttgtaaagctgtcgggtctatcgcttacctgtttttcactaaccggcacgaggttaggaagatgactcttgataggagcgagtataccagtttaattccgaatctaagaaatgtggtagcattggacaccgaggtagcatctaatcgcatatattggtctgacttgagtcagagaatgatctgtagtacccagctagatagagcacacggtgtgtcctcatacgataccgtgatctctagagatattcaagcccctgacggattagccgtggactggattcacagcaacatctattggaccgacagtgtgctaggtacggtgagcgtggcagatactaagggtgtgaaacgaaagacactctttcgagagaacgggtcaaagccccgggctatcgtggtggatcctgtacacggcttcatgtattggactgattgggggacaccggcgaagatcaagaagggaggactcaacggggttgacatctactcactcgttaccgagaatattcagtggccgaatgggatcacactggatctgctgagtgggagactgtattgggtcgattccaagctgcacagcataagctccatcgacgtgaatggcggtaatcgtaaaacaattctggaggatgagaaacgcctggcacaccctttttcactagccgtgttcgaagataaagtgttctggaccgacatcatcaatgaggccattttttcagctaatagattaaccggttccgacgttaatcttcttgctgagaacctgttgtctcctgaggatatggtactctttcacaacttgacacagccgaggggtgtaaactggtgtgagcgaactaccctgtcaaatggcgggtgccagtacctgtgtttaccggcacctcagatcaacccacactctccaaaattcacatgtgcctgcccagatggcatgctcttggcacgagacatgaggtcgtgcttgacggaggccgaagctgctgtggccactcaggagacgtcaaccgtgaggctgaaagtgtcaagtactgccgtgagaactcaacacactacaacgcgccctgttccagatacgagcagactacctggagccactccaggcctcacaactgttgagatagtgactatgtctcatcaagcccttggggatgtggccggccgaggaaacgaaaaaaagccatcctccgtgcgggccctatcaattgtcctccctattgtacttctagtgtttctgtgtctcggggtctttcttctctggaaaaattggaggcttaagaacatcaattctattaactttgacaatcctgtttaccagaaaacaacagaggacgaggtgcacatatgccataatcaagacgggtacagctacccgagccgtcagatggtgtcattggaggatgatgtcgcc

SEQ ID NO: 590 - DNA, 2580 bp, Artificial Sequence
  Description of Artificial Sequence: Synthetic Transcript Sequence
atggggccatggggatggaaactgcgttggacggttgccttgctcctcgcggcagcaggtactgcggtcggtgacaggtgcgaacggaatgagttccaatgtcaggatggtaagtgcatctcttacaaatgggtgtgcgacgggtccgccgagtgccaagacggatcggacgagtcccaggaaacctgcttgtcggtgacctgcaagtccggagacttctcatgtgggggaagggtgaaccgctgcatccctcaattctggagatgcgatggtcaagtggactgtgataatggatctgatgaacaggggtgcccaccaaagacttgcagccaggacgagttccggtgccacgacgggaagtgcatttcccggcagttcgtgtgcgatagcgaccgggactgcctggacggatccgacgaagctagctgcccggtgctgacctgtggtccagcctccttccaatgtaattcgtccacttgcatcccgcagctgtgggcatgcgataacgatccggattgtgaagatggcagcgacgaatggccgcagaggtgtagaggcctttacgtgttccagggagactcgtccccctgtagcgccttcgaattccattgcctgagcggggagtgcattcattcgtcgtggcgctgcgacggcggaccggactgcaaggacaaaagcgacgaagagaactgcgcggtggcgacttgccgaccagatgaattccaatgcagtgacggcaattgtatccacgggagccgccagtgcgaccgcgagtacgactgtaaggacatgtccgacgaggtaggttgcgtcaatgtgaccttgtgcgagggcccgaacaaattcaagtgtcattcgggcgagtgtatcaccttggacaaggtttgcaacatggcccgcgattgccgggattggagcgatgagccgatcaaggagtgtggaaccaatgagtgcctcgacaataatggcgggtgttcacacgtgtgcaacgatttgaagatcggagccgaatgtctgtgccctgatggcttccagctggtagcccaaagacggtgcgaagatattgatgaatgtcaagatcccgacacctgctcccagctctgcgtgaacctcgaaggtggttataagtgtcagtgcgaagagggtttccagctggatcctcacacgaaggcatgcaaggccgtcggaagtatcgcttatctgttcttcaccaacagacacgaagtccgaaagatgacgctggaccgctcagaatacacctcactcatccccaacctgcgcaacgtggttgctctggacaccgaagtggcaagcaaccggatttactggtccgacctctcccagaggatgatctgctcaactcaattggaccgggcacacggagtgtcctcatacgacaccgtgatctcccgggacatccaagcgccggacggactcgccgtggactggatccattccaatatctactggactgattcggtcttgggaacggtttcggtcgcagatacgaaaggtgtgaagcgtaagactctgtttagggagaacgggtcgaagccaagagctatcgtggtcgacccggtgcatggattcatgtactggacggattggggaactccagccaagataaagaaagggggactgaatggagtcgatatctactcgctggtcactgagaacattcagtggccgaacggaatcaccctcgacctcctgtccggtagactgtactgggtggactcaaagctccacagtatctcctctatcgacgtgaatggcggcaaccggaaaactattctcgaggacgaaaagcgcctggcacaccccttctcgctggccgtctttgaggacaaagtgttttggaccgacatcatcaatgaagccatcttctcagccaatcgcctgaccggaagcgacgttaaccttcttgctgaaaatctgctgagcccggaagatatggtgctctttcataacctcacgcagccgagaggcgtaaactggtgcgaaaggactaccctcagcaacggtggatgccaatacctttgcttgcctgcaccgcagatcaatccgcattcacccaagtttacgtgtgcctgccctgacggcatgctgctggctcgagatatgagatcgtgcctgaccgaggctgaagcagctgtggcgactcaggagacgagcacggtccgccttaaagtcagtagcaccgccgtgcgcactcagcacaccactactcggcctgttcctgacaccagccgcctgcctggagccaccccaggactcactaccgtggagatcgtgacgatgtcgcaccaagccctgggcgacgtggcgggaagagggaatgagaagaaaccatcatcggtgcgtgcgctctccatcgtgctcccgatcgtgctccttgtttttctgtgcctgggagtgttcctgctgtggaagaactggcgacttaagaacatcaactcgattaactttgataacccggtgtaccagaaaactaccgaagatgaagtccacatttgccacaaccaggacggatactcgtacccatctcgccaaatggtgtccctggaggatgatgtggcg

SEQ ID NO: 591 - DNA, 2580 bp, Artificial Sequence
  Description of Artificial Sequence: Synthetic Transcript Sequence
atgggcccctggggatggaagctgcgttggactgttgccctgctattagcggccgcagggacggcggtaggtgaccgctgtgagcggaatgaattccaatgtcaagatgggaaatgcattagttacaaatgggtgtgtgatgggagcgccgagtgtcaggatggctctgacgagtcccaagagacctgcttgtcagtcacttgcaagagtggagacttcagttgcggaggacgggtgaatcgttgcatcccccagttctggcgatgtgatggacaggtagactgcgacaatggatcggatgaacagggttgccctcccaagacatgctctcaagatgagtttagatgtcacgacggaaagtgtatctccaggcagtttgtctgtgactctgatcgcgattgcctagacgggtctgacgaggcttcctgccccgtcctgacatgcggacctgcctctttccaatgtaatagcagcacatgcattccacagctttgggcatgtgataatgatccggactgtgaggacggaagtgacgaatggccacagagatgccgcggcctgtatgtattccagggcgactcatcgccctgtagcgccttcgaattccattgcttgtccggtgagtgtatccacagcagctggcggtgtgacggtgggcccgattgcaaggataaaagcgacgaggagaactgcgccgtggctacgtgtagaccggatgagtttcagtgttctgacggcaattgcatccacgggtccaggcaatgcgacagagagtacgattgcaaggatatgagcgatgaagtgggctgtgtgaacgtgacactctgcgaagggcccaataagttcaaatgtcacagcggtgaatgtattactctggataaagtgtgcaatatggcacgggattgtcgtgactggagcgacgaacccattaaggaatgcgggaccaacgaatgtttagacaataacggggggtgttctcacgtctgcaacgatctgaaaatcggggctgagtgcctttgccctgatgggttccagttggttgctcagagacgctgcgaggatattgacgaatgtcaggatcccgacacctgtagtcaactctgcgtgaacctcgagggaggatacaaatgccaatgcgaagaggggtttcagctagaccctcataccaaagcctgcaaggcagtgggtagcattgcttatctattttttacaaaccggcacgaggtgaggaaaatgacccttgacaggagtgagtatacctctctgatacccaatttacgtaatgtggtggccttggacacagaagtggcttccaataggatctactggtcagacctgtcacaacgaatgatctgcagtacccagcttgacagagcacatggcgtgtctagttacgacacggttatttcccgtgacatccaggcacccgatgggctggctgtagattggatccattccaatatatactggactgattcagttttggggactgtgtccgtggccgacaccaaaggagttaaaaggaagacactgttccgggagaacggttccaagccgagggctattgtggtggaccccgtgcatggctttatgtactggacagactgggggacacctgcaaagataaagaagggagggttaaacggcgtggatatttatagccttgtgactgagaacattcagtggcccaacgggatcactctggatttgcttagtggacggctctattgggttgatagcaaactgcatagcatctcctcaatcgatgtgaacggggggaaccgcaagaccatcctagaggacgaaaaacgtttagcacatcccttttccctggctgtcttcgaggataaggtcttctggaccgacattattaatgaggctatattcagcgcgaacaggctgactggttctgatgtgaatctgcttgctgagaatctgttatcacctgaagacatggttctcttccacaatctgacacagcctcgcggtgttaattggtgtgaacgcaccaccctgagtaatggcggttgtcaatatctgtgtttgcccgctcctcagataaacccccattcaccaaagtttacatgtgcctgtcccgatggaatgctcctcgcgcgagacatgagatcctgcctgactgaggccgaagccgctgtggctacacaggagacatcgaccgtacgactgaaggtgtctagcacagccgtgagaacacagcacaccacaactcgacccgtccctgatacatcccgtctgccaggcgcaacccccgggctgacaactgtggagatcgtgacaatgtctcatcaggccctgggtgacgtagcagggaggggtaatgagaaaaagcctagcagcgtgcgtgccctcagtatcgtactccccatagtgttgcttgtgttcctgtgcctcggcgtgtttcttctgtggaagaactggaggctgaagaacatcaacagtattaattttgacaaccccgtttaccagaagacaaccgaggacgaagttcatatctgccacaaccaggatggctactcctacccctctcgccagatggtgtcccttgaggatgacgtggct

SEQ ID NO: 592 - DNA, 2580 bp, Artificial Sequence
  Description of Artificial Sequence: Synthetic Transcript Sequence
atgggcccctgggggtggaagctgagatggacagttgcacttttactggcagcggcgggtacggccgtcggggaccggtgcgagcgcaacgagttccagtgtcaggatggaaaatgtatctcatataagtgggtgtgtgatggctccgctgagtgccaggatgggagtgatgagtcccaagagacctgcttaagtgtaacttgcaagtctggagatttcagttgtggcggaagggtcaaccggtgcatccctcagttttggagatgcgatggacaggtagattgtgataacggctctgatgaacagggctgtcccccaaagacctgtagtcaggacgagtttaggtgccatgacggaaagtgcatcagccgacaatttgtatgcgattctgaccgcgactgtctcgatggaagcgacgaggcatcgtgtccagtgctgacttgcggccctgcctcgttccagtgcaatagttccacctgcatccctcagctatgggcatgtgataatgatccagattgtgaggacgggagcgacgaatggccccaacgatgtcgtggactctacgtattccaaggcgactcttcgccttgctcagcattcgaattccattgtctgtcaggagagtgtatccatagttcttggcggtgtgacggtggccccgattgcaaagataaaagtgatgaggagaactgcgcagtggctacctgcaggccagatgaattccagtgttcggacgggaattgcatccatgggtcccgccagtgcgatagggagtacgactgcaaggatatgtccgacgaggtcggatgcgttaacgtgacattgtgcgaggggcctaacaaattcaagtgccacagcggggaatgtataaccctggataaggtgtgcaatatggcccgcgattgtagggattggagtgatgagccaattaaagagtgcggaacaaacgagtgtctcgataataacgggggctgctcacatgtttgcaacgatctgaaaattggcgcggagtgtctctgtcccgatgggttccagctggtggctcagagaaggtgtgaagatatagatgagtgtcaagatcctgacacctgttctcagctgtgcgtcaaccttgagggagggtataaatgccagtgtgaggaaggcttccagctggatccccatacgaaagcctgcaaagcggtgggctcgatcgcctatctctttttcaccaatcgacatgaggttcggaagatgacgttggataggtccgagtacaccagtctgatccccaatctgcggaacgttgtcgcattggacaccgaggtggcatcgaacagaatctattggagcgacctgtcccagcgcatgatctgctctacccagcttgacagggctcacggggtgagctcttatgatactgtgatcagtagagacattcaggccccggatggcctggccgtggattggattcacagcaacatctattggacagatagcgttctcggaactgtttctgtcgcggacaccaagggcgtgaagagaaagactttattccgcgagaacggctctaaaccccgggctatcgttgtagaccctgttcacgggtttatgtattggactgattggggaacaccggccaagatcaagaaagggggattgaacggggtggacatctattcgctggtgaccgagaacatccagtggcccaatgggattacattggatctcctgagcggacggctgtactgggtggacagcaagttgcattccattagcagtatcgatgtgaacggaggaaatagaaagactattttggaggatgagaagaggctcgcccatcccttctcactagccgtattcgaggacaaggtattctggaccgatataatcaatgaggccattttctccgcgaaccggctcacagggtctgatgtgaatctgctagcagaaaatctgctctcccctgaagacatggtgctgtttcacaacctaacccagccacggggagtgaattggtgtgagcggaccaccctgtccaatgggggctgccagtacttgtgtctgccagcccctcaaatcaacccacacagccctaaatttacgtgcgcttgccctgatggcatgctcctagcgcgggatatgaggtcgtgcctgaccgaggccgaagctgcagtcgccacacaggagacttcgactgtgcgtctgaaggtgagttctaccgcagtgagaactcaacacaccactacccggccggtgcctgacacttcccgactgcctggagcaaccccaggacttaccacagtggagatagtaaccatgtctcaccaggcattgggagatgtggcaggcagaggaaacgaaaagaagccatctagtgtcagagcgctcagcatagtgctgccaatcgtccttctcgtgtttctgtgtctgggcgtcttcctgctgtggaagaattggcggttgaaaaatatcaactccatcaattttgacaaccctgtgtatcaaaaaactactgaagacgaggtccacatctgccataaccaggacggatattcctaccccagccgtcagatggtgtctctggaagacgacgtggca

SEQ ID NO: 593 - DNA, 2580 bp, Artificial Sequence; identical to SEQ ID NO: 545
  Description of Artificial Sequence: Synthetic Transcript Sequence

SEQ ID NO: 594 - DNA, 2580 bp, Artificial Sequence
  Description of Artificial Sequence: Synthetic Transcript Sequence
atgggcccctggggttggaagctgcgatggaccgttgcacttctactggctgcagctggaactgccgtgggagataggtgtgagcgcaatgaattccaatgccaagatgggaagtgtatcagttacaaatgggtttgcgacggatccgcagagtgtcaagacgggtccgatgaaagccaagagacttgtttgtctgtgacctgcaaatcaggagatttctcttgtggtgggcgagtgaaccggtgtatcccccagttttggagatgcgatggccaagtggattgtgataacggcagcgatgaacaggggtgccctccaaagacctgctcacaggatgagtttcgctgccatgatgggaagtgcatctctagacagttcgtctgtgatagcgacagggactgcttggatggcagtgacgaggctagttgcccagtcctgacgtgcggccccgccagtttccaatgcaacagttcgacatgcattcctcagctgtgggcctgcgacaatgacccagactgcgaggacggaagcgacgagtggccacagaggtgtcggggattatacgtgtttcagggagatagttcgccctgctcggccttcgagtttcattgcctcagcggggaatgcattcacagtagttggaggtgcgatggagggccggattgcaaggataaatccgatgaggagaattgcgccgtggctacctgtcgacctgacgagtttcagtgttccgatggcaattgcatacacggatctcggcaatgcgaccgagagtatgattgtaaagatatgtccgatgaagtcggatgtgttaatgtgacactgtgtgaggggcctaacaagtttaaatgccatagtggcgagtgtatcacactcgacaaagtgtgcaacatggctcgggactgtagggactggtcagacgaaccaatcaaggagtgtgggacaaacgaatgtttggacaacaacggcgggtgctcccatgtgtgtaacgatttgaagattggcgccgagtgtttgtgtccagatgggttccagttggtggcccagaggcgatgtgaggatattgacgagtgtcaggatccagatacgtgttcccaactttgtgtgaatttggagggcggttacaagtgccagtgtgaagagggatttcagctggatccgcataccaaggcttgcaaggccgtcgggagcatcgcttatctgttctttactaaccgccacgaggtccgaaagatgactctggatcgcagcgaatatacatcactaattcccaacctgaggaatgtcgtggcccttgataccgaggtggcttccaaccgtatttactggagtgacctatcccagcggatgatctgttcaacacagctggatcgtgcacatggagtaagctcgtatgatactgtgatctcccgtgatattcaggcaccagacggtctggccgtcgactggatccatagcaatatctattggactgactctgtgttgggtacagttagtgtcgctgacactaagggagtcaagaggaagacactatttagggagaacggcagcaaacctagagccattgtagtcgacccggtccacgggttcatgtattggactgactgggggactcccgcaaagattaaaaaggggggactgaacggcgtggacatctacagtctggtgaccgagaatattcagtggcctaacggcattacccttgatttgctaagcggccgactgtactgggtcgactcaaagctccactcaatcagctcaattgatgtcaatggggggaataggaagacaatcttggaagacgagaaaaggctcgcccacccattctcactggcagtgtttgaggacaaagttttttggacggacatcatcaacgaggcaatcttctccgccaatagactgacaggctcagacgtgaacctgctagcagaaaacttactgtccccagaagacatggtgcttttccataatctgacccagcctcgaggtgtaaattggtgcgaaaggacaaccttgtctaacggggggtgccaatacctgtgtctcccagctcctcagatcaacccacactcccccaagtttacatgcgcttgtcccgacggaatgctcctagcgagagatatgagatcatgccttactgaagctgaagcagcggtggctacccaagaaacaagcaccgtgagactcaaagtctctagcactgccgtgcggacgcagcacacaaccacccggcccgtccctgatacgtcacggctgccaggcgcaacccctggacttaccaccgtcgagatcgtaacaatgtcccaccaggccctcggcgacgtggctggcagaggcaatgagaagaagcctagcagcgtgagggcgctgagcattgtgctcccaatcgttttgctggttttcctgtgtctgggggtatttctcctttggaaaaattggaggctgaagaatattaattctatcaacttcgataatcccgtttaccaaaagaccactgaggacgaggtgcacatatgccataatcaggacgggtattcgtacccttcaaggcaaatggtgtctttagaggatgacgtcgca

SEQ ID NO: 595 - DNA, 2580 bp, Artificial Sequence
  Description of Artificial Sequence: Synthetic Transcript Sequence
atgggtccctggggatggaagctccgctggaccgtggccctcctcctggcagccgcaggaaccgccgtgggcgatcggtgtgaaagaaacgaatttcaatgtcaagacggaaaatgtattagctacaagtgggtgtgcgatggatcggcagaatgtcaggatggctcggacgaatcgcaggaaacctgtctctccgtaacctgtaagagcggggatttttcatgcgggggcagagtgaacagatgcattcctcagttttggaggtgcgacgggcaagtggattgtgataatggttccgatgagcaaggctgtccacctaagacgtgttcccaggatgaatttcgctgccatgatggcaaatgcatttctcgtcaattcgtgtgtgattccgatagagactgcctggacggtagcgacgaagcatcgtgtcctgtgctcacctgcgggccagcatcattccaatgtaacagctccacttgtattccgcaactttgggcatgtgataatgatcctgactgtgaagatggttcagatgagtggccccagcgttgtaggggtctgtacgtgttccagggggatagctcaccatgttcggctttcgaattccattgcttgtcgggagagtgtatccattcctcgtggcggtgtgatgggggacccgactgtaaggataaatcggatgaagaaaactgcgcagtcgcaacctgccgcccagatgaatttcagtgttcagatggaaattgcattcatggttcgagacagtgtgacagagaatatgattgtaaggacatgtcagatgaggtcggttgtgtgaatgtcactctttgcgaaggtccaaataagtttaagtgtcatagcggggagtgcataacccttgacaaggtgtgcaatatggcaagggactgtagagactggtccgatgaacctattaaggagtgtgggaccaacgaatgtctcgacaacaacggaggctgttcacatgtctgtaacgatctgaaaataggtgctgaatgtctgtgcccagatgggtttcaacttgtggcgcaaagaagatgcgaggacatcgatgaatgtcaagaccctgatacctgcagtcagctgtgtgtcaacctcgaagggggatacaagtgccaatgtgaggaaggattccagctggatccccacactaaagcatgtaaggccgtgggctccatagcatatctgtttttcaccaaccggcatgaggtgaggaagatgactcttgaccggtctgaatacacttcgctcattccgaacctccgcaatgttgtcgccctggacaccgaggtggcgagcaaccggatttactggtccgacctcagccaacgcatgatatgctccacccaattggaccgggcacatggagtttcctcgtacgacaccgtgatttcgcgagatatccaagcaccagatggcctggccgtggactggattcattcaaacatttactggaccgatagcgtccttggcaccgtcagcgtggccgatacgaagggtgtcaaacgaaagactctctttagagaaaatggttcgaaaccacgcgccatagtcgtggatcctgtccacgggtttatgtactggactgactgggggactcctgcaaaaatcaagaagggaggtctgaacggagtggacatctactccttggtcaccgagaatattcagtggcccaatggaattacgcttgaccttctttccggtaggctttactgggtcgactctaaacttcacagcattagcagcattgatgtgaatggtggcaacagaaagactatcctggaagatgaaaagagactggcccatcccttttcgctcgcagtgttcgaggacaaagtgttttggacggatatcatcaacgaagctatcttctcggccaacagacttactggatccgatgtcaatcttctcgccgaaaacctgcttagccctgaagatatggtgctttttcataaccttacccagccacggggagtgaactggtgtgagcgcacgaccttgtctaatggcggatgccagtatctttgtctgcctgcaccccagattaacccgcactcgccaaagtttacttgtgcgtgccctgacggaatgcttctggcaagggatatgcggagctgtctgacggaggcagaggcagcagtggcaacccaagaaacctcaaccgtgcgcctcaaagtctcatccaccgccgtgcggacgcagcacactaccacgcggccagtaccagatacttcgcgcctgcctggagccacccctggactcaccactgtggagatagtgacgatgtcgcatcaagctctgggtgacgtggccggaagaggaaatgagaaaaagcctagctccgtgagagctctttcgatcgtacttccaattgtcctgctggtgtttctctgcctgggtgtgttcctgctgtggaagaactggcggcttaagaatatcaactcgatcaactttgataatcctgtatatcaaaagaccactgaagatgaggtgcatatatgccacaatcaggacgggtactcatacccttcacgtcaaatggtgtcacttgaagatgacgtcgcg

SEQ ID NO: 596 - DNA, 2580 bp, Artificial Sequence
  Description of Artificial Sequence: Synthetic Transcript Sequence
atgggtccttggggatggaaattgcgatggactgttgcattactactcgcagcagccggaacagctgtcggagacagatgtgagcgtaatgaatttcagtgccaggatggaaaatgtatctcgtacaaatgggtctgtgacggaagtgctgaatgtcaagatggaagtgatgagagtcaggaaacttgtctttctgtcacttgcaagtcgggagattttagttgcggaggtagagttaatagatgtattccacaattctggagatgtgatgggcaggtagactgcgataacggaagcgatgagcagggatgtccaccaaaaacatgttctcaggatgagttcaggtgtcacgacggaaagtgcatctctcggcagtttgtatgcgattcagacagggactgccttgatggctcagatgaagcatcgtgtcctgttcttacatgcggtcctgcctctttccagtgcaatagttctacgtgtattccacagttgtgggcttgcgacaacgacccggattgtgaagatggaagtgatgaatggccgcaaagatgtagaggactttacgtgttccaaggcgatagttcaccatgttccgcttttgaattccattgtttaagcggcgagtgtatacattcctcttggagatgtgatggtggccccgattgtaaagataaaagtgatgaagaaaattgcgcagttgctacgtgtagaccagatgaatttcagtgcagcgatggaaattgtattcatggatctcgacaatgcgacagagagtatgattgtaaggatatgtctgatgaggttggatgtgttaatgtcacgctctgtgagggtcctaacaagtttaaatgtcattcaggagaatgtattactttggacaaagtgtgtaatatggctcgtgactgccgagactggtcggacgagccgattaaagagtgtgggacaaatgaatgtcttgataataacggcggttgctcacatgtgtgtaacgacctaaaaattggagctgagtgtttgtgcccggatggattccaactcgtcgcacagagacggtgtgaagacatcgatgaatgccaggacccagatacatgctcacaattatgcgtgaacctcgaaggaggatataagtgtcaatgtgaagaaggtttccaattggatcctcatacaaaagcttgcaaggccgttggatccattgcatacctcttcttcactaaccgacacgaggtgcgtaagatgacattagatagaagcgaatatacttcactcatccccaacttgcgtaacgttgttgcacttgatacggaagttgccagtaaccgcatttactggtctgacttgtcacaacgtatgatttgctcaacccaactcgatcgagcacacggagtctctagttacgatacagtgatctctcgagatatccaagcgccagatggattggcagtcgactggatccacagtaatatctattggacggattcagtgttgggtacagttagcgtggctgataccaaaggcgttaaacgtaagaccctttttagagaaaatggaagtaaaccaagagctattgttgttgacccggttcatggattcatgtattggactgattggggaacaccagctaaaatcaaaaaaggagggttgaacggagtggatatatactctcttgttactgaaaatattcagtggccgaacggaattactctcgatttgctgagtggaagactttactgggttgatagcaaactccatagtattagcagtattgatgtaaatggaggtaatcgtaagacaattctggaagacgagaagagactcgctcacccattctccttggcggttttcgaagataaggtattttggacagacataattaatgaagcaatctttagcgcaaatagacttacgggctcagatgtaaatttgttggcggaaaatctcctatctccggaagatatggttttgtttcacaatttgactcaaccaagaggagttaactggtgtgaacggactacactatccaacggaggatgccaatatctgtgtcttccggctccacagattaacccgcacagtccaaaattcacgtgcgcgtgccctgatggaatgttgctcgcacgagacatgagatcctgtttgacagaggcagaggctgccgtggctacccaagaaacatcaacagtcaggctcaaagtttcctctacagcagttagaacacaacatactaccacaagacccgtgcctgatacatctagattaccaggagccacccctggacttacaacggtagagattgtgactatgagccatcaagctttaggagacgtcgctggacgtgggaacgaaaaaaaaccaagttcagttcgtgctttgtcaattgtgctgccaattgtgttgcttgttttcctctgcttgggagttttcctgctttggaaaaactggcgtttaaaaaatattaacagtattaatttcgataatccagtgtatcaaaagacaacagaagacgaagtccacatctgtcacaaccaagacggctattcctacccatctaggcaaatggtgtcgttggaggatgacgtagct

SEQ ID NO: 597 - DNA, 2580 bp, Artificial Sequence
  Description of Artificial Sequence: Synthetic Transcript Sequence
atgggcccgtgggggtggaagctccggtggacggtagcgctgctgttggctgcagccggaactgccgtgggagatcgctgcgagaggaacgaattccaatgccaagacggcaagtgcatctcctacaagtgggtgtgcgacggatcagcagagtgccaggatggctccgacgaatcccaggagacttgcctcagcgtcacctgtaaaagtggagacttctcgtgcgggggtagagtgaaccggtgtatcccgcaattttggagatgcgacggacaagtggactgtgacaacggatccgacgagcagggatgccccccaaagacttgctcgcaggatgagttccgctgccacgacggaaagtgtatatcccgccaattcgtgtgcgatagcgaccgggattgcctggatggttcggacgaggcttcctgcccggtgctgacttgcgggccggcgtccttccagtgcaattcgtccacgtgcatcccacaactttgggcatgtgataacgacccggactgcgaagatggatccgatgagtggccgcagcgctgtcggggcttgtacgtgttccagggcgactcttccccgtgctcggcatttgaattccactgccttagcggagagtgcatccacagctcgtggaggtgcgatgggggtccggactgtaaggataaatcagacgaagagaattgcgccgtagctacctgtcgcccggatgagttccagtgctccgatgggaactgtatccatggatcccgccagtgtgacagggaatacgattgcaaagacatgtcagacgaggtgggctgcgtgaacgtgactctgtgcgagggcccgaacaagttcaagtgccacagcggagaatgtatcaccctggataaagtctgcaacatggccagagactgtcgggattggagcgacgagccaatcaaagaatgcggtactaatgagtgcctggacaataatggaggatgctcgcacgtgtgtaatgacttgaaaattggcgccgagtgcctgtgcccggacggattccagctggtcgcccagcggcgctgcgaggatatcgacgagtgtcaagaccccgacacttgttcccaactttgcgtcaacctcgagggaggatacaagtgtcagtgcgaagaagggtttcaattggacccacataccaaagcgtgtaaggccgtgggctccatcgcctacctgttcttcactaataggcatgaagtgcgtaagatgacgctggaccgctcggagtatacctctctgatcccaaacctgaggaatgttgtggccctcgataccgaggttgcgtccaaccggatctattggagcgacttgagccaacgcatgatttgttcgactcagctcgaccgggcacacggtgtctcttcttacgacaccgtcatctcccgggatattcaggcccccgacggactggctgtcgactggatccattcgaacatctactggaccgatagtgtgctcggcactgtgtctgtggcagacaccaagggtgtgaaaagaaagaccctctttcgcgagaacggcagcaaaccaagggccattgtggtggatcctgtgcacggatttatgtattggaccgattggggaacccctgctaagatcaagaagggaggactgaatggcgttgacatctactctctcgtgactgagaatatccagtggcctaacgggatcacccttgacctgctctcaggcagactgtactgggtggatagcaaactgcattcgatctcctcaattgatgtgaacggaggaaaccgtaagaccattctggaggacgagaaaaggttggcgcacccatttagcctggcagtgttcgaggacaaggtgttctggactgacatcatcaatgaagcaatcttctcagccaacagactgactggatcggatgtcaacctgctcgcggaaaatctgctgtcgccagaagatatggtcttgttccacaacctgacccagccaagaggagtgaactggtgtgagcgcaccacgctgtcaaacggcggctgccaatacctgtgccttccggctccgcagatcaacccgcatagcccgaaattcacttgtgcgtgcccagacggcatgctgctggcgagagatatgcgcagctgcctgactgaagccgaagcagctgtggccacccaagagacttcgactgtgcggctgaaggtgtcgtcaaccgcagtgcggacccaacacaccactactagaccagtgccagacacttcgcggttgcctggagccacccctggacttaccaccgtcgagattgtgaccatgtcgcaccaagctctgggtgacgtggcgggacgcggaaatgaaaagaaaccctcaagcgtgcgcgcgctctccatcgtgctcccgatagtcctgctggttttcctttgcctcggcgtctttctgctgtggaagaattggcggctcaaaaacatcaattcaatcaacttcgacaacccggtctaccaaaagaccacggaggacgaagtgcacatctgccacaatcaggatggttactcgtacccgtcgaggcagatggtgtccctggaggatgatgtggca

SEQ ID NO: 598 - DNA, 2580 bp, Artificial Sequence
  Description of Artificial Sequence: Synthetic Transcript Sequence
atgggtccgtggggctggaaactcagatggactgtcgctctactgctggcagcagcggggaccgccgtcggtgatcgatgcgagcgtaacgaatttcagtgtcaagatgggaaatgcatttcctacaagtgggtctgtgatgggtcggctgaatgccaggatgggtcggacgagtctcaagagacgtgcttgtcagtaacgtgtaagtctggggatttctcttgcggggggcgagttaatcgatgtatcccgcaattttggcgctgcgatgggcaggttgactgcgacaacggcagtgatgaacaaggctgcccccctaagacgtgttctcaagacgaatttcgatgccacgatggcaaatgtatttcgcggcaattcgtatgtgattcggaccgggattgtctcgatggaagtgacgaagcctcatgcccagtgctcacctgcggacctgcatcatttcaatgcaactcgagtacttgtattcctcaactttgggcctgcgacaatgatccagattgtgaagacggctctgatgaatggccccagagatgtagaggtctctacgtctttcaaggcgattcgtcaccatgttcggcctttgagtttcattgtcttagcggtgagtgtatacatagctcctggcggtgcgacggcgggccggactgcaaagataagagcgacgaggaaaactgcgctgttgcgacctgtcggccagacgagtttcagtgctctgacgggaactgtatccacggatctcgacaatgcgatagagaatatgattgcaaggacatgagtgatgaagtcggatgcgtgaatgttacactctgcgagggtccgaacaagttcaagtgccactccggagagtgcattacgcttgacaaggtgtgtaacatggctcgcgactgccgtgattggtctgatgagccgataaaggaatgtggcaccaatgagtgcctagacaacaatggtggttgtagccatgtgtgcaacgacttgaaaatcggggccgagtgcttgtgtcctgacgggttccagctggttgcccagcgcaggtgcgaggatatagatgagtgccaagatccggacacgtgcagccagctgtgtgttaatttggagggcggttataagtgccaatgcgaagaaggttttcagcttgacccacatactaaggcctgcaaggcggttggcagcatcgcctatctcttctttacaaatagacacgaggtgagaaaaatgactctggacagaagtgaatatacatcgctgatccccaacttgcggaatgtcgtagccctcgatacagaagtcgcttcaaatcgcatctactggtccgacttgtcccagaggatgatttgctcgacacaacttgacagggcccacggggtctcttcgtacgacaccgtcatcagtcgtgatattcaggcgccagatggactcgccgttgactggattcattcaaacatctattggaccgactcggtcctgggtacagtctccgttgcagacacaaaaggcgtaaagcgcaagactttgtttcgtgaaaacggctcgaaacctcgagcaattgtagtggatcctgttcacggttttatgtattggacggactgggggacgccagccaagatcaagaagggcggactcaacggtgttgatatctacagccttgtcaccgagaacattcagtggccgaatggcatcacgcttgatttacttagcggtcggctttactgggtcgattccaagttgcattcgatttctagcatcgacgtcaacggaggtaaccggaaaaccattttggaggacgagaagcgcctagcccatcccttcagcctggctgttttcgaagacaaagttttctggactgatataatcaatgaggccatcttctccgccaaccgactcacgggctccgacgttaatctgttagctgaaaacctcctctcgccagaagatatggttctgtttcacaacctgactcaacctcgtggtgtcaactggtgcgagagaaccacgcttagtaacggaggttgtcaatatctgtgtctccccgcccctcagatcaacccgcattctccaaaatttacctgtgcgtgccctgacggtatgcttctagcccgggacatgcggagttgtctcaccgaggcggaagcggcagtcgctacgcaggagacatctacagtgcgactaaaagtctcctcaactgcagttcgcactcaacatactactactcgaccagtccctgacacttctcgtcttcctggtgccacacccgggttgactaccgttgagatcgttaccatgagtcaccaagcacttggggacgttgcaggacgcgggaatgagaaaaaaccgagtagtgtccgcgcactctcaattgtcctcccaatcgtgcttttagtcttcctctgtctgggagtcttccttctgtggaagaactggagattgaaaaatatcaactcgattaatttcgataacccggtctaccaaaagacaaccgaagacgaagtgcatatctgtcacaaccaggacggttattcctacccaagccgacagatggtctctctcgaagatgacgtcgcc

SEQ ID NO: 599 - DNA, 2580 bp, Artificial Sequence
  Description of Artificial Sequence: Synthetic Transcript Sequence
atggggccatggggctggaagctgagatggacagtcgctctattgctggctgcagcaggaacagctgtgggggataggtgcgagaggaatgaatttcaatgccaagatggcaaatgtatatcgtataagtgggtatgtgacggctcggctgagtgtcaggatgggtcagatgaatcgcaggaaacctgtctgtccgtcacatgtaagtcgggggactttagctgcggtgggcgagtcaaccggtgtatcccccagttttggcggtgtgacgggcaggtcgattgtgacaacggttctgacgaacaagggtgtcctcccaagacctgcagtcaggacgagtttaggtgccatgacggcaagtgtatcagccggcaattcgtgtgtgattctgatcgcgactgcctggatggctccgacgaagcctcatgccccgtactaacgtgtggtccagcaagctttcagtgtaactccagcacctgcattcctcagctctgggcgtgtgataacgaccccgattgtgaggatggaagcgatgagtggccacagaggtgccggggactctacgtgttccagggagattcatcgccctgtagcgccttcgagttccactgtctgtcaggagaatgtatccactctagttggcgctgcgatgggggccctgactgtaaagacaaatcagacgaagaaaattgcgcagtcgcaacatgccgcccggacgaattccagtgtagtgacggcaactgtatccatgggtcacgacagtgcgatcgagaatatgactgcaaagatatgagcgatgaggtgggctgtgtaaatgtgactttatgcgagggacctaacaagttcaagtgccatagtggcgagtgcattaccctggacaaggtctgcaatatggcacgcgactgcagagactggagtgatgaacccattaaggaatgtggcactaatgagtgcctggacaacaacgggggttgcagccatgtatgcaatgatctgaagatcggtgccgagtgcctgtgccctgacggctttcagctcgtggcccaaagacgttgcgaggatatagacgagtgtcaggaccccgatacatgcagccagctgtgtgtcaaccttgagggaggctacaagtgtcagtgcgaggaagggttccaactcgatccacacaccaaggcctgcaaggcggtggggtccatcgcctacctattcttcactaaccggcacgaagtgcggaaaatgacccttgaccgttcagagtacacttcgctgattcccaatttacggaacgttgttgcactggatactgaggtcgcctccaaccgaatttactggtccgacctttcgcagcgtatgatctgcagtacgcagctcgaccgcgctcacggcgttagctcctatgacacagtgatttctagggacatccaggcccctgacggcctggcagtggactggatacacagcaacatctactggaccgactcggtcctggggacagtctccgtcgcagataccaaaggggtgaaacggaagacactgtttcgggaaaatgggtctaagccccgtgcaattgtggttgaccctgtacatggctttatgtattggaccgattggggaacccccgcaaaaataaagaagggcggtctcaatggcgtggatatctactccctagtgacagagaatattcagtggcccaacggaatcaccttggacctcctgtcaggcaggctctactgggttgactcaaaattgcattctatctctagcattgacgtgaacggggggaatcgtaagaccatactcgaagacgagaagcggctggcacacccgttcagtttggcagttttcgaggacaaagtattctggacagatatcattaatgaagccatattctcggctaatcgcctcaccggatcagacgttaacctgctagctgaaaatttgttatccccggaggacatggtactgtttcacaacctgacacagcccaggggggtgaactggtgcgaacgcaccacactgtccaacgggggctgccagtacctgtgcttgcctgcgccccagattaaccctcatagccccaagttcacctgcgcctgtccagacgggatgcttctagcacgagacatgcggagttgccttacagaggccgaagccgctgtggccacgcaggagaccagtactgtgagactgaaagtcagctcaaccgcggtgagaacgcagcacacaaccacgaggccggttcccgatacctctcgactccccggagcaacacctggattaacaacggtggaaatcgtgactatgagtcaccaagccctgggggacgttgcgggccgcggtaatgagaaaaagccgagctcggtccgcgctctttccatcgtcctacccatcgtgctcttagtctttctgtgtcttggcgtctttctcctttggaaaaactggcgattgaagaacatcaatagcattaacttcgacaatcccgtttaccaaaaaaccactgaagatgaggttcacatctgccataaccaggacggctacagctacccttcgagacagatggtgtctctagaagacgatgtcgca

SEQ ID NO: 600 - DNA, 2580 bp, Artificial Sequence
  Description of Artificial Sequence: Synthetic Transcript Sequence
atggggccttggggttggaagctcagatggacagttgccctgcttctggcagctgctggtacggctgtgggtgatcgctgtgagcggaatgagttccaatgccaggacgggaagtgcatctcttacaaatgggtgtgtgacggctctgcggaatgccaagacggctccgacgagtcacaggagacatgtctgtccgtgacttgcaaaagcggtgatttctcctgcgggggtagagtgaaccgatgtatcccacagttttggaggtgtgatgggcaggtggactgcgataacggatcagacgagcagggttgtcccccaaaaacttgtagtcaggacgagttcaggtgccatgatggcaaatgtatcagtaggcagttcgtgtgtgactcagatcgggactgtctggatggcagcgatgaggcgtcttgccctgtgctcacctgtggtccggcaagcttccagtgtaatagttctacttgcattccccagctgtgggcctgcgataacgatccggattgcgaggatggatctgacgaatggccccagcggtgtaggggcctctacgtgtttcaaggggatagtagcccttgtagcgctttcgaattccactgtctgagtggcgaatgcatacattcaagctggcgctgcgatggaggacctgattgtaaggataagtctgacgaggaaaattgtgctgtcgccacttgccggcccgacgaattccagtgttccgacggaaattgtatccatggcagccgccagtgtgatcgagaatacgattgcaaggacatgtccgacgaggttggttgtgtcaatgtgactctttgcgagggcccaaataaatttaagtgccattctggagaatgcatcacattggataaggtgtgcaacatggcacgagactgccgggattggagcgatgaacctattaaggaatgcggcactaatgaatgccttgacaataatgggggctgttcccacgtttgcaatgatctgaagattggagcggaatgcctctgccctgatgggttccagctggtggcgcagagacgctgcgaggatattgatgaatgtcaggaccctgacacatgttcccagctgtgcgtgaacctggaaggtggttataagtgtcaatgcgaggagggctttcagctggatccgcacacaaaggcctgcaaagcagtgggaagcatcgcttacctgtttttcacaaatcgccacgaggtccggaaaatgaccctcgatcggagcgaatatacctcccttattcctaacttgcgcaatgtggttgcactggataccgaggtggcgtctaatagaatctattggagtgatctcagccagagaatgatctgctccacacaattggaccgcgctcacggtgtgtcaagctatgataccgttatatctagggatattcaggcacccgatggactcgcagttgattggattcattccaacatttactggacagatagcgtgttgggtaccgtgagtgtcgctgatacaaagggcgtgaagcggaagaccctctttagggaaaatggtagtaagcctcgggccatagtagttgatccggtccacggatttatgtattggaccgactggggcactcccgctaagattaagaagggcggcctgaacggcgttgatatttacagcctggtgacggaaaacatccagtggcccaacggcatcactctggacctgctgtccggcagactgtactgggtggattctaagctgcacagcatcagctctatcgatgtcaacgggggaaacaggaagacgattctggaggatgaaaaacggctggcccacccattcagcctggcagtgttcgaagataaggtgttttggacggatattatcaacgaggccatattcagcgccaacaggcttacgggctctgacgtcaatctgctcgccgaaaatcttctgagcccagaggatatggtgctcttccacaatctgacccagccacgcggtgttaactggtgcgagagaactactctgagcaacgggggctgtcagtacctgtgtctgccagctccccaaatcaacccccattcaccaaaatttacctgcgcttgtcccgatggcatgttgctggccagggatatgaggtcctgcctcacggaggctgaagcagcagtggccactcaggagacttctactgttcggcttaaagtcagctctactgctgtgaggacacaacatacaacgaccagaccagtgcccgacacctctcggctgccgggggccacccccgggctgaccaccgtggagattgtcacaatgtcacaccaggctctgggggacgtagcaggcaggggtaacgaaaagaagcccagctcagtgagggcactcagcatcgtgctgccaatcgtactgctggtcttcctttgtctgggcgtctttcttctgtggaaaaattggaggctgaaaaacatcaacagcattaactttgacaatccggtgtatcagaagaccacagaagatgaggtacacatatgtcacaatcaggacggatactcctatcctagcaggcaaatggtatctctggaggacgatgtggcc

SEQ ID NO: 601 - DNA, 2580 bp, Artificial Sequence
  Description of Artificial Sequence: Synthetic Transcript Sequence
atgggcccatggggatggaagttgcgttggactgtagcgctcctattagctgcagcgggtactgccgtgggagatcgctgcgagcggaatgaatttcaatgccaagacggcaaatgcatatcgtacaagtgggtgtgtgatggttctgcagaatgccaggatggtagcgatgaatctcaggagacctgtctgagcgtaacatgcaagtccggcgacttctcatgtggaggtagggtgaaccgatgtattccccaattctggagatgtgacgggcaagtcgattgtgataatggatcagatgaacaagggtgcccccccaagacatgctctcaagatgaattccgatgccatgatggtaagtgtattagtcgacagtttgtgtgcgactctgatagagattgtctggacggcagtgatgaagcctcgtgccctgtgctaacctgcgggccagcctctttccagtgtaactcgtctacttgtataccacaactttgggcttgtgataacgatcccgattgcgaagatgggagcgatgaatggccacaacgttgtagggggctttacgttttccaaggggattcgtcgccgtgctcagccttcgaattccattgcctgtcaggtgagtgcatccacagtagctggaggtgtgatggcggccctgactgtaaggataagagcgacgaggagaattgcgccgttgctacctgcaggcctgatgaattccaatgttctgacggaaattgtattcatggttccagacagtgtgacagagagtacgactgcaaggatatgtccgatgaggttgggtgtgtgaatgttacgctttgtgagggaccaaacaagttcaaatgtcatagtggtgaatgtattacattggataaagtctgcaatatggctagagattgtagggattggtcagacgagccaattaaagagtgtggaaccaatgaatgcctggataataatgggggttgttctcatgtatgcaacgatctcaagattggagcagagtgcctttgtccagacggcttccagcttgttgcccagaggagatgcgaagacattgatgagtgtcaagaccctgatacctgttcacaattgtgtgtgaatttggaaggcggttacaaatgtcaatgcgaggaaggatttcaactggacccgcatacaaaggcttgcaaagcagttggctcaatagcttacttattctttaccaaccggcacgaggttaggaaaatgactttggaccgttcggaatacacttctcttatccccaacctaagaaacgttgtggcactagacactgaagttgcttcaaacaggatttattggtctgaccttagccaaaggatgatttgcagtactcaacttgacagggcccatggggtgagctcatatgacactgtaatctctagagacatacaagctcccgacgggcttgctgtggactggattcatagtaacatctattggactgatagcgttctagggaccgtctcggtagccgatacaaaaggcgtgaagagaaagacgttgtttcgtgaaaacgggtcaaagccccgagctatcgtggtggatccagtccatggtttcatgtattggaccgattggggaacgcctgctaagattaaaaaaggtgggctaaatggtgttgacatatatagcctcgtgaccgaaaatatacaatggccaaatggaatcacgctcgatttgcttagtggaagactttactgggtggactctaaattgcactcaatatcaagtattgatgtaaacggtggaaacaggaagacaattcttgaagatgaaaagaggcttgcacatcccttctcactcgctgtttttgaagataaagtgttttggaccgatattattaacgaggcgatctttagtgctaatcgtttgaccggttccgatgttaaccttttggcggaaaacttgctttctcctgaggatatggtattattccataaccttactcagcctcgcggtgtgaattggtgtgaaaggacaactcttagcaatggtgggtgccaatatttatgtttgccagcccctcaaattaacccacactcccctaagttcacatgcgcttgccctgatggtatgctgcttgcccgagatatgcgctcgtgtctgacagaggctgaggcagcagttgctacccaggaaacttcaactgtgagactcaaggtgtcatcaaccgccgtgaggacccagcataccacgacaaggcccgttcctgatacgtcacgtttgccgggagcgacaccaggcttaactactgtggagatagttaccatgtctcatcaagctctaggtgacgtcgccggccggggaaatgaaaaaaaaccttcgagtgttcgagctctgtctatcgtgttgcctatcgttctgcttgttttcctttgtcttggtgtgttcttgctctggaagaactggagactgaaaaacatcaactcaataaattttgataaccctgtttaccaaaagacaacggaagacgaggtacatatttgccataatcaagatgggtattcttatccttctcggcagatggtaagcttagaggacgatgtggct

SEQ ID NO: 602 - DNA, 2580 bp, Artificial Sequence
  Description of Artificial Sequence: Synthetic Transcript Sequence
atgggaccgtggggttggaaacttcggtggactgtcgcactgcttctggccgcagctggcactgcggtgggtgatcggtgtgaaagaaacgaatttcagtgccaggatggcaagtgtatatcgtacaagtgggtgtgcgatggatccgcggaatgccaagacggaagcgatgaatcacaggagacttgcctgtcagtcacctgcaagtcaggtgacttttcatgcgggggtagggtcaaccggtgcattccccaattttggcgctgtgacggccaagtcgactgcgacaatggatccgatgaacaaggttgcccacccaagacctgttcgcaggacgagttcaggtgtcacgatggaaagtgcattagtcgccagttcgtgtgtgacagcgaccgtgactgtctggatggatcggacgaagcaagctgccctgtgttgacttgcggaccagcatcctttcagtgcaacagctcgacttgcatccctcagctctgggcatgtgataacgatcctgattgcgaggatggttccgacgaatggcctcagcggtgtcgtggtctgtacgtctttcaaggtgattcgtccccttgtagcgcatttgagtttcattgtctctcgggagagtgcattcattcctcctggcgctgtgatggaggtccagattgtaaagataagtcagatgaagaaaattgtgcagtggcaacctgccgccccgatgaatttcagtgtagcgatggcaactgtattcatggatcgagacaatgtgatagggaatacgactgtaaggatatgtccgacgaagtagggtgcgttaacgtgactctgtgtgaaggaccgaacaagtttaagtgtcactccggagaatgcattaccctcgataaggtctgcaatatggcaagagattgccgtgattggagcgacgaacccatcaaggaatgcggtaccaatgagtgtctggataacaatggcggatgttcgcatgtgtgcaacgatctgaagatcggcgcagagtgtctctgtcccgatggtttccaactggtggcacaaagaagatgtgaagatattgatgagtgtcaagacccggacacctgcagccaactgtgtgttaatcttgaaggtggatacaagtgtcaatgcgaagaaggttttcagctcgatccccacactaaggcgtgtaaggcagtggggagcatagcgtacctgtttttcactaatagacatgaagtgagaaagatgactctggaccgttcagaatacacttcacttatccctaaccttcgcaacgtggtcgccctggatactgaggttgcaagcaaccgcatttactggtcggatctttcacaaagaatgatttgttctactcagcttgatcgagctcatggcgtgtccagctacgataccgtgatcagccgtgacattcaggctccagacggcctcgcagtggattggatacattcaaacatctattggacggattcggtcctgggaaccgtctccgtcgccgataccaagggtgtgaagagaaaaacgctgtttcgtgaaaatggatctaaacctagagcaatcgtcgttgaccccgtgcatgggttcatgtattggactgattgggggactcctgccaagatcaaaaagggaggattgaatggtgtggatatctattcgctggtgactgaaaacattcagtggcctaatgggattaccttggatctgctgtccggtcgtttgtactgggtggattcgaagctgcattccatctcctctattgatgtgaacggcggaaaccgtaagaccatccttgaagatgaaaagcgtctggcacaccctttctccctggccgttttcgaggacaaggtcttttggactgacattatcaacgaagctatcttttcagcgaatcgcttgaccggttcagatgtgaaccttctggctgagaatctgctgtcccccgaagatatggtgctgttccacaacctgacccaacccaggggagttaattggtgcgaaaggaccacgctcagcaacggaggatgccagtacctctgccttcctgccccacaaatcaatcctcattcccccaagttcacctgtgcatgcccggatggaatgttgcttgccagagacatgcgaagctgtcttactgaagcagaagcagcggtggcaacccaggaaacctcgactgtgcgcctgaaggtgtcgagcaccgcagtccgcactcagcacaccaccaccaggccagtccccgacactagcaggcttccaggagctactccagggcttaccaccgtggagattgtgactatgtcccaccaggcactgggtgacgtcgcaggacggggaaatgagaaaaaaccctcgagcgtgagggcattgtcgattgtgcttcctatcgtgttgctggtctttctgtgtctcggagtgtttcttctctggaagaactggagactgaagaacataaacagcatcaactttgacaacccagtctaccaaaaaactactgaagatgaagtccatatctgccataatcaagacggttactcctacccctccagacaaatggtgagcctcgaggatgacgtggcc

SEQ ID NO: 603 - DNA, 2580 bp, Artificial Sequence
  Description of Artificial Sequence: Synthetic Transcript Sequence
atgggaccgtggggttggaagctgaggtggaccgtcgctctgctcctggcagccgcaggaaccgcggtcggggatcgctgcgagcggaacgagtttcaatgtcaggacggaaagtgcatctcttacaaatgggtgtgcgacggctccgccgagtgccaggatggttccgacgaatcgcaggaaacttgcctgagcgtgacttgcaaatccggagacttctcgtgcggaggacgggtgaatagatgcatcccacagttctggaggtgtgacggacaggtcgactgcgataacggatccgacgagcagggctgccctccgaaaacctgttcgcaagatgagtttcggtgtcacgatggaaaatgcatctcgagacaattcgtgtgcgattcagatcgggactgcctggatggctcagacgaagcatcctgtcctgtgctcacctgcggcccagcttctttccagtgcaattcgtccacgtgtattccgcagttgtgggcgtgcgacaacgacccggattgcgaggacggtagcgacgaatggcctcaacggtgcaggggactctacgtgttccaaggggactcatcaccgtgctcagccttcgagtttcactgcctgtcgggagaatgtattcactcctcctggcgctgcgatggagggcccgactgcaaggataaatcagatgaagaaaactgcgcggtggctacttgcagaccggacgaattccaatgcagcgatggtaactgcattcatggatcccggcaatgcgaccgggagtatgattgcaaagatatgtcagatgaagtgggttgtgtgaacgtgaccctgtgcgaaggcccgaacaagtttaagtgtcattcgggggaatgcatcactctggacaaggtgtgcaacatggcgcgtgactgcagggattggtccgacgagccgataaaggagtgtggtaccaacgaatgtctcgataacaatggcggatgctcccatgtgtgcaatgatctcaagatcggggctgagtgtctgtgcccagacggattccagctggtcgctcagcgccggtgtgaagatatcgatgaatgtcaggacccagacacctgctcacagctctgcgtcaatctggaaggtggatacaagtgccaatgtgaggaaggtttccaactcgacccgcacaccaaagcgtgtaaagccgtggggagcattgcttatctctttttcactaatcggcatgaagtcagaaagatgacccttgacagatcagaatacacctcccttatcccgaatttgagaaacgtggtcgccctggataccgaggtggcgtccaacagaatctactggtcggacctgagccagcgaatgatttgttcgacccaactggatcgggctcacggcgtgtcgagctacgacaccgtgatctcgagagacatccaggccccagatggactcgccgtggattggatccactctaacatctactggaccgactcagttcttggcaccgttagcgtcgccgacactaagggagtgaaacgaaagaccctgtttagggaaaatggaagcaaaccacgggcgatagtggtggaccccgtgcatggcttcatgtactggacggactggggaacgcccgcaaagatcaagaagggtggactcaacggcgtggacatctactcgctggtgactgagaatatacagtggcctaacggaatcacgttggatctgttgtcgggcaggctgtactgggtggattccaagctccatagcatttcgagcatcgatgtgaacgggggaaaccgaaagactatcctcgaagatgagaaacgcctcgcgcacccgttctccctcgccgtgttcgaggataaggtgttctggaccgacatcatcaatgaggcaatcttcagcgccaatcggttgaccgggtcggatgtgaacctgctggcggagaacctgctttctccggaggacatggtcttgttccacaacctcacccagccccgaggagtcaattggtgtgaacgcactactctgtcaaacgggggatgccaatacctgtgcctgcctgccccgcagatcaacccacactccccgaaattcacctgcgcatgcccggacggaatgctgctggccagagacatgcgctcttgcttgactgaagctgaagccgccgtggccactcaagagacgtccactgtgcgccttaaagtctcctcgacggctgtgagaacccagcacaccaccacgcggccggtgcctgacactagcagactcccgggtgcaacgccgggactgaccaccgtggagattgtgaccatgtcgcaccaggcccttggcgacgtggcaggacgcggcaacgagaagaagccgtcctccgttcgcgctctgtcgatcgtcttgcccatcgtgctcctcgtgtttctgtgccttggagtctttctgctgtggaagaattggcgtctgaagaatatcaattccatcaacttcgacaacccagtttaccagaaaactaccgaagatgaggtccatatctgccataaccaagatggctacagctatccatcccgccagatggtgtcgctcgaagatgacgttgcc

SEQ ID NO: 604 - DNA, 2580 bp, Artificial Sequence
  Description of Artificial Sequence: Synthetic Transcript Sequence
atgggaccctggggttggaaactccgctggaccgtggccctgctgttggccgccgcgggtaccgcggtcggagataggtgcgaacgcaatgagtttcaatgccaggacggaaaatgcatctcgtacaagtgggtgtgcgacggatccgctgagtgccaggatggatcagacgaatcacaagaaacttgcctctccgtgacttgcaagagcggagacttcagctgtggtggaagagtgaatcgttgtatcccccagttttggcggtgcgatgggcaggtcgactgcgataacgggtccgacgaacagggttgtccaccgaaaacctgctcccaggacgagtttagatgtcatgatggcaagtgcatcagcagacagttcgtgtgcgactccgatcgggactgtctggatggcagtgatgaagcctcctgccccgtcctgacgtgcggaccggccagcttccagtgcaattcgtcgacttgcatacctcagctttgggcctgtgacaatgaccctgactgtgaagatgggtccgacgagtggccgcaacgctgtaggggcctttatgtgttccaaggtgattcgtctccgtgctcggctttcgaattccactgcctcagcggagaatgcatccattcctcctggcgctgcgatggcggtcctgactgcaaggataaaagcgacgaggagaactgcgccgtggcaacttgccggccggacgagtttcagtgttccgacgggaactgcatccatgggtcaaggcaatgcgacagagagtacgactgtaaggacatgtccgatgaggtcgggtgcgtcaacgtgactctgtgcgagggaccgaacaagttcaaatgtcatagtggcgaatgcattaccctggacaaggtgtgcaacatggctagagattgccgggattggagcgacgagcctatcaaggagtgtggcacgaacgaatgccttgacaacaacggtggatgttcgcacgtctgcaacgatctgaagattggagctgaatgtctctgccctgacgggtttcaactcgtggcacagcgtcgctgcgaggacattgatgaatgtcaggacccagacacctgctcgcaactctgtgtcaacttggaaggagggtacaagtgccaatgcgaggaaggcttccaactcgacccgcataccaaggcttgtaaagcagtgggctctatcgcctacctgttcttcaccaatagacacgaggtgcgcaagatgacgctggatcggtcggaatacaccagcctcatccctaacttgcggaatgtggtcgccctggacactgaagtcgcgagcaaccgcatctactggtcagacctgtctcagcgaatgatctgttccacgcaactcgacagagcccacggcgtgtccagctacgacaccgtgattagccgggatatccaggccccagacgggctggctgtggactggattcactccaatatctactggaccgactcggtgctcggcactgtctccgtggcggacaccaagggtgtgaagcgaaagaccctcttccgcgaaaacggttcgaagcctagagcaattgtggttgaccctgtgcacgggttcatgtactggactgattggggaaccccggccaagatcaagaagggaggactcaacggagtggatatctactcgctggtcaccgagaatatccagtggccaaatggaatcaccctcgatctcctttcagggcgtctgtactgggtcgactccaagctgcactcaatctcctcaatcgatgtaaacgggggcaatcggaaaactatcttggaagatgaaaagcgcctcgcccatcctttttcgctggctgtgttcgaggataaagtgttctggaccgatatcattaatgaggccatcttttcggcgaatcgccttactggaagcgacgtgaaccttctggcggagaatttgctgtcgccggaagatatggtgttgttccataacctgacccaaccacggggcgtgaactggtgcgaacggactactctgtcaaacggcggatgccagtacctgtgcctccccgcaccacaaatcaatccgcactcgcccaaattcacgtgcgcgtgcccggacgggatgctgctggcacgggatatgcggtcctgcctgaccgaggccgaggcagccgtcgcgactcaggaaacgtcaaccgtgcgcctcaaggtgtcgtcgactgcggtccgaactcagcacactaccactagaccggtaccggatactagccgcttgcccggagctaccccaggcttgaccactgttgagatcgtaactatgtcgcaccaggcactgggcgacgtcgctggacggggaaatgaaaagaagccgtcgagcgtgcgggccttgtccattgttctgccgattgtgctgctggtgttcctgtgtctcggagtgttcctgctgtggaaaaactggcgactgaaaaacattaactcgatcaacttcgacaacccggtttaccagaaaaccactgaggatgaagtccacatctgccacaatcaagatggctacagctatccgtcaagacagatggtatccctggaggacgacgttgcc

SEQ ID NO: 605 - DNA, 2580 bp, Artificial Sequence
  Description of Artificial Sequence: Synthetic Transcript Sequence
atgggtccctggggctggaaacttagatggactgtcgcactgctccttgcagcggcgggaactgctgtgggtgatcgctgcgaacgcaatgaatttcagtgtcaagacgggaagtgcataagctacaaatgggtctgcgatggatccgcggaatgccaggatggttccgatgagagccaagaaacttgcctttccgtgacttgtaagagcggcgacttctcgtgtggtggcagagtgaatcggtgcatcccacaattttggcggtgtgatggacaagtggactgcgacaacgggtccgatgaacagggatgcccaccgaaaacttgctcgcaggatgaatttagatgtcatgatggaaaatgtatctcccgccagttcgtgtgcgatagtgatcgggactgcctggatggttcggatgaagctagctgtccagtgctgacttgtgggcccgctagctttcaatgcaactcctcgacttgtattcctcagctttgggcctgtgataacgaccctgactgcgaagatggctccgatgaatggccgcagcggtgcagagggctctatgtgttccaaggcgatagcagcccttgctcagcatttgaattccattgtctgtcgggagaatgtatccactcaagctggcgatgcgatggtgggcccgattgcaaggacaaaagcgacgaggagaattgtgccgttgccacgtgtcgccctgatgagttccagtgttcggacggcaactgtattcatggatctcgacagtgtgatagagagtacgactgcaaagacatgtcggatgaagtgggatgtgtgaacgtgactctgtgtgaagggcccaacaagttcaaatgccactccggtgaatgtatcacgctggacaaggtgtgtaacatggcacgagactgtagggattggtctgatgaaccgattaaggaatgcggaaccaacgaatgtctggataacaatggaggatgctcccacgtctgtaatgatctgaagattggtgcagagtgcttgtgtcctgatggttttcaactggtggcccaaagacgttgcgaggatatcgatgaatgtcaagatcctgatacttgttcccagttgtgcgtgaacctcgaaggaggttacaaatgtcaatgcgaagagggattccaactggacccccacactaaggcctgtaaagcagtgggaagcatcgcatacctcttctttaccaatcgccatgaggtccggaagatgactctggataggtcggaatacacctcgctgataccgaacctcaggaatgtggtggccctggataccgaggtcgcatcgaatagaatttactggtcggatctctcccaaaggatgatttgctccacccaacttgatcgcgcccacggcgtctcatcctacgacaccgtgatctcgcgtgatattcaagccccagacggactggcagtcgactggatccattccaacatttactggactgactcggtcttgggtactgtctccgtggcagacactaagggtgtcaagagaaagactctctttcgcgagaacgggtcaaagccacgggcaatcgtcgtggatccggtgcacggctttatgtactggaccgattggggaaccccagcaaagatcaagaaaggaggtcttaacggtgtcgacatctattcgcttgtcaccgaaaacatacagtggccaaacgggataacccttgaccttctttcgggacgtctctactgggtggattccaagctgcacagtatctcgtccattgacgtgaatggaggtaatagaaagacgattcttgaagatgaaaagaggctcgctcacccgttttcgcttgctgtgtttgaggataaagtgttttggactgatatcattaacgaagccatattctccgcaaatagactgactggttcagatgtgaacctgcttgcagaaaacctgctttcaccagaagatatggtgctttttcataacttgactcaaccccgtggcgtgaactggtgtgaacgaaccacgctgagcaatggcggatgtcagtacctttgcctgcctgcaccccagatcaacccgcatagtcccaaattcacctgtgcatgccccgacggaatgttgctggccagagacatgcgctcttgtctgaccgaagcggaagcagctgtggcaacccaagaaacctctactgtgcgacttaaggtgtcatcgaccgcagtgcggactcaacacaccaccaccagacctgtccctgacacgtcgcggctgccaggtgcgactcccggcctgaccaccgtggaaatcgtgaccatgagccaccaagccttgggagacgtcgcaggtaggggaaacgagaagaaaccatcgtccgtgcgcgccctgtcgattgtgttgccaatagtgctgctggtgttcctttgccttggggttttcctgctgtggaagaactggcggctgaaaaacatcaattccattaacttcgataatccagtgtaccaaaagactaccgaggatgaagtgcatatatgtcacaaccaggacgggtacagctacccatcgagacagatggtgtccctggaggatgacgtggca

SEQ ID NO: 606 - DNA, 2580 bp, Artificial Sequence
  Description of Artificial Sequence: Synthetic Transcript Sequence
atgggaccttggggttggaagctgcgttggaccgtggcactgctgcttgcagccgccggaaccgctgttggagatcgatgcgaacggaacgagtttcagtgtcaagacgggaagtgtatatcgtacaagtgggtgtgtgatggatcggccgagtgtcaggatggaagcgatgaatcccaggaaacttgtctttccgtgacttgcaaaagcggagatttttcgtgtggaggtcgtgtgaatagatgcatccctcagttttggaggtgcgatggacaagtggattgtgacaatggttctgatgaacagggctgccctcctaagacctgctcccaagatgaatttcgctgtcatgacggaaagtgcatttcccgacagttcgtctgcgattcagacagagactgtcttgacggatccgatgaagcatcatgtccagtccttacctgcggacccgcctcgtttcaatgcaatagctccacctgtatccctcagctctgggcttgtgataatgaccctgattgtgaggatggctcagacgaatggccacagcggtgtcgaggcctgtacgtattccagggcgattccagcccatgttcggcatttgaattccattgcctctcaggagagtgtatccattcgagctggcggtgtgatggaggtcctgactgtaaagataaatcagatgaagaaaactgtgccgtggctacgtgtagacctgatgaatttcagtgcagcgatggaaactgtatccatggctccagacagtgtgaccgagaatacgattgtaaagatatgtcagacgaagtcgggtgtgtcaacgtgactctgtgcgaaggaccaaacaagtttaagtgtcactcgggcgagtgcattactcttgataaagtgtgtaacatggcacgcgattgtcgggattggtcggatgagccaattaaggaatgtgggactaatgagtgcttggacaacaacgggggctgttcccatgtgtgcaacgatctgaaaattggtgcagaatgtctgtgtcctgatggctttcaactggtggcccagagaagatgcgaagatatcgatgagtgccaggatcccgacacttgttcgcaactctgcgtcaaccttgaggggggctacaaatgtcaatgtgaagagggcttccagttggatccccatactaaggcctgtaaggcggtgggttccatagcatacctgtttttcaccaatcggcatgaggtgcgtaagatgaccctggacagaagcgagtacactagcctgattcctaatctccgcaacgtggtggctctggatactgaggtggcatccaatcggatctattggtcggatctctcccagaggatgatctgttcgacccagcttgatagagcacatggtgtctcgtcgtacgataccgtgatttccagggacattcaggcacctgatggactcgcagtcgactggatccattcgaacatttactggactgattccgtgcttggaactgtgtccgtggccgacactaagggcgttaagaggaaaacgctcttcagagagaacggatccaagcctagagcaattgtcgtggaccccgtccatggatttatgtactggacggactggggaactccagcgaagataaagaaggggggattgaatggagtggatatctactcgcttgtgaccgaaaacatccagtggcctaacggcatcacccttgatcttcttagcggacgtctttactgggtggatagcaaacttcatagcatttcaagcatcgatgtcaacggtggtaacagaaagactatccttgaagatgagaagcgactggcacatcccttttcgcttgccgtgtttgaagataaggtcttttggaccgacatcattaacgaggcaatcttcagcgcaaaccgccttacggggagcgatgtgaatctccttgccgaaaaccttctgtcaccggaagatatggtgctgttccacaatctcacccaacctaggggagtgaactggtgcgagcggaccaccctcagcaacggcggttgtcaatacctgtgtctgccagcacctcagataaatcctcacagccccaagtttacttgcgcgtgtcctgacggaatgcttctggcacgagatatgcgtagctgtttgaccgaggcggaggcggccgtggcaactcaggaaacttccaccgtgagacttaaggtgtcctctaccgcagtgcggacccaacataccaccaccaggcctgtcccagacacctcaagacttccaggtgcgacgccaggtcttacgactgtggagattgtgactatgagccatcaagcactgggagatgtggccggccggggaaatgaaaagaagccttcatcggtgcgcgccctttcgatcgtcctgccaattgtgcttctggtgtttctttgtctgggcgtgtttttgctttggaagaactggcggctgaagaacattaacagcataaactttgataacccagtgtaccaaaagactaccgaggacgaagtgcacatatgtcataatcaagatgggtactcttacccatcgaggcaaatggtgtcgctggaagatgatgtcgca

SEQ ID NO: 607 - DNA, 2580 bp, Artificial Sequence
  Description of Artificial Sequence: Synthetic Transcript Sequence
atgggcccatggggttggaagttgagatggacggtggcactgcttctggcagcagcaggaactgcagtgggagatagatgcgaaaggaacgaattccaatgccaggatggtaagtgcatttcatacaaatgggtgtgtgacggttccgcagaatgtcaggatggttctgatgagagtcaggaaacttgcctctcggtgacttgtaagagtggtgattttagctgtgggggacgtgtgaatcgctgcattcctcaattttggaggtgtgacgggcaggtggactgcgacaacggatccgacgagcaaggatgtccaccaaaaacctgttcgcaggacgagtttcggtgtcacgacggaaagtgtattagtagacaatttgtatgtgattcggatcgtgattgtcttgacggttcagatgaagccagctgccctgtgctgacctgtggcccagcctccttccaatgcaattcatcgacttgtattccccagctgtgggcatgcgacaacgatcctgattgtgaagatggttcggatgaatggccccagcgatgcagaggcctgtacgtgttccagggagatagctcaccgtgttccgcttttgaatttcattgtctttcgggggaatgcatacattcatcctggcgctgcgacggcggacccgattgcaaggacaagagcgacgaagagaattgtgcagtcgccacgtgtagaccagacgaatttcaatgctccgacggtaactgtatccacggttcgcgtcaatgcgatagagagtacgattgtaaggacatgagcgatgaagtgggatgtgtaaacgtgaccctttgtgagggtccaaacaagttcaaatgccattcgggtgaatgtatcacccttgacaaagtctgcaatatggcgcgcgattgccgcgattggtccgatgaacctattaaggaatgtggaaccaacgaatgtcttgacaacaacggcggctgctcgcacgtttgcaacgatctgaagattggagctgaatgtctttgtcccgacgggtttcaactcgtcgcacaacggcggtgtgaggacattgatgagtgtcaggatcccgacacttgtagccaattgtgtgtgaaccttgaagggggctacaaatgtcagtgcgaggaaggcttccaactcgatcctcatacgaaagcatgcaaggctgtcggatccattgcatacctgttctttactaatcgccatgaggttagaaaaatgactcttgaccgatcagaatatacttctcttatccctaacctgagaaatgtcgtggcactggatactgaggtggcctcaaatcgcatctattggagcgatctgtcccagaggatgatttgttccactcaacttgatcgagcgcacggtgtctcgtcgtacgacaccgtgatttcgcgggatattcaagcccctgatggactcgcagtagactggatccattcaaacatctactggactgattcagtgctgggaaccgtgtcagtggctgataccaagggagtcaaacggaaaaccttgtttagagagaacggatcgaagccccgagccatcgtcgtcgatccagtgcatggcttcatgtactggacggattggggcactcctgcgaagatcaaaaagggaggcctcaatggagtggacatttactcccttgtgaccgagaacattcagtggccgaacggcatcacgctggaccttctctcggggagattgtactgggtggactcgaagctccactctataagctccattgatgtgaacgggggcaatcggaaaactatccttgaagatgaaaagcgcctggcacatccgttttccctcgcggtgtttgaggataaggtattttggactgatatcattaatgaagcgatcttttcggccaatcgcctcactggatcggatgtcaaccttctggccgaaaaccttctttcccctgaggatatggtcctgttccataatctcacccaaccacgtggtgtgaactggtgtgaaagaaccacccttagcaatggaggctgccaatacctttgtttgcctgcccctcagattaaccctcactccccaaagttcacctgcgcgtgtccagacggtatgctgcttgcccgagatatgcgtagctgtttgactgaggcagaagcagcggtcgcaactcaggaaaccagcaccgttcggctgaaggtcagttcaaccgctgtgcggacccaacatacgacgaccagacctgtccctgacacgtcgcggttgccgggtgcaactcccggattgaccactgtggagatagttaccatgagccatcaagccctcggagatgtcgcaggaagaggaaacgagaaaaagccctcgtccgtccgagcactttccattgtccttcctatcgtgcttctggtgttcctttgtctcggtgtgtttctgctgtggaagaattggagactcaagaacataaactcgattaactttgataatccagtgtaccagaaaaccaccgaagatgaagtgcacatatgtcataatcaagacgggtacagctacccatcccgacaaatggtgtctctggaagatgacgtggca

SEQ ID NO: 608 - DNA, 2580 bp, Artificial Sequence
  Description of Artificial Sequence: Synthetic Transcript Sequence
atgggcccatggggatggaagctccgctggactgtcgctctccttttggccgctgcaggaaccgcagtgggggataggtgcgagaggaatgagttccaatgccaggatggaaaatgtatttcatataagtgggtctgcgacggatccgcagagtgtcaggacggcagcgacgaatcccaggaaacatgcctctcagttacatgcaagtccggcgacttttcttgtggtgggagagttaaccggtgtattcctcaattctggcgatgcgacgggcaggtcgactgcgataatgggagcgatgagcaagggtgtcctcctaaaacttgtagtcaggacgagttcaggtgtcacgatgggaaatgtatttctagacagttcgtgtgtgatagtgatcgcgactgcttggacggctcagacgaggccagctgccccgttctgacgtgcgggcctgcttccttccagtgtaactcttctacttgcatccctcagctctgggcctgcgacaacgaccctgactgtgaagatgggtccgatgaatggccgcagcgctgcagagggctctatgtttttcagggagattctagcccttgctctgcattcgagttccactgcctgtcaggcgagtgcatccactcttcctggcggtgcgacggtggtcccgactgcaaagataagtccgacgaggaaaactgcgccgtcgctacctgccggcccgatgaattccagtgtagcgatggaaactgtatccacggctcaagacagtgtgatcgagagtacgactgtaaagacatgagcgatgaggtcggctgtgtaaacgtcaccttgtgtgagggccccaacaaattcaagtgtcactcaggcgagtgcatcaccctggataaggtgtgtaacatggctagggattgtagagattggagcgacgagcccattaaagagtgcggaacaaacgagtgcctggataacaacgggggatgctcacacgtgtgcaacgacttgaagattggagcagagtgcctgtgcccagacggctttcagctcgtggcgcagcggaggtgtgaagacatcgacgaatgtcaggatcctgatacctgcagtcagctgtgcgtcaacctggagggaggatacaaatgtcaatgcgaggagggctttcagctggacccccatactaaagcctgtaaagccgttggttctattgcgtatctgtttttcactaataggcacgaagtgcggaagatgaccctcgacaggagcgaatacacaagcttgattcctaacctgcgaaatgtcgtcgccctggacaccgaagtggctagcaataggatctattggagcgatctctctcaacggatgatttgctcaactcagctggatcgagcgcacggcgtgagctcttatgacacggtgatatccagggacattcaggcacctgatgggctggccgtagactggattcactctaatatctattggaccgactccgtgctcggaaccgtctctgttgctgataccaaaggggttaagcgaaagactttgttcagagagaacggtagtaaaccgcgggcgatcgtcgtggacccggtgcatggtttcatgtattggactgattggggcactccagcaaaaattaaaaaaggaggccttaacggggtagatatctactccttggtaacagagaatattcagtggccaaatgggattaccctggatctcttgagcgggcgcctgtactgggtggatagcaagctccatagcatctcaagtatcgacgtgaacggtggcaacaggaaaacaatcctggaggatgagaagcgcctggcccatcccttctcactggctgttttcgaagataaagtattctggactgatattataaacgaagcaattttttccgccaacaggctgacagggtccgacgtgaacttgctggcagaaaacttgttgagccccgaggatatggtcctcttccataaccttacccagccaagaggtgtcaactggtgcgagcgcacaacactgtcaaacggcggttgccagtacctgtgcctgccggccccgcagatcaaccctcacagccctaagtttacctgtgcatgccccgatggaatgcttcttgcacgggatatgaggtcctgtctgactgaggctgaagcggccgtggcgacacaagagaccagcacggtcagactgaaggttagtagcaccgctgtgaggacacagcacactactactaggcccgtgccagacacatcacggctgcccggggccacccccgggctgacaactgtggaaatagtgacgatgagccaccaggctttgggcgatgtggcaggaagaggcaatgagaagaaacccagcagtgttagggccctttctattgtactgcccatcgtgctgctggtttttctgtgcttgggtgttttcctcttgtggaaaaactggagactgaagaacatcaacagcattaactttgataaccccgtctaccagaaaaccacagaagatgaggtgcacatatgtcacaatcaggatgggtatagctacccctctcgccaaatggtgtcactggaagacgatgtggca

SEQ ID NO: 609 - DNA, 2580 bp, Artificial Sequence
  Description of Artificial Sequence: Synthetic Transcript Sequence
atgggcccgtgggggtggaaactacggtggaccgtggccttgttgctggcagccgctggcaccgctgtgggcgacagatgtgagcggaacgagttccagtgtcaggacggtaagtgcatctcctacaagtgggtgtgcgatggcagtgctgagtgccaggacgggtctgacgagtcgcaggaaacgtgtctgagcgtgacctgcaagtctggtgatttctcatgtggagggagggttaaccgctgtataccgcagttctggaggtgtgatgggcaagtagactgtgataacggaagcgacgagcagggctgtcctccgaaaacatgcagtcaggacgagtttcggtgccacgacggtaagtgcatctccagacaattcgtctgcgactccgacagggattgtctggatggatccgatgaggcctcctgccctgtactcacctgtggccccgcctcgtttcaatgcaatagctctacgtgtattccccagctctgggcctgcgacaacgaccctgactgcgaggacgggtctgacgagtggcctcagagatgccgtggactgtacgtgttccaaggagactcctctccgtgttctgcttttgagttccattgcctctccggcgagtgcatccacagtagttggaggtgcgatggcggaccggactgtaaggacaaaagcgacgaagagaattgcgccgtggctacctgcaggcccgacgagttccagtgcagcgacgggaattgcatccatggtagccggcagtgtgaccgggaatatgactgtaaagacatgtcggatgaggtgggttgcgtaaacgttacactgtgtgagggcccaaacaaatttaaatgccattctggggaatgcattaccctcgacaaagtgtgtaacatggctagggattgtagagattggtctgatgagcccataaaagagtgtggtaccaatgagtgccttgacaataatggtggctgttctcacgtgtgtaacgatttgaagatcggagccgaatgtctatgtccggatgggtttcagttggttgcccagcgacggtgcgaggatattgatgagtgccaggatcctgacacctgctcccagctctgtgtcaacctggaaggaggctacaagtgccaatgcgaagaaggttttcagctggacccacacactaaggcatgcaaagccgtgggatctatagcgtaccttttcttcacgaatcgccatgaagttcggaagatgaccctggaccggagcgaatacactagtctgattcccaacctgcgtaatgttgtagctcttgacacagaagtcgcttccaatcgtatttactggtctgacttgtcacagaggatgatctgctcgacacagttggaccgcgcccatggagtgtccagctatgacacagtgatatcaagagatatccaagcccctgacggactagcagtggattggattcactccaacatttactggactgactcagtgctgggcacggtgtccgtcgctgacactaagggggtgaaacgaaaaaccctgttcagagaaaatggaagcaagccacgggcaattgtggttgaccccgttcatgggtttatgtactggactgactggggtaccccagctaaaatcaaaaaaggagggcttaatggcgtcgatatttactcgcttgtgacagaaaacattcaatggcctaatggaatcactctggacctgctaagcggaagactgtactgggtcgattcaaagctgcactctatcagctccatcgatgtgaatgggggtaataggaaaaccattctcgaagacgagaagcggttggcccaccccttctccctcgcggtatttgaagacaaagtgttttggactgacattatcaatgaggctatctttagcgccaatcggctaacaggctccgacgttaatttgctggctgaaaatctgttatctcccgaggatatggtcttatttcataacctaacacagccaagaggcgtcaattggtgtgagaggaccacgctgtccaatgggggctgccagtatctctgcctccctgctccgcagatcaacccccattctccaaagttcacatgcgcctgccccgacgggatgctgctggccagagacatgaggagttgtctcaccgaagccgaagctgcagtggctacgcaggagacttctaccgtacgactgaaagtgtcatccactgcggtcaggacgcagcataccacgacaaggcctgtgcctgacacctcgcggctccccggagcaactcccggcctgaccaccgtggaaatagttactatgagccatcaggcgttgggcgacgtggccggcagaggcaacgagaagaagccctcctctgtcagagccctctcaatcgtgctgccaatagtgctcctcgtctttctgtgcttgggcgtgtttctactatggaagaattggaggcttaaaaatatcaactcaattaactttgacaaccccgtttatcagaaaaccaccgaggatgaggtacacatctgtcataaccaggatggctacagctaccccagccggcagatggtcagcctggaggacgacgtcgcc

SEQ ID NO: 610 - DNA, 2580 bp, Artificial Sequence
  Description of Artificial Sequence: Synthetic Transcript Sequence
atgggaccatggggttggaagctcaggtggaccgtggcgttgctcctggctgccgcagggaccgcggtgggtgatcgatgtgagcggaacgagtttcaatgccaagacggtaagtgcatctcttataagtgggtgtgtgacgggtcggccgaatgtcaagatggttcggacgaatcgcaagagacgtgtctgtccgttacctgtaagagtggagacttttcctgcggaggtcgagtgaaccgatgcattccccagttctggcgttgtgatggtcaggtcgattgtgataacggatccgatgaacagggttgcccacctaagacctgttcgcaagatgagtttagatgccatgacggaaagtgtatttccagacagtttgtgtgcgatagcgatagggactgtctggacgggtccgatgaagcaagttgccctgtcctgacctgcggccctgcatcctttcaatgcaattcctcgacttgcattcctcaactctgggcttgtgacaacgatccagactgtgaagatggctcggacgaatggccgcagcgctgtcgtggcctctacgtctttcagggcgacagcagcccttgttcggcatttgaattccactgtctgagcggcgagtgtattcacagcagctggcgatgtgacggaggacccgactgtaaggacaagtcggatgaggagaactgtgcagtggcgacttgcagacctgacgagttccaatgttcggatggtaactgtattcatggctcgagacagtgtgaccgcgaatacgattgtaaggatatgagcgatgaagtcggctgcgtgaacgtcaccctttgtgaaggaccaaacaagtttaagtgtcattccggagaatgcattaccctggataaggtgtgtaacatggcccgagattgcagggactggtcagacgagcccattaaagagtgtgggaccaacgaatgtctggataacaacgggggatgctcgcatgtgtgcaatgatctcaagatcggagcggaatgcctttgcccggatggattccagttggtggcacaaagacggtgtgaggatatcgacgaatgccaagatcctgatacctgctcccagctttgtgtcaacctggagggcggttacaagtgtcaatgcgaggaagggtttcagcttgatccacataccaaggcatgtaaggcagtgggaagcattgcctacctctttttcactaacagacatgaagtcagaaaaatgactttggaccgttcggagtatacctcgcttattccaaatctcagaaacgttgtcgccctcgacaccgaggtggcatcgaaccgtatatactggtcagacttgtcacagaggatgatttgttcgacgcagcttgacagagcacatggtgtgtcctcttacgataccgttattagccgcgacattcaggcccctgatgggcttgcagtggattggatccattcgaacatttactggactgatagcgtccttggtactgtgtcagtggcagatacgaaaggtgttaagagaaaaaccctgtttcgagaaaacggtagcaaacctagggctatcgtggtggatccggtgcacgggtttatgtactggaccgattggggaacccctgccaagataaagaagggtggtcttaacggcgttgacatttactcgctggtgactgaaaacatacaatggccaaatgggattactcttgatcttctgtccggtcggctgtactgggtggactccaagctccattcgatctcgtcaatagatgtcaacggaggaaaccgcaagactatccttgaagatgaaaaaagactggcgcatcctttttcgctcgcagtctttgaagataaggtgttttggactgatatcatcaacgaggcaatattctcagccaatcgtctcaccggttcggatgtcaatctcctggcagaaaatcttctgtcccctgaggatatggtgctttttcataacctgacccaaccacgcggcgtcaattggtgtgaacggactacgctttcgaacggaggttgtcagtacctgtgcctgcctgcccctcagattaacccccactcgcctaagtttacctgtgcatgccccgatgggatgcttctcgcgagagacatgcgctcatgcctgactgaagcagaggcggcagttgcaactcaggaaacgagcactgtgagactgaaagtgtcctccaccgcagtgagaacccaacacactaccacgaggcccgtgccggatacctccagactgcctggtgcgaccccagggcttactaccgtggaaattgtgaccatgtcccatcaggctcttggagatgtggcaggtagaggcaacgagaaaaagccctcctccgtgcgtgcattgtcgattgtgttgcctatcgtcctccttgttttcctctgtcttggcgttttccttctttggaagaactggagacttaagaacattaactcaattaacttcgacaatcctgtctaccaaaagacgacggaagatgaagtgcatatttgccacaaccaagacggatactcgtacccttcacggcaaatggtttcgctcgaagatgacgtggcg

SEQ ID NO: 611 - DNA, 2580 bp, Artificial Sequence
  Description of Artificial Sequence: Synthetic Transcript Sequence
atgggaccatggggatggaagctcaggtggaccgtagccctcctcctggcggcagcgggaaccgccgtgggagatagatgtgaacgcaatgaattccagtgccaggatggaaagtgtatatcgtacaagtgggtctgtgacggtagcgcagaatgtcaagatgggtcggacgagagccaagaaacgtgcctgtctgtgacctgtaagagcggtgatttttcgtgtggaggccgcgtcaacaggtgcattccacaattctggaggtgtgatggtcaggtggactgcgataacggatcagatgaacagggctgtcctccaaaaacgtgctctcaggatgaatttaggtgccatgatggtaagtgcatctccagacaattcgtttgtgattcggatagggattgtttggatggtagcgacgaagcaagctgtccggtccttacctgtggccccgcctcattccaatgtaactcgtcaacctgtatccctcaactttgggcatgcgataacgatccagattgtgaagatggatcagacgaatggcctcaaagatgtcgcgggctctacgtgttccagggtgacagctcgccatgctcggcatttgaatttcactgtctgtccggagagtgcatacattccagttggagatgtgacggtggacccgactgcaaagacaagagcgacgaagaaaattgtgcggtcgcaacttgtagaccagatgaatttcaatgcagcgatggaaactgtattcacggcagcagacaatgcgatcgcgagtacgactgtaaggacatgtccgacgaagtgggctgtgtcaacgtgaccctgtgcgagggtcccaacaaattcaagtgtcactctggcgaatgtataactctcgacaaagtgtgtaacatggctcgggactgcagagactggtctgacgaacctattaaggagtgtggtacgaacgaatgccttgataacaatggtggatgctcgcatgtctgtaatgatctcaagattggcgccgaatgtctgtgccctgatggctttcagttggtggcccaacgtagatgtgaagatatcgatgagtgtcaagacccggacacctgctcccaactgtgtgtgaatctggaaggtggatacaagtgtcaatgcgaggagggttttcagcttgaccctcacactaaggcctgcaaggcggtgggttcgatagcctacctgtttttcaccaaccgtcatgaagtcagaaagatgaccctggacagatccgaatacacctctctgattccaaacctgaggaacgtggtggcactggacactgaggtcgcatccaatcgcatttactggagcgatctgagccagcggatgatatgctctacccagctggatagagcacatggtgtgagctcgtacgatactgtcatttcacgtgatatccaggcacccgatgggcttgctgtggattggatacattccaacatatactggaccgactccgtgcttggaacggtgtcggtcgcagatactaagggggtcaaaagaaaaacgctgtttcgggagaatgggtcaaaacctcgagctatagtggtcgatcctgtgcacggattcatgtattggaccgattggggaactccagcaaagataaagaaaggtggacttaatggagtcgacatttactccctggtcaccgaaaacattcagtggcccaatggcattacgctggacctgctgtccggcagactttactgggttgattcaaagctgcattccatttcgtcgatcgatgtgaatggcggcaatcgcaagactattctcgaagatgagaaaagacttgcgcatcctttttccctcgcagtctttgaggacaaggtgttttggaccgatatcattaacgaggccatcttttcggccaatcgcctgaccggatcggatgtgaaccttcttgccgagaaccttctttccccagaagatatggtcctttttcacaacctcacccaaccacgaggcgtgaactggtgcgagcgtaccactctgagcaatggaggttgtcagtacttgtgtctcccagcgcctcagatcaaccctcattcgcccaagttcacctgcgcatgccctgacggcatgctgctggctcgcgatatgcgcagctgcctcactgaagcagaagccgccgtcgctactcaggaaacgtcaacggtgcggctgaaagtcagctccacggccgtgcgtacgcaacacactactacgaggccggtgccagatacttcccgattgcctggagcgactccaggactcactactgtggaaatcgtgaccatgagccatcaggcacttggagacgtggcaggtcggggcaacgaaaagaaaccaagctccgttagggccttgtcaattgtgctgccaatagtacttttggtgtttctgtgtcttggcgtgttcctgctgtggaagaactggaggctgaagaatatcaactcgattaactttgacaaccctgtgtaccaaaagaccactgaggatgaagttcatatatgtcataaccaggatggatacagctacccttcgcgccaaatggtgtcactggaggacgatgtggca

SEQ ID NO: 612 - DNA, 2580 bp, Artificial Sequence
  Description of Artificial Sequence: Synthetic Transcript Sequence
atgggcccttggggctggaagctgcgctggacagttgcacttctgttggcagctgccggcacagctgtgggggaccgctgcgagcgtaacgagttccagtgtcaggacggaaaatgtatcagctacaaatgggtgtgcgatggaagtgcagaatgccaagacgggtcggacgaatcacaggagacctgtctttctgtgacgtgcaaatctggtgatttttcatgcggcggccgcgttaatcgctgtattcctcaattttggagatgcgatggacaagtagattgcgacaatggcagcgatgaacaagggtgccctccaaagacatgctctcaggatgagtttagatgtcacgatggtaaatgcattagtcggcaatttgtgtgcgacagtgatagggattgcctcgatgggagcgacgaagcaagttgtcccgtcctgacctgcggaccagctagtttccagtgtaatagcagcacctgcatcccgcagctctgggcttgtgataacgacccggactgcgaggacggatcagatgaatggccccagaggtgtcggggactttacgtattccagggagactcttcaccatgcagcgcctttgagttccattgtctgtccggggaatgcatccacagttcttggaggtgtgatggcggcccagattgtaaagataaaagcgatgaggaaaactgcgcggtcgccacctgtaggccagatgagttccagtgctcagacgggaactgcatacacggtagcagacagtgtgaccgagagtatgattgcaaggacatgtctgacgaagtgggctgcgtgaacgtcactctttgtgaaggacccaacaaattcaaatgccactctggcgaatgcatcacactcgataaggtgtgtaacatggccagagattgcagagactggagcgatgagccaatcaaggaatgtggcacaaacgaatgcctggacaacaatggcgggtgcagtcacgtatgtaacgatctgaagataggggccgagtgcctgtgtcccgatggattccagctcgtcgcgcaacgaaggtgtgaagatatcgacgaatgccaagatccagatacctgcagccagctttgtgttaatctcgaggggggatacaagtgccaatgtgaggaaggctttcagctcgatcctcacaccaaagcgtgcaaggccgtcggaagtattgcgtacctcttctttactaacaggcacgaagtacgcaagatgactctggaccggagcgagtataccagtctgattcctaacctaaggaacgtggttgcgctggacacagaggttgcatccaacagaatatactggagcgatctgtcgcaacggatgatctgttcaacccagcttgacagggcccacggcgtgtcaagttacgacacagtgatctcccgcgacattcaggctccggacgggctcgcagttgattggatccacagtaacatatattggaccgatagtgtactgggcaccgtgtctgtcgctgataccaagggcgtaaaacgcaaaactttgtttagagagaacggaagcaaaccaagagcaatcgtggttgacccagtacacggcttcatgtattggaccgactggggaactcctgccaagataaaaaaggggggactgaatggtgtggacatctacagcctcgtcacagagaacatccagtggcctaacggtattactctggatctgctgagcggcaggctttactgggtggatagtaagttgcactccatttcgtcaatcgacgtgaatgggggcaacaggaaaacaatcttggaagatgagaagcgactggcccaccccttcagcctcgccgtctttgaggataaggtcttctggacggacatcataaacgaagctatctttagtgccaataggctgacagggtcagatgtgaatttacttgcagagaatctgctgtcccctgaggatatggtgctgtttcataacctgacacagccgcgaggggtcaactggtgtgagagaaccactttgtccaatggcggctgccagtacctgtgcctgccagctcctcagattaatcctcactcacctaagttcacttgcgcctgccctgatggcatgttgttggccagggacatgcgctcctgcctgaccgaagccgaagctgcggtggctacccaggagacgtcaaccgtgcgtctgaaggtttcgtctaccgccgtgcgcacacaacatactacaacacgtcccgtccctgacacctcccggctccctggcgcaacccctggcctgacaacagttgaaatcgttaccatgagccaccaggctttgggcgacgtggctgggagaggaaatgagaagaaacccagttctgtgagggcgctcagcattgtgctacccatcgtattgcttgtgttcctttgcctgggagtgtttctcctctggaagaactggaggctgaaaaacatcaacagcattaattttgacaaccctgtctaccagaaaaccaccgaagacgaggtccacatttgtcataatcaagacggatacagctacccatctaggcaaatggtgagcctggaagacgacgtcgct

SEQ ID NO: 613 - DNA, 2580 bp, Artificial Sequence
  Description of Artificial Sequence: Synthetic Transcript Sequence
atgggtccgtggggttggaaattacgttggacggtagcgctattactagcggcggcgggtacggcggttggtgatcgatgtgaacgtaatgaatttcaatgtcaagatggtaaatgtatatcgtataaatgggtatgtgatggttcggcggaatgtcaagatggttcggatgaatcgcaagaaacgtgtctatcggtaacgtgtaaatcgggtgatttttcgtgtggtggtcgagtaaatcgttgtataccgcaattttggcgatgtgatggtcaagtagattgtgataatggttcggatgaacaaggttgtccgccgaaaacgtgttcgcaagatgaatttcgttgtcatgatggtaaatgtatatcgcgtcaatttgtatgtgattcggatcgtgattgtctagatggttcggatgaagcgtcgtgtccggtattaacgtgtggtccggcgtcgtttcaatgtaattcgtcgacgtgtataccgcaattatgggcgtgtgataatgatccggattgtgaagatggttcggatgaatggccgcaacgatgtcgtggtttatatgtatttcaaggtgattcgtcgccgtgttcggcgtttgaatttcattgtctatcgggtgaatgtatacattcgtcgtggcgttgtgatggtggtccggattgtaaagataaatcggatgaagaaaattgtgcggtagcgacgtgtcgtccggatgaatttcaatgttcggatggtaattgtatacatggttcgcgtcaatgtgatcgagaatatgattgtaaagatatgtcggatgaagttggttgtgtaaatgtaacgttatgtgaaggtccgaataaatttaaatgtcattcgggtgaatgtataacgttagataaagtttgtaatatggcgcgagattgtcgtgattggtcggatgaaccgataaaagaatgtggtacgaatgaatgtttagataataatggtggttgttcgcatgtttgtaatgatctaaaaataggtgcggaatgtttatgtccggatggttttcaattagtagcgcaacgtcgttgtgaagatatagatgaatgtcaagatccggatacgtgttcgcaactatgtgtaaatctagaaggtggttataaatgtcaatgtgaagaaggttttcaattagatccgcatacgaaagcgtgtaaagcggtaggttcgatagcgtatctattttttacgaatcgtcatgaagtacgtaaaatgacgctagatcgttcggaatatacgtcgctaataccgaatttacgtaatgtagtagcgttagatacggaagttgcgtcgaatcgtatatattggtcggatttatcgcaacgtatgatatgttcgacgcaattagatcgtgcgcatggtgtatcgtcgtatgatacggtaatatcgcgtgatatacaagcgccggatggtttagcggtagattggatacattcgaatatatattggacggattcggttttaggtacggtatcggttgcggatacgaaaggtgttaaacgaaaaacgttatttcgtgaaaatggttcgaaaccgcgtgcgatagtagtagatccggtacatggttttatgtattggacggattggggtacgccggcgaaaataaaaaaaggtggtttaaatggtgttgatatatattcgttagtaacggaaaatatacaatggccgaatggtataacgctagatttactatcgggtcgactatattgggtagattcgaaattacattcgatatcgtcgatagatgtaaatggtggtaatcgtaaaacgatactagaagatgaaaaacgtctagcgcatccgttttcgttagcggtttttgaagataaagtattttggacggatataataaatgaagcgatattttcggcgaatcgattaacgggttcggatgtaaatttattagcggaaaatttattatcgccggaagatatggtattatttcataatctaacgcaaccgcgtggtgtaaattggtgtgaacgaacgacgttatcgaatggtggttgtcaatatttatgtttaccggcgccgcaaataaatccgcattcgccgaaatttacgtgtgcgtgtccggatggtatgctattagcgcgagatatgcgatcgtgtttaacggaagcggaagcggcggttgcgacgcaagaaacgtcgacggttcgtctaaaagtttcgtcgacggcggttcgtacgcaacatacgacgacgcgtccggttccggatacgtcgcgtttaccgggtgcgacgccgggtttaacgacggtagaaatagtaacgatgtcgcatcaagcgttaggtgatgttgcgggtcgtggtaatgaaaaaaaaccgtcgtcggttcgtgcgttatcgatagtattaccgatagttctattagtatttttatgtttaggtgtatttttattatggaaaaattggcgattaaaaaatataaattcgataaattttgataatccggtttatcaaaaaacgacggaagatgaagtacatatatgtcataatcaagatggttattcgtatccgtcgcgacaaatggtatcgttagaagatgatgtagcg

SEQ ID NO: 614 - DNA, 2580 bp, Artificial Sequence
  Description of Artificial Sequence: Synthetic Transcript Sequence
atgggaccatggggatggaagttgcgctggaccgtggccttgctcctggcagccgccgggaccgcggtcggagatagatgcgaaagaaatgaatttcagtgtcaggacggaaagtgcatctcgtacaagtgggtgtgtgatggctcagccgagtgccaggatggatcggatgagtctcaagaaacctgtctgtcagtcacctgcaaatccggagacttctcgtgcggtggacgggtgaaccgctgcatcccccagttctggcgctgcgatggtcaggtggattgcgataacggtagcgatgagcaaggatgccctccgaaaacttgctcgcaagacgagttcaggtgccacgacggaaagtgtatatccagacagttcgtttgcgactcagaccgggactgcctggatggctcggacgaagctagctgcccagtcctgacctgcggcccagccagctttcaatgcaattcatccacttgcattccgcagctgtgggcctgcgacaatgacccggactgcgaagatggatcggacgaatggccgcaaagatgtcgcggactgtacgtgttccaaggagattcgtcgccgtgctcggcgttcgaattccattgcctgtcgggcgaatgcatccacagttcatggcggtgcgacggtggacctgactgcaaggataagtcagatgaagaaaactgcgcagtggctacctgcaggccggacgagttccagtgctcagacggaaactgtatccacgggtcaagacagtgcgatagggagtacgactgtaaggatatgagcgatgaggttggatgcgtgaacgtcaccctgtgcgaaggaccgaacaagtttaagtgccattccggagagtgtatcaccctcgataaagtgtgcaacatggcaagggattgccgcgactggtcagacgaaccaatcaaggagtgcggtacgaatgagtgccttgacaataacggcggatgctcccatgtgtgcaacgatctgaagataggagccgaatgcctgtgtccagatggtttccagctggtggcccaacgccgctgcgaggatatcgatgaatgccaagatccggatacttgctcgcagctctgcgtgaacctggaaggaggatacaagtgccagtgcgaggaaggatttcagctggacccacacactaaagcgtgcaaggctgtcggctccattgcttacctgttcttcactaatagacatgaggtgcgtaaaatgaccctcgaccggtcagaatacacttccctcatcccgaacttgcgcaacgtcgtggccctcgacactgaggtcgcatcgaatcgcatctattggtccgacctctctcagagaatgatctgctcgacccagctcgaccgcgcgcacggagtgagctcatacgacactgtgattagcagagacatccaggcacctgacggactcgccgtggattggatccacagcaacatttactggaccgatagcgtgctggggaccgtgagcgtggcagacaccaaaggggtcaaaagaaaaactctgtttcgagagaacggatcgaagccgcgggcgatcgtcgtggatcccgttcacgggtttatgtactggaccgactggggaaccccggcaaaaatcaaaaagggaggtcttaacggagtggacatttactcgctcgtcaccgaaaacattcaatggccgaacgggatcaccctggacctgttgtctggacggctgtactgggtggattcaaagctgcactccatctcctccatcgatgtcaatggaggaaatcgcaagaccatcctggaggacgagaagcggctggcccacccattttccctggctgtctttgaagataaggtgttctggaccgacatcataaacgaagcgatcttctcagccaaccggctgacgggctcagacgtgaacttgctggcagagaatttgctgtcgccggaggacatggtactcttccacaacctgactcagccgagaggagtgaactggtgcgaaaggactaccctgtccaacggcgggtgccagtacctgtgcttgccggcaccacaaatcaatccgcattcgccaaagttcacctgcgcctgcccagacggaatgctgctcgctagggatatgcgttcgtgcctcaccgaggccgaggccgcggtggcaactcaggagacgtcgaccgtgagactcaaggtgtcatcgaccgccgtgcgcacgcagcatacgactacccgccctgtgccagatacctcgaggcttccaggggccacgcctggccttacgactgtggaaattgtgaccatgagccaccaggctctgggagacgtcgcaggccgcgggaacgaaaagaaaccatccagcgtgcgcgccctcagcatcgtgcttcccatcgtgctgttggtgttcctctgccttggagttttcttgctgtggaagaactggcggctcaagaacatcaactccatcaacttcgataatccggtctaccaaaaaactaccgaagatgaagtgcacatctgtcataaccaggacggatactcatacccttcacgccagatggtgtctctggaagatgacgtggcg

SEQ ID NO: 615 - DNA, 2580 bp, Artificial Sequence
  Description of Artificial Sequence: Synthetic Transcript Sequence
atgggtccttgggggtggaaactgcggtggacagtggccctgcttcttgctgccgcgggcacagcggtgggagataggtgtgaacgaaacgagttccagtgccaggacgggaaatgcatctcttataagtgggtatgcgacggcagtgctgaatgccaggacggctcagacgagtcccaagagacatgtttatccgtgacgtgtaagagcggcgacttttcatgtggaggaagagtgaatcgctgcatccctcagttttggcgctgtgacggccaggtggattgcgacaacgggtccgacgagcaaggctgtccaccgaaaacctgctcccaagacgagtttagatgccacgacggaaagtgcatctctaggcagtttgtatgcgattccgatagagattgcctcgacggttcggacgaagcttcctgccccgtgctgacctgcggaccagcctccttccagtgtaatagttcgacctgcatcccccagctgtgggcatgtgacaatgatccagattgtgaggacggttctgatgagtggccacagaggtgccggggcctctatgtttttcagggtgacagctctccatgtagcgcctttgagttccactgcctgagtggcgagtgcatccactcatcctggaggtgcgatgggggcccagactgtaaggacaagtccgacgaggaaaactgcgccgtggcaacatgtcggccagacgagtttcagtgctctgacggaaactgtatccatggatctcgccagtgtgatcgggagtatgattgtaaggacatgagtgatgaggtgggatgtgtgaacgtgactctttgcgaaggtcctaacaagttcaagtgccattcaggggagtgtattacgttagataaagtctgcaatatggctcgcgactgccgggattggtcagatgaacctatcaaagaatgtggcacaaacgaatgtcttgataacaatgggggttgttcacatgtgtgtaacgacctcaagatcggggccgagtgcctatgtccagacggctttcagctcgtcgcacagaggcgctgcgaagacattgatgaatgtcaggatcccgacacttgtagccagctctgtgttaaccttgagggtgggtacaaatgccaatgtgaggaagggtttcagttggacccccacaccaaggcgtgtaaagcggtgggttctatcgcttatctgtttttcactaatcggcacgaggttaggaagatgactctggacaggtcagaatacactagtctgattccaaacctgcgcaacgtagtggccctcgataccgaggtggcctcaaaccgtatctattggtccgacctgagccagcgtatgatctgttctacccagcttgaccgggcacacggcgtctcttcttatgataccgtcatctccagagacatccaggcgcctgatggactagcagtcgactggatccactccaacatatactggaccgacagcgtgctgggaactgtttccgtggctgataccaagggcgtgaagagaaaaactttattccgggagaacggctctaagccaagagcgatcgtcgtagatccagttcacggattcatgtattggacagattggggtaccccagcgaaaataaagaaaggtggattgaatggagtagatatctacagtttggtcaccgagaacatccagtggccgaacggtatcactcttgatctgttgagtggacgattatattgggtggactcgaagctgcacagcatctcatcgatcgatgtgaacggtggaaaccggaaaacgatacttgaggatgagaaacggttagcgcacccttttagtttggccgtgttcgaagacaaggtcttttggaccgacattatcaacgaggccatcttctctgccaaccggctaactggaagcgacgttaacctactggcggagaacctgttgtccccagaagacatggtcctgttccacaatttgacacagcctaggggggttaactggtgcgagcgaacaacgctgagcaacgggggatgtcagtatctctgcctgccggccccccaaattaatccccactccccgaagttcacgtgcgcttgccccgacggtatgctactcgctagagatatgcggtcatgtcttacagaagccgaggctgccgtggctacgcaggagacttcaactgtgcgactgaaggtgtccagtaccgccgttaggacccagcacactactacgagaccagtcccagatacttcacgcctgcccggggccacacctggcctgacaacagtcgagatagtgaccatgagccaccaggcgctgggagatgttgctggaaggggcaacgaaaagaagccgagttcagtgcgggccctatccattgttttgcccatcgtcctgctggtatttctctgtttgggggtttttctgctctggaaaaactggcggctcaagaacattaactccattaattttgacaacccggtctaccagaagacaactgaggacgaggttcacatctgtcacaaccaggacggctacagctacccatctcgtcagatggtgagcctggaagatgatgtcgcc

SEQ ID NO: 616 - DNA, 2580 bp, Artificial Sequence
  Description of Artificial Sequence: Synthetic Transcript Sequence
atggggccgtggggttggaaactgaggtggaccgtggccctcctgctcgcagccgctgggaccgcggtgggagatcgttgcgagcggaacgagtttcagtgtcaggacgggaagtgcatctcttacaagtgggtgtgcgacggatccgcagaatgccaagacgggtccgatgaatcccaggaaacctgcctgtccgtgacgtgtaaatcaggggatttttcctgcggcggacgcgtgaaccgttgcatccctcaattttggaggtgtgacggacaggtcgactgcgataatggcagcgacgaacaaggctgccctccaaagacttgcagccaggatgagttccggtgtcacgacggcaagtgcatctcgaggcagttcgtctgcgactcggacagagactgcctggatggtagcgacgaggcctcctgtccggtgctgacttgcggcccggcctccttccagtgcaactcatccacttgcataccgcagctgtgggcgtgcgacaacgatccggactgcgaggacggttccgacgaatggccgcagcgctgtcgcggactctatgtctttcaaggagactcgagcccttgctcggcgttcgaattccactgcctgtccggagaatgcatccatagctcatggaggtgcgatggtggcccggattgcaaggacaaatctgacgaggaaaactgtgcagttgcgacttgcaggccagatgaattccagtgctccgacggaaactgtatccacggatctcggcagtgtgatcgcgagtacgactgcaaagacatgtcagatgaagtgggctgcgttaatgtgaccctctgcgaaggaccgaataagttcaagtgccactccggagagtgcatcactctggataaggtgtgcaacatggcccgggattgccgcgactggtcggacgaacctatcaaggagtgtggaactaacgaatgcctggataacaacgggggctgctctcacgtgtgcaacgatctcaaaatcggagccgaatgcttgtgccctgatggcttccagctcgtggcgcaaagacgctgcgaagatatcgatgaatgtcaagaccccgacacctgtagccagctctgtgtgaacctcgagggagggtataagtgccaatgcgaagaaggattccagcttgacccccacaccaaggcatgtaaagccgtgggctccattgcgtacctcttcttcaccaacagacatgaggtcagaaaaatgactctggatcgctcagaatacacttccctcatcccgaatctgagaaatgtcgtggcactggacactgaagtggcctcgaaccggatctactggagcgacctctcccagcgcatgatctgtagcacccaactggaccgcgcgcatggggtgtcaagctacgatactgtgatttcacgggatattcaagcgccggacggactggccgtagactggatccattcaaacatctactggaccgatagcgtgctgggcactgtgagcgtcgcagatactaagggagtcaagagaaagacgctcttccgggaaaacgggtcgaagccaagagcaatcgtggtcgaccctgtacacgggttcatgtactggacggactggggaaccccggccaaaatcaagaagggagggctcaatggggtcgacatttactccctggtgaccgagaatatccagtggcctaacgggatcaccctcgatctgctttcgggtcgcctgtactgggtggatagcaagctgcatagcatatcatcgatcgacgtgaacggagggaatcgaaagaccatcctggaggacgaaaagcgcctggcccacccgtttagcctggccgtgttcgaggacaaggttttctggaccgacatcatcaatgaggcgatcttttccgcgaatcggctgaccggctcagatgtgaacctgctcgcggaaaatctcctgtcgccggaggatatggtcctcttccataaccttacccaaccccgcggcgtgaattggtgtgagcggactaccctgagcaacggcggatgccagtacctctgcctgccagcaccacagattaatccgcacagccctaagtttacctgcgcttgccctgatggaatgttgctcgcacgggacatgcggagctgcctcaccgaggctgaggctgcggtcgctactcaagagacttcgaccgtccggctgaaggtgtcatctacggcagtgcgcacccaacatactactacccggccagttccagatactagccgcctgccaggtgcaactccaggtctgactactgtggaaatcgtgaccatgagccaccaggccctcggtgacgtcgccggacgcggcaatgaaaagaagccaagctccgtgcgggcactctcgatcgtcctccccatcgtgttgctggtgtttctgtgcctcggagttttcctgctgtggaagaattggcgcttgaaaaacataaactcgatcaacttcgacaatccagtgtaccagaaaacgaccgaggacgaggtgcacatctgccacaatcaagacggatacagctacccgagccgccaaatggtgagcctggaggatgatgtggct

SEQ ID NO: 617 - DNA, 2580 bp, Artificial Sequence
  Description of Artificial Sequence: Synthetic Transcript Sequence
atgggaccttggggatggaaacttcgctggaccgtggcgctgctcctcgccgcggccggaaccgccgtcggcgatcggtgtgagcgcaacgaattccaatgccaagatggcaaatgtatctcatataagtgggtctgcgacggctccgctgaatgtcaggacggatctgatgagtcacaggaaacttgcctgtcagtcacttgtaagtcgggcgatttctcctgcggaggccgggtcaacaggtgcattccacaattctggcggtgcgacggtcaggtggattgcgacaatggatcagatgaacagggatgcccgcctaagacttgttcgcaggatgaattcagatgccacgacggaaagtgcatttcacgccagtttgtctgcgattctgaccgcgattgccttgacggctccgacgaggcgtcctgcccagtgctgacctgtgggcctgcgtcctttcaatgcaactcctcgacgtgtatcccgcagctgtgggcttgcgacaacgacccagattgcgaagatggctcagatgagtggccccaacgctgtaggggactgtacgtgtttcaaggagactcttcaccatgctcggcatttgaattccactgcttgagcggagaatgcatccacagctcgtggcgctgcgatggcgggccagactgcaaggacaagtccgatgaagaaaactgcgctgtggcgacctgcagaccagatgaatttcagtgctcggatggcaactgcatccatggctcacgccagtgtgaccgggagtacgactgcaaagatatgtcggacgaagtgggttgcgtcaacgtgactctgtgtgaaggaccaaacaagttcaagtgtcactcgggagaatgcattactctggacaaagtctgcaatatggctagagactgcagggattggtcggacgaaccaatcaaggaatgtggaaccaacgagtgcctggacaataacggaggatgctcccacgtctgcaatgatctgaagatcggggccgagtgcctctgccccgacggctttcagctggttgcgcagaggcgctgtgaagatatcgacgaatgccaagatccagacacctgctcgcagctgtgtgtgaatctcgagggcggatacaagtgtcaatgtgaggaggggttccagctggatccccacaccaaggcatgcaaggcagtcggctcgatcgcctacctgttcttcactaatcgccacgaggtgcggaagatgactctggaccggtcagagtatacgtcgctgatacccaatctccggaatgtggtggccctggacactgaagtggcttcgaacagaatctactggagcgatctctcgcagagaatgatctgtagcacccaactggaccgggcccatggagtgtcaagctacgacactgttatttcacgtgatattcaggcgccggacggtttggctgtggactggatccactccaatatctactggacggacagcgtcctgggcaccgttagcgtggcggatactaaaggcgtgaagaggaaaaccctctttagggaaaatggatccaaaccgcgagcaatcgtggtggatccggtccacggattcatgtattggaccgattggggaaccccggctaagattaagaaaggaggactcaacggagttgacatttactctctcgtgaccgagaacatccagtggccaaacggaatcactctggatctgctgtcaggcagactgtactgggtcgactcgaaactccactcaatctccagcatcgatgtgaacggcgggaatcgcaaaactatcctcgaagatgaaaagaggctggcacacccgttctccctggccgtgttcgaggacaaggtgttctggaccgacatcatcaacgaagccatcttctcagcgaatcggctgactgggagcgacgtgaacctgctcgccgaaaatctcctgtcaccggaggacatggtgttgttccataacttgactcagccaagaggcgtgaactggtgcgaaagaactaccctgtccaacggtggatgccagtacctgtgcctcccggctcctcagattaatcctcactcgccgaagttcacttgtgcgtgtccggatggtatgctgttggcccgtgatatgcgctcctgtctgactgaggcagaagcagcggtcgccactcaggaaacctccaccgtgcggctcaaggtgtccagcaccgcagtgcggactcaacatacgactactcggccagtgccagatacctcacggctgccgggggcgactccgggtctgaccaccgtggagatcgtcacgatgtcccaccaggcactgggagacgtggccggaagaggcaacgagaagaaaccctcatcggtgagagcactgtcaattgtgctgcccatcgtcctgctggtgtttctgtgcctgggcgtattcctcctgtggaaaaactggcgcctgaagaacatcaactcgattaacttcgacaatcccgtgtaccagaaaaccaccgaggacgaagtgcacatctgtcacaaccaagacggatacagctacccttcgagacagatggtgagcttggaagatgacgtggcg

SEQ ID NO: 618 - DNA, 2580 bp, Artificial Sequence
  Description of Artificial Sequence: Synthetic Transcript Sequence
atgggcccgtggggatggaaacttcgatggactgtcgcactgctcttggccgccgccggtacagcagtcggcgatcggtgtgagaggaacgaattccagtgccaagacgggaaatgcatcagttacaaatgggtctgtgacggctccgccgaatgccaggatggtagcgacgaatctcaagagacttgcctcagcgtgacctgcaagagtggggatttcagctgcggcggtcgggtcaatagatgtattcctcagttctggcgatgtgacggtcaggtagattgcgacaatggctccgatgagcaagggtgccctcctaaaacatgttctcaggatgagtttcgatgtcacgacgggaaatgtatatctaggcaattcgtttgcgactctgatagggactgtttggacggatccgacgaagctagttgtcctgtgcttacttgtggacctgcgtcatttcagtgtaatagttcgacgtgcatacctcagctctgggcctgtgataatgaccctgattgcgaagatggatcagatgagtggccacagcgatgccgtggcctgtatgtctttcagggcgatagttctccctgcagcgccttcgaattccactgcctgtctggcgaatgtattcacagctcatggcgatgcgacggtggaccagattgtaaagacaagtcggatgaggagaactgtgcagtggcgacctgtaggcctgatgagttccaatgttcagatggcaactgtattcatggaagtcgacagtgcgatagggagtatgattgcaaagacatgtcagatgaagttggctgcgtaaacgtcactctgtgtgaggggcccaacaagttcaaatgccattccggtgaatgcatcacgctggataaagtgtgtaacatggctagggactgcagggattggtctgacgagccaatcaaggaatgcggaactaatgagtgcctagacaacaatggaggatgtagccacgtgtgcaatgatctgaaaattggtgcagagtgcctgtgccctgacgggtttcagctcgtagctcagcgaaggtgcgaggacattgatgaatgccaggatccagacacgtgttcacagctatgtgtcaacctggagggtggatataagtgccagtgcgaagaaggttttcagctcgacccccacacaaaggcttgtaaagccgtgggttccattgcttacctgttcttcaccaatcgacacgaagtgaggaagatgacccttgacagaagcgaatacacctcgttaatccctaatctccgaaacgttgtagctctggacaccgaggtggcctccaaccgaatctattggagtgacctcagccagcgaatgatctgttccacccagcttgacagggcgcatggtgtatcgtcttatgacaccgtgatctcacgagatatccaggcccctgacggactggccgtcgattggatccactccaatatttactggactgattctgttctggggactgtctccgtggccgatacaaaaggtgtgaaacgaaagaccctctttagagagaacgggagcaagccgagagctatcgtggtggaccctgtgcacgggtttatgtattggaccgattgggggacccccgccaagattaaaaagggcggcctgaacggagtagatatttacagccttgtgaccgaaaatattcagtggccaaatggcatcaccctggatcttctcagcggccgactgtattgggtagatagtaaactacacagcatatcaagtattgacgttaacggaggtaacaggaaaactatcctagaagacgaaaaacgcctggctcacccattctctctggccgtctttgaggacaaggtgttttggacggatattatcaacgaagcaatcttcagtgctaatcgattgacaggcagtgacgtgaacctgctggcagaaaatctcctgtcgcccgaagatatggttctgttccacaatttgactcagccgagaggagtaaactggtgtgagcgtacaacgttgtcgaatggggggtgtcagtatctgtgcttgcccgcaccccagattaatcctcactctcctaagttcacctgtgcatgcccggacggaatgttgttggccagagacatgcgaagctgcctaaccgaggcggaggccgcagtggcgacacaggaaacctcaaccgtcaggcttaaggtgagttccaccgcagttagaacacagcacacaaccactcgacctgtgcccgacacctcacgacttccaggggcaaccccaggactgacgacagtcgagatcgtgacgatgtcccatcaggccctcggagatgtggcaggccgaggtaacgagaaaaagccttcatcagttcgggcattgagcatagtcctgccaatcgtgctgctggtgttcctgtgtctgggtgtgtttctgctgtggaagaactggaggttaaagaacatcaactcaattaactttgacaatcccgtttatcagaaaaccacagaggatgaagtgcatatctgccacaatcaagacgggtatagctatccttctaggcagatggtgtcactggaggatgacgtcgct

SEQ ID NO: 619 - DNA, 2580 bp, Artificial Sequence
  Description of Artificial Sequence: Synthetic Transcript Sequence
atggggccatggggatggaaattgcgatggacagtcgccttactgttagccgcagctgggacagcagtgggggatagatgtgaaagaaacgaattccagtgccaagatggaaaatgtatctcttataaatgggtctgcgatggaagtgcggaatgccaggatgggtcagacgaatcccaagaaacttgtctctcagtcacatgcaaaagtggggatttttcctgtgggggaagggtcaaccgatgcatcccccagttttggcgctgcgatgggcaggtagattgtgataacggatcagatgaacaggggtgccctcccaagacatgctcgcaggatgaatttaggtgccatgatgggaaatgtatctctagacagttcgtgtgtgattcagatcgagactgtctcgatggatccgatgaagcctcgtgtcccgtgcttacatgtgggccagcatcctttcagtgcaactccagtacttgtatcccacagctctgggcttgtgataacgatcctgactgcgaggacgggtccgatgaatggccgcagcgctgtagggggctttatgtctttcagggggattcctcgccttgctccgcttttgaatttcactgcctctcaggggagtgcatacattcatcttggcgatgtgatgggggacccgactgtaaagataagtctgatgaagaaaattgcgctgttgccacgtgccgtcccgatgaattccagtgttctgatggaaactgtattcacggatcccgacagtgcgacagagaatatgattgcaaagatatgtccgatgaggtggggtgtgttaacgtaacactctgtgaaggacccaacaaatttaaatgccactcaggggaatgtattactcttgataaggtgtgtaatatggcacgggattgccgggattggtccgatgaacccatcaaagaatgtgggacaaacgaatgcctggataataatggaggatgttctcatgtttgtaacgatttaaaaataggagccgaatgcctctgtcctgatggatttcagttggtcgcccagcggcgatgtgaagatatagacgaatgccaggatcccgatacttgctcacagctctgtgtcaacttggaagggggatataaatgtcagtgtgaagaaggatttcagttagatccacacactaaagcttgtaaagccgtgggatccatcgcctatctctttttcacaaaccggcacgaggtgagaaaaatgactctcgacaggtctgaatatactagtctgataccaaatctcaggaatgttgtggctctggatacagaagttgcttcaaatagaatctactggtcagatctctcacagcgcatgatttgttccacacagctcgatagggctcacggggtctcatcatatgatactgttatatctcgtgatatacaggctcccgatgggctcgccgtcgattggatccactctaatatatattggactgattccgtcctcggaacagtctccgtcgctgacacaaaaggggtgaaaaggaaaactctctttagagagaatggaagtaagccacgagccatagtggtggatcctgtacatgggtttatgtattggactgattggggaacacccgccaaaatcaaaaaagggggacttaatggggttgatatctattcattggtaacagaaaatatccagtggcccaacgggatcactttagatcttctatccggacggctgtactgggtcgactcaaaactccattcaatctcttccatagatgtgaacggagggaatcggaaaacaatcttagaggatgaaaaacgcttagcccaccccttctctctcgcagtatttgaagataaagtcttctggactgatatcatcaacgaagcaatattctcagctaaccgattaactggatcagatgtcaacctcctcgctgaaaatctgctgtcacctgaagatatggtcttattccacaaccttactcagcctcggggggtcaattggtgtgaaaggactacactctctaatggggggtgtcagtacttatgtttgcccgcacctcagatcaatccacactctccaaaattcacatgcgcttgtcctgatggaatgttgcttgcacgcgatatgaggtcgtgtctcacagaagctgaagcagctgtggcaactcaggaaacttctacagtgaggctcaaagtttcctctactgcagttcgcacacagcacacgacgacacgcccagtgcccgatacttccagactacctggagccactcctggattgactactgtggagatagtaactatgagtcatcaggcactaggggatgttgcggggagaggaaacgaaaaaaaaccatcctcagtacgggccctttctattgttctgcccattgttctcctggttttcctttgcctgggagtttttctcctctggaagaattggaggctcaaaaatattaattctatcaactttgacaacccagtctatcagaaaacaacagaagatgaggtgcatatatgtcacaaccaggatgggtattcatatccttcgaggcagatggtctctcttgaagatgacgtagct

SEQ ID NO: 620 - DNA, 2580 bp, Artificial Sequence
  Description of Artificial Sequence: Synthetic Transcript Sequence
atgggaccttgggggtggaagctgcgttggacggtagctctcctgctagccgccgccggaactgccgtgggtgacagatgcgaacgtaacgagttccagtgccaggacggaaaatgcatctcttacaagtgggtctgcgatgggagtgccgagtgccaggatggctctgacgagagccaggaaacatgcctgtctgtgacatgcaaatcaggagatttctcctgcgggggccgcgtgaataggtgcatcccgcaattctggagatgcgatggccaagtggactgtgacaatggcagtgacgagcaagggtgccccccaaagacatgctcacaagacgagttccggtgccatgacggaaaatgcatctctagacaatttgtgtgcgattctgatcgcgattgccttgacgggagtgacgaagcctcatgtccagtcttgacttgtggaccagctagtttccagtgtaattcgtcgacttgcatcccccagctgtgggcctgtgacaatgacccagactgcgaggacggatcagacgagtggcctcagagatgcagggggctgtatgttttccagggggattcctccccttgttctgccttcgagtttcattgtctgtccggggagtgcattcattccagttggcgatgtgacggtgggcctgactgtaaggacaagtcggacgaggagaattgcgccgtagcaacctgccggccagacgagtttcaatgctctgatgggaactgcatccatgggagccggcagtgtgacagggagtacgattgcaaagacatgtccgatgaagtgggttgcgtgaacgtgaccctgtgtgaaggtcctaacaaattcaaatgtcatagcggagaatgcataaccttggataaggtatgcaacatggcccgggattgccgagactggtcagacgagccaattaaggaatgcgggaccaatgagtgcttggacaacaatggcggctgttctcacgtgtgcaacgacttaaaaataggagcagagtgcctttgccccgacggatttcaactggtagctcagcgccggtgcgaagacatagacgaatgccaggaccccgatacatgttcccagctgtgtgtgaacctagagggcggatacaagtgtcagtgtgaggagggctttcaactggatccccacaccaaggcctgtaaagctgtcggctctatcgcctacctgttcttcactaaccgccacgaggtaagaaagatgactctcgaccggagtgagtacacatccctgatcccaaaccttcgcaatgtcgtggctctggacacggaggtagcttcaaatagaatttactggtccgatttatctcagcggatgatttgctccacacagctggaccgggcccacggggtctcgtcatacgataccgtcatatctcgcgatattcaggcaccagatggattagcagtcgactggatccactccaatatttattggaccgatagcgtcctgggaacagtttccgtggcagataccaaaggcgtcaaacggaaaacattattcagggagaatggatcaaaacctcgagcgattgttgtcgacccagtgcatgggttcatgtattggacagattggggcaccccagcgaagatcaaaaagggggggctaaacggcgtggatatatacagcctcgtcacagagaatatccagtggcccaatgggattacactcgatttgctgagcgggcgcttgtattgggtggactcgaaactccattctatcagttctatcgatgtgaatggcggaaatcgtaagacgatccttgaggacgagaagaggctcgctcatccattctcactggccgtgtttgaagacaaggtgttctggactgacatcatcaatgaagccatattctccgcaaaccggctgactggcagcgacgtgaacctgctggctgaaaatctcctcagtccggaggatatggtcttgtttcataacttgacccaaccccgaggagtcaactggtgtgaaaggacaactctcagtaacggcgggtgccagtacctgtgcctgccagccccgcaaattaatccccacagccctaagtttacttgcgcttgcccagacgggatgctgttggcccgggatatgcgtagctgtcttactgaagctgaagcggccgtggcaacccaggagactagtacggttcgtcttaaagtgagcagcaccgccgtgagaacccagcataccactacacggcccgtgcctgacaccagtagactgcccggggcaacacccggccttaccacagtcgaaatagtcaccatgtcacatcaagctctcggcgacgttgcagggagaggcaatgagaaaaagccaagttccgtgcgggccctgtctatcgtacttcccatagtcctgttggtgttcctctgcctcggtgtctttctcctgtggaaaaactggcgcctgaaaaacatcaacagcataaattttgacaatccggtctaccaaaagaccaccgaggacgaagtgcatatctgccataatcaggatgggtactcttatccatccaggcagatggtgtcactggaagatgacgtggcc

SEQ ID NO: 621 - DNA, 2580 bp, Artificial Sequence
  Description of Artificial Sequence: Synthetic Transcript Sequence
atgggaccctggggatggaagctgcggtggactgtggcgcttctcctagcagctgccggaactgccgtgggagatcgctgcgagcggaatgaattccagtgccaggatggaaaatgcatatcctacaaatgggtgtgcgatgggtccgctgaatgccaagacggatctgatgaaagtcaggaaacttgccttagtgtcacatgcaaatccggagatttttcttgcggggggcgggtaaatagatgcattccacagttctggaggtgtgatgggcaggttgattgcgataatggatccgacgaacaggggtgtcctcctaagacgtgctctcaggatgaattccggtgccacgacggaaaatgtattagtagacagttcgtttgtgacagtgatagggattgcctagatgggtctgacgaagcatcctgccccgtcctcacttgtggacccgcttccttccagtgcaattcctctacatgcatccctcagctgtgggcctgcgataacgatcccgattgtgaagacgggtccgatgaatggccccagaggtgtcgggggctctacgtgttccagggagattcttccccttgctccgcttttgaatttcattgtttatccggagaatgtatccattcctcatggcggtgcgatggagggcctgattgcaaagataaatctgatgaagaaaattgtgccgtagctacatgccggcctgatgaattccaatgttctgatggaaattgcatccatggaagtaggcagtgtgatcgcgaatatgattgtaaagatatgtccgatgaagtcgggtgtgttaatgtgacactgtgtgagggacctaacaaattcaagtgccactctggagagtgtattactctcgataaagtctgtaacatggcacgtgactgcagggattggtccgatgaacccatcaaagaatgtggaacaaatgaatgtcttgataacaatggaggatgcagtcatgtgtgcaatgacctgaaaatcggagctgaatgcctctgtccagatggattccagctggtggcacagcgccggtgcgaagatattgatgaatgtcaggatccagatacttgctcccagttatgcgtgaacctggaggggggatataaatgccagtgcgaagaaggattccagctcgatccacacacaaaagcctgtaaagctgtggggagtatcgcctatctctttttcacaaacaggcatgaagtacgcaaaatgactttagatcggtcagaatatactagtttaataccaaatcttaggaacgtggtagctctcgacacagaagtagcgtctaaccggatctattggtcagatctaagtcagcgcatgatctgtagtactcaactcgatcgggcacatggagtatcctcttatgatacagttatatcacgcgatattcaggcacctgatggactcgcggtggattggattcacagtaatatctactggactgattcagtcctgggaactgtcagtgtagcagatactaaaggggtgaaacgaaaaactctttttcgggaaaatgggtccaaaccacgcgccatcgtggtggatcccgttcatggatttatgtactggactgattgggggactcccgccaaaatcaaaaaaggagggcttaacggagtggacatatattcccttgtgacagaaaatatacagtggcccaatgggataacactcgacctgctgtccggaaggctatactgggtagattccaagctgcactcgatatcttccatcgatgtcaacggaggaaaccggaagactatccttgaagatgaaaaaaggctggcccaccccttctctctcgccgtgttcgaagacaaggtcttttggactgatatcataaatgaagctattttttccgctaaccgactaactgggagtgatgtgaatctcctagctgaaaacctcctttcacctgaagacatggtgctctttcataatttaacacagccaaggggagtaaattggtgtgaacggacaactctatcaaatggagggtgccagtacctttgcctccccgcccctcaaatcaatccacatagtcccaaatttacatgtgcctgtcccgatgggatgctactggctcgggatatgcgatcttgtctcacagaagccgaggcagccgtggccacacaggagacttctacagtccggctaaaagtgtcgagtacagctgttaggacacagcatactacaactcgccccgtacccgatacaagtcggctcccaggggccacacctggattaacaacagtggaaatcgtaacaatgtctcaccaggccttgggggatgtcgcggggcgcgggaacgaaaaaaaaccctcctctgtgagggcattaagtattgttctgcctatcgtcctccttgtcttcctatgcctcggagtattcctgctttggaaaaactggcgactgaaaaatatcaatagtatcaatttcgataatcccgtttaccaaaaaacaactgaagatgaagtgcatatatgccataaccaggatgggtactcttatccaagtcggcagatggtgtctctggaagatgatgtggct

SEQ ID NO: 622 - DNA, 2580 bp, Artificial Sequence
  Description of Artificial Sequence: Synthetic Transcript Sequence
atgggtccttggggatggaaacttcggtggactgtcgcgctgctgttggctgccgcgggcacggcggtaggtgatcgctgcgaacgaaacgagttccaatgccaagacggcaagtgtattagctacaaatgggtctgtgacggctctgcggaatgccaagatggctctgatgagagccaggaaacgtgtctgagcgttacttgtaagagtggggacttcagctgcggtggacgagttaaccgctgcatacctcagttttggcgatgcgatggccaggttgattgtgataacggttcagatgaacaaggttgtcctccgaaaacctgcagccaagatgaattcaggtgccacgatgggaagtgtatctcccgccagttcgtttgtgattctgaccgggactgcttggacggatctgacgaagccagctgcccggtcctgacttgtggccctgcctcgtttcagtgcaactctagcacttgcattccacagctgtgggcgtgcgataacgaccctgactgcgaggacggcagcgatgagtggccccagcgttgtcgaggtctgtacgtgttccaaggcgacagctccccttgttctgcctttgagtttcattgcttgagcggcgaatgcatacactcttcttggcgctgtgatgggggcccggattgtaaggacaagagtgacgaagaaaattgcgccgtggcgacctgccgtcctgatgagtttcagtgctctgatggtaactgtattcacggcagccgccaatgtgatcgcgaatacgactgtaaagatatgagcgatgaggtgggctgtgttaacgtcaccctgtgtgagggtcctaataagttcaagtgtcatagcggagaatgtattactttggacaaagtttgtaacatggcacgcgattgccgcgactggagtgatgagccgattaaggagtgcggcactaacgagtgcctggacaataacggtgggtgctctcacgtttgcaatgacctgaaaatcggggccgagtgcctctgtccagacggctttcaactggttgcacagcgacgttgtgaagacatcgacgagtgtcaggacccggatacctgtagccaactttgtgtgaatttggagggtgggtacaaatgtcagtgtgaagaagggttccagctggatccacacacgaaagcctgtaaagctgttggttcgatcgcatatctgttctttacgaaccgtcacgaggtccgtaagatgactctggaccgatccgagtatacctcgctgatcccgaacctgaggaatgttgtcgccttggatactgaagtggcaagcaatcggatttattggtccgatctgagccaaaggatgatctgttccacccaactggaccgggctcatggtgttagcagctatgacacggtaataagccgggacattcaagcaccagacggcctcgccgtggattggattcatagcaatatttactggaccgatagcgtgctcggcaccgtgtccgttgcggacaccaaaggtgtcaaaaggaaaacgctcttccgcgagaatggaagtaaaccacgcgctatcgttgtagacccggtccacggttttatgtactggactgactggggtacgccagccaaaatcaagaagggcggattgaacggggtagacatctacagcttggtgaccgagaatattcaatggccgaacggtattaccctggacctcctgagcggacggttgtactgggtggattctaagctgcattccatttccagcatcgatgttaacggtggtaacaggaagaccatcctcgaagatgaaaagcgtctggcccacccatttagcctggccgtattcgaggataaggtgttttggaccgacattataaatgaggcgattttctctgcaaatcgcctgacgggtagcgacgttaacctgctggcggagaatctactctcccctgaagacatggtcctgttccacaatctgactcaaccacgaggagtcaactggtgtgaacggaccaccctgtctaacggcggctgccaatatctgtgcttgccagccccgcagattaatcctcattctccgaagttcacctgtgcctgtccagatgggatgctgctggcgcgggacatgcgcagctgtctgacggaagcagaagcggcagtagcaacccaggagaccagcaccgttagactgaaagtaagcagtacggcagtccgtactcaacacaccacgacgcgcccggtccctgatacctcccgcctgccgggtgccacccccggcctgacgaccgtggaaatcgtcaccatgagccaccaggccctgggtgacgtggcgggtcggggtaatgagaagaaaccgagcagcgtgcgcgctctgagcatcgttctgccaatcgttttgctggtttttctgtgtcttggtgtctttttgctgtggaagaactggagactcaaaaatattaatagcattaacttcgataacccagtgtatcaaaagaccacggaggacgaagtgcacatttgccacaaccaggatggctattcttatccttcacgccagatggtgtctctggaggacgacgttgcg

SEQ ID NO: 623 - DNA, 2580 bp, Artificial Sequence
  Description of Artificial Sequence: Synthetic Transcript Sequence
atgggcccatggggctggaagctccggtggacagtggctctgttgcttgccgctgcggggacggctgttggggatcgatgtgagcgcaatgagttccagtgccaggacgggaagtgtatatcatataaatgggtctgtgatgggtccgcagaatgtcaggacggctccgacgagtctcaggaaacctgcctttccgtaacgtgtaagtcaggcgacttttcctgcggtggtagggtgaatagatgtattccccagttttggaggtgcgatggccaggtggactgcgataatggaagtgacgaacagggttgtcccccgaagacatgctcccaagacgagtttcggtgccacgacggcaagtgtattagcaggcagtttgtgtgtgactccgacagggattgtcttgatggttctgacgaggctagctgccctgtcctcacatgtggcccggcctcattccagtgcaactccagtacctgcatccctcaactgtgggcgtgtgataatgaccctgattgcgaagatggaagtgacgagtggcctcagagatgtcgagggctgtacgtgttccagggcgattcctccccgtgttctgctttcgagtttcactgtctttcaggggaatgcattcattcaagctggcgatgcgatggaggaccagattgcaaggacaagtctgatgaagaaaattgtgcagtcgctacatgtcggcccgacgagtttcagtgctccgatgggaattgtattcacggctccagacaatgcgatcgggaatatgactgtaaagacatgtctgatgaggtaggatgcgttaacgtgaccctgtgcgaggggcctaacaagtttaaatgtcactccggtgagtgtatcacactggacaaggtgtgtaacatggcccgggactgccgggactggtctgacgagccgattaaagagtgtgggactaatgagtgcctggacaacaatggaggctgctctcatgtttgtaacgatctgaaaattggtgcagagtgtctgtgtcctgatgggtttcaactggttgctcagcgccgctgcgaggacatcgatgaatgtcaggaccctgacacttgctcccagctttgtgttaacctggagggcggctataagtgtcagtgtgaagagggcttccagttggacccgcatacaaaggcctgcaaggctgtaggctccattgcctacctcttcttcacaaatcgacatgaagtgcgcaagatgacattggacagatcagagtacacctctttgatccctaatttgcggaatgtggtcgccctcgataccgaggtggcgtcaaacaggatctattggtctgatctgtctcagcggatgatttgttctactcagctcgaccgggctcacggggtctcctcatatgataccgtgatctcaagggacattcaggcccctgacggccttgccgttgattggatacattccaatatatattggaccgatagcgtgctcggtaccgtcagtgtggccgacacgaagggagtgaagcgcaaaactctcttcagggaaaacgggagtaagccaagggctatcgtggtcgatcccgtgcacgggttcatgtactggacagactgggggacaccagccaagataaaaaaaggaggcctgaatggcgtggatatttatagcttggtgaccgagaacatacagtggcccaatggtattactctcgatctgctgtcaggtaggctgtactgggtggactctaaattgcatagcatatctagcatcgacgtgaacggcggtaatcggaagacaatcctggaggacgagaagcggcttgcccaccctttttctctggccgtttttgaggacaaagtattttggacggatatcattaacgaagctatcttcagcgctaacagactgaccggctcagacgtgaatctcctcgctgagaatctgctctccccagaggacatggtgcttttccataacctgacccagcccaggggggtgaattggtgtgagaggacgactctttccaatggaggttgccagtacctgtgtctgcccgcgccgcagattaatcctcactctcccaagttcacatgtgcgtgtccggatggtatgctgctggcccgggatatgagatcctgtctcacagaagctgaggctgcagttgctactcaggagactagcacagtaaggctgaaggtgagttcaactgcagtgcgaactcagcacacaactacaaggccagttcctgacacttccaggctgcccggcgcaaccccgggtctcaccacagtcgaaatcgttacaatgtcccaccaagcccttggggatgtggccgggcgcgggaatgagaagaagccttcatcagtgcgggccctgtccattgttttgcccatcgtcctgctcgtgtttctctgcctgggcgtcttcctcctctggaagaactggaggctgaaaaacatcaactctatcaactttgacaatcctgtgtaccagaagactaccgaggacgaggtccacatatgtcataatcaggatggatactcctacccctcccgccaaatggtgagtctggaggacgacgtggcc

SEQ ID NO: 624 - DNA, 2580 bp, Artificial Sequence
  Description of Artificial Sequence: Synthetic Transcript Sequence
atgggtccttggggttggaagctgagatggactgtcgcacttctgctcgctgcagcaggtaccgcagtcggagatcggtgtgaacgaaacgaatttcagtgccaagatgggaagtgtatctcgtacaagtgggtttgcgacggttcagcagaatgccaagatggttccgatgaaagccaagagacttgtctctcggtcacctgcaagagcggtgatttttcctgtggtggccgcgtcaatcggtgtattcctcaattttggagatgtgacggacaggtggattgcgataatggatcagatgaacaaggctgcccaccaaaaacttgttcccaagacgagtttcgttgtcatgatggcaagtgtatctcccgtcaattcgtgtgtgattcagatcgcgattgccttgatgggtcagatgaagcatcttgccccgtgctcacttgcggaccagcgagcttccaatgtaactcgagcacctgtataccacaactgtgggcgtgcgataacgacccggactgtgaagatggaagcgatgaatggcctcagcgatgcaggggcctttacgtgttccaaggtgactcctcgccgtgctcagcgttcgaatttcattgtctttccggagaatgcattcattccagctggcggtgtgatgggggtcctgactgtaaagacaaatcggatgaggagaattgtgcagtcgctacctgtagacctgatgaatttcaatgttcagacggaaactgcatccatgggtcgcggcaatgtgaccgcgaatacgattgtaaggacatgtcagacgaagtgggatgcgtgaatgtcactttgtgcgaaggacctaataagttcaagtgtcacagcggagaatgtatcacccttgacaaagtgtgtaatatggcccgcgattgcagagattggtcagatgagccgattaaggaatgtggcaccaacgaatgccttgataacaacgggggatgttcccacgtgtgcaatgacctcaaaatcggagccgagtgtctgtgcccagacggttttcagctcgtcgcgcaacgtagatgtgaggacattgatgagtgccaagacccagatacgtgttcacaactgtgtgtcaacctggagggagggtacaagtgtcagtgtgaggagggcttccaactggatcctcataccaaggcatgtaaggcagtcggaagtatagcatacctcttcttcactaacaggcatgaggtgcgcaagatgaccctcgatcggtcggagtacacctctcttattcctaaccttcgtaatgtggtcgcgcttgataccgaagtcgcttcaaaccgtatttactggtcagacctttcgcaaagaatgatatgtagcacccagctggatagagcgcacggtgtgtcctcttacgacactgtgatttcccgagatattcaagcaccggatggacttgcagtcgactggattcactcaaacatctattggaccgactcggtccttggtactgtgtccgtggcggatacgaaaggagtgaaacggaaaactctgtttcgcgaaaacggttcaaagccaagagcgattgtggtggaccctgtgcatggattcatgtattggacggattggggtacccctgcaaagatcaagaaaggggggctgaacggcgtcgatatctactcgctggtcaccgagaatattcagtggccaaacggaattactcttgatttgctctcgggtagactgtactgggtggattcgaagctccattcgatttcgtcaatcgatgtcaacggtggcaaccgaaagacgatcctcgaagatgagaaaagactcgcacatccgttttccctcgcagtgtttgaagataaggtgttttggaccgatatcataaacgaagccattttctccgcaaaccggctgactggttccgatgttaaccttttggccgaaaatctgctctcgccagaggatatggttcttttccataacctgactcaaccgcgtggagtgaattggtgcgaacgaaccactcttagcaatgggggttgccagtacctctgtctcccagctccacagataaaccctcactcacctaagttcacttgtgcgtgccccgacggaatgctgctggctcgtgacatgcggagctgtttgactgaagcagaagcagctgtggcgactcaagaaacctcaaccgtaagactcaaggtgagctcgactgcggtgaggactcagcacacgaccaccaggccagtgcctgatacgtcccgcctgcctggagcaactcccggtttgaccaccgtcgagattgtgactatgagccatcaggcattgggtgatgtggcagggcggggtaatgagaagaaaccctcgtctgtgagggcactgtcgattgtgttgcctattgtactgcttgtgtttctctgccttggagttttcctgctttggaagaattggcgtctgaagaatatcaactcgatcaacttcgataacccggtctaccagaaaaccactgaggatgaagtgcacatctgccataaccaagacggttactcatacccttcccgccagatggtatctcttgaagatgatgtcgca

SEQ ID NO: 625 - DNA, 2580 bp, Artificial Sequence
  Description of Artificial Sequence: Synthetic Transcript Sequence
atgggcccctggggttggaagctgcggtggaccgtggccctcttgctggctgcagccggaactgccgtcggcgaccgatgtgagcgtaacgagtttcaatgccaggatgggaagtgtatcagctacaagtgggtgtgcgatggaagcgccgagtgtcaggatggcagtgacgaatcccaggagacgtgtttaagcgtgacatgtaaatctggtgacttcagctgcggaggtcgagtcaaccggtgtattccgcaattttggaggtgcgacggtcaggtcgactgtgataacggatccgatgaacagggctgtccccccaaaacgtgctcacaggatgaatttaggtgccatgatggtaagtgcataagcaggcagtttgtgtgtgacagtgatagggattgcctggatggatcagacgaggcatcctgcccagtgctgacgtgtgggcctgcgtcctttcagtgtaactcctcaacctgtataccacaattgtgggcctgtgacaacgaccctgattgcgaggatggcagcgacgaatggccccagcgctgccgaggactttatgtgttccagggcgactccagcccctgtagtgctttcgagttccactgcttgtccggtgagtgtattcatagctcctggcgatgcgacgggggccccgattgtaaagataagagcgacgaagaaaactgtgctgtggctacctgccgtccagacgaatttcaatgttccgacggcaattgtatacacgggtcacgacagtgcgaccgtgaatacgactgtaaggacatgtcagatgaggtgggatgcgtgaacgtgacgctctgcgagggacctaacaaattcaagtgtcacagtggcgagtgtatcacactagacaaagtttgtaacatggctagagactgcagggactggagcgatgagcccattaaagaatgtggtactaacgagtgcctggataacaacggcggctgcagtcacgtgtgcaatgacttgaaaatcggcgcagaatgcttgtgtccagacggcttccaactagtcgcccagaggcgatgcgaagatatcgacgaatgccaagaccccgacacctgctcccaactttgcgtcaacctcgagggcggatacaagtgtcagtgtgaagagggctttcagctggacccccatacaaaagcttgtaaagcagtgggcagcatcgcttacctcttttttacaaacaggcatgaggtccgaaaaatgaccctggacagaagtgaatataccagcctgatacccaacctgcgaaatgtggtcgctcttgacactgaggtggctagtaaccgaatttactggtctgatctctcacagaggatgatatgcagtacacagttagatagagcacacggcgtctcttcgtacgatactgtaatcagccgggatatccaggcaccagacgggctcgcagtggactggatacactccaacatatattggaccgactcagttctcgggacagtaagcgtcgcggacaccaagggcgtaaagcgtaaaacattgtttagggaaaacggctctaaacccagggcaatcgtggttgatccagtccacggcttcatgtattggacagattggggcacaccggccaagatcaagaaggggggtctgaacggagtggatatctacagcctggtcaccgaaaacattcagtggccaaacggaattacattggatctcctctcaggtagactctactgggtcgattccaaacttcatagtatcagcagcatcgacgtcaacggtggtaaccgcaaaacgatactcgaggatgaaaagagattggcacatcctttttccctggccgtgttcgaggacaaggtgttctggaccgacatcataaacgaagccattttcagcgctaatagattgacgggttctgatgttaatctccttgcggagaatctcctgtccccagaggacatggtgctgtttcataaccttacacagccacgaggcgtcaactggtgcgaacgcaccaccctctctaacggcgggtgccagtacctgtgcctcccggcgccccagattaacccccattcaccaaagttcacatgtgcatgccccgacgggatgctgctggcccgagatatgaggtcctgtctcacagaagctgaggcagccgtcgctacacaagaaaccagcacggtaaggctcaaagtttccagcaccgccgttcgtacccagcatacaaccactcgcccggtgcccgatacaagcagactgccgggcgccactcccggcctgaccactgtcgaaatcgtgacaatgtctcatcaggccttgggtgacgtggctggccggggcaacgagaagaaaccatctagcgttcgagcactctccatcgtactaccaatagtgctgctcgtcttcctgtgcctgggagtttttctgctctggaaaaactggaggttaaagaacataaacagtattaattttgacaaccctgtctatcaaaaaacgacagaagacgaggtgcacatatgtcacaaccaggacggctattcttaccctagccgacagatggtctcccttgaagatgatgtggcg

SEQ ID NO: 626 - DNA, 2580 bp, Artificial Sequence
  Description of Artificial Sequence: Synthetic Transcript Sequence
atgggtccttggggatggaagctgagatggactgtggctctgcttctcgctgctgcgggaacagctgtaggggaccggtgtgagaggaacgagttccagtgtcaggacggcaaatgtatctcttacaaatgggtttgcgatggctccgcagaatgccaggatggtagcgacgaaagtcaggagacctgtctgtctgttacctgtaagtccggcgacttcagctgtggcggtagagtcaaccgctgcatccctcagttctggcggtgcgatggtcaggttgactgcgacaacgggtctgacgagcaggggtgtcctcccaagacatgttctcaagacgagtttcgatgtcacgatgggaaatgtatttccagacagttcgtgtgtgactcagatcgtgattgtttggatggttccgacgaagcctcttgtcctgtgctcacttgtgggccggcctccttccagtgcaattcatctacttgcatcccacagctatgggcctgtgataatgacccagactgcgaagacggatctgatgaatggccccaaaggtgtagaggcctgtacgtatttcagggagatagctcaccctgtagtgccttcgagtttcactgcctctcaggcgaatgcatacattcctcgtggcgctgcgacgggggccccgattgtaaagataagtccgatgaggaaaattgtgcagtggcaacctgtcgaccagacgagtttcagtgctctgacgggaattgtattcacgggtcccggcaatgcgaccgggagtatgattgtaaggacatgagcgacgaagtgggttgcgtaaacgttacattgtgcgaaggtcctaacaaattcaagtgccatagtggcgaatgtatcaccctcgataaagtttgtaacatggctcgcgactgtcgagattggtctgacgaaccaataaaagagtgcggaaccaacgagtgtctggacaacaacggaggatgtagccacgtttgtaacgatcttaagataggggccgaatgcctgtgcccagacggctttcagcttgtggcacagcgccgctgcgaggatattgacgaatgccaggaccctgacacatgcagccagttgtgcgtgaacttggagggtggctacaagtgtcaatgtgaggaggggtttcaactcgaccctcacacgaaggcatgcaaagcggttggttccatcgcttacctcttcttcactaaccggcacgaagtccgtaaaatgactctagatcggagcgagtacacttccctgattcctaatttgcggaacgttgtggctttagataccgaagtagcctccaacaggatctattggagtgacctgagccagcgcatgatctgctccacccagctggacagagctcacggggtgtcttcatatgataccgtgataagtagagatatccaggcacctgatgggttggcagttgattggatccacagtaacatctattggacagacagcgttctggggaccgtaagtgtggccgataccaagggcgtgaagcgcaaaactttgtttcgggagaacggatcaaagccacgagcgattgtagtggacccagtacacgggtttatgtactggaccgattggggcacacctgctaaaatcaagaaaggtggcctgaatggcgtggacatttactctctggtgactgaaaatatccagtggcccaatgggatcacactggacctactatccggacgcctgtattgggtggactcgaagctgcatagcataagcagtatcgacgtgaacggcgggaacagaaaaacaatcttggaggatgaaaaacggctggcacaccctttttctttggcagtcttcgaggataaggtgttctggaccgacatcattaacgaggcaatcttttccgccaatcgcctgaccggctctgatgttaacctgctagcagagaatctcctgagtcctgaggacatggtactgttccataacctgactcaaccccgcggcgtgaattggtgtgagcgcactaccctttctaatggcggatgccagtatctgtgcctgcccgcgccacagatcaacccccacagcccaaaatttacgtgcgcttgccccgacggaatgctcctggctcgcgatatgcgcagctgtctgactgaggcagaagccgctgtggcaacacaagaaaccagtacggtcagactgaaagtttcttcgacagctgtccggactcagcatacaaccaccaggcccgtacccgacacctcacgtctccccggcgcaacacccggactgacaaccgtcgagattgtcactatgtcccaccaagcgctgggcgacgtcgcaggacggggcaacgaaaagaagccaagttcggtaagggccctgagtatagtcctacccatcgtgttattggtgttcctgtgtcttggtgtgttcctgctgtggaagaactggagactgaagaacattaacagcataaactttgataatccagtgtaccagaaaactactgaggacgaggtccatatctgccacaatcaggatggatacagctatccttctaggcagatggtttccctggaggatgatgtcgct

SEQ ID NO: 627 - DNA, 2580 bp, Artificial Sequence
  Description of Artificial Sequence: Synthetic Transcript Sequence
atgggaccctggggatggaaactgcgctggaccgtggcactgctgctcgcagcagccggaacggcagtgggagataggtgtgagagaaacgagttccaatgtcaagacggtaaatgtatttcgtacaaatgggtgtgtgatggctccgccgagtgccaagatggatccgatgagtcgcaggagacttgtctctccgttacttgtaagtccggggatttcagctgtggcgggcgggtgaacaggtgtattccacaattttggagatgtgatgggcaagtggattgtgacaacgggtcggatgaacaggggtgtccaccaaaaacttgctcgcaagatgaatttcggtgccacgacggcaagtgtatcagccgccaatttgtgtgtgattcggatcgcgactgtctggacggatcggatgaagcatcctgtccagtgcttacctgtggccccgcctccttccagtgtaattcgtcgacctgtataccccaattgtgggcatgtgataacgacccagattgcgaagatggcagcgatgagtggcctcagcgctgtagggggctttacgtgtttcagggtgactcctcgccctgttccgcatttgagtttcattgtctctcgggagaatgtattcattcgtcgtggcgatgcgatggaggaccagactgcaaagacaaatcagatgaggagaattgtgcagtggcaacctgtagaccggatgagtttcaatgcagtgatggtaactgcattcatggatcccggcaatgcgatagagagtacgattgtaaggatatgagcgacgaggtgggatgcgttaacgtgaccctgtgtgaaggacccaataagtttaagtgccattccggcgaatgtataacccttgataaggtgtgtaacatggctcgtgattgccgggattggtcggacgaacctataaaggaatgcggcaccaacgaatgtctcgataacaacggaggttgttcgcatgtgtgcaacgatcttaagataggcgcagagtgtctttgtcctgatggttttcagcttgtggctcaaagaaggtgtgaagatatagatgaatgtcaagaccctgacacctgctctcaactgtgcgtgaatctggaaggtggatacaagtgtcagtgtgaagaaggattccagcttgaccctcatactaaggcctgtaaggcagtcggttctatcgcgtacctgtttttcacgaaccggcacgaagtgcggaagatgactcttgatcgtagcgagtacacctcccttattccaaatctgcgcaatgtggtcgcactggatactgaagtcgccagcaacagaatctactggtcggatctgtcccaacggatgatctgctcgacccaactggatcgtgcccatggagtcagctcctacgacaccgtgatctctcgcgacatccaggcaccagatggtctggcagtcgactggatacattccaacatttactggacggattcagtgctcggtactgtgtccgtggcggacaccaagggagtgaagagaaagactttgtttcgggagaatgggtctaagccaagagcaattgtggtggaccccgtgcatggtttcatgtactggactgattggggaactccagctaagatcaaaaagggaggtctgaacggagtggatatctacagccttgtgactgaaaacattcagtggcccaacggaattaccctggacctcctgtcgggacggctgtattgggtggattcaaagctgcacagcatttcaagcattgatgtgaacggaggaaatcggaaaaccattcttgaggacgaaaagcggctggcacatccttttagcctcgcagtgtttgaagataaggtcttttggaccgacatcattaacgaggcgattttctcagcaaataggctgactggaagcgatgttaacctgcttgcagaaaatctgcttagccccgaggacatggtgctctttcataaccttacccaaccaagaggagtgaattggtgcgagagaaccaccttgtcaaatggcggttgtcagtacttgtgcctcccggccccacagatcaacccccactcccctaagttcacgtgcgcgtgccccgatggcatgctcctcgcacgggacatgaggtcgtgtctcactgaagcagaagctgcagtagcgacccaagagactagcactgtcagacttaaagtgtcctcgaccgcagtgagaacccaacatactaccacccgtccagtccccgatacgagcagactccctggtgcaactcctggcctcactactgtcgaaatcgtgactatgtcgcatcaagcactcggtgacgtggccggacggggaaacgagaaaaagccaagctcagtgcgtgcgctttcaatcgtccttcctatcgtgctgcttgtgttcctttgcctcggagtgtttttgctgtggaaaaactggagacttaagaatatcaattccatcaactttgataaccctgtgtaccaaaagaccaccgaagatgaggtgcacatctgtcataaccaagacggctacagctacccctcgcgccaaatggtgtcattggaagatgatgtcgcc

SEQ ID NO: 628 - DNA, 2580 bp, Artificial Sequence
  Description of Artificial Sequence: Synthetic Transcript Sequence
atggggccctggggatggaagctgcggtggaccgtggctcttctgctggcggccgcgggtactgctgtgggggaccggtgcgaacggaacgaattccagtgccaggacggtaaatgcatctcatacaagtgggtctgtgacggatctgcggagtgccaggatgggtcggacgaaagccaagagacttgcttgtcagtgacttgcaagagcggcgatttcagctgcggaggccgcgtcaacagatgtattccgcaattctggagatgcgatggacaggtggattgcgataacggttcggacgaacagggatgtccgcctaagacttgctcccaagacgaatttagatgtcatgatggaaagtgtatcagccgacagttcgtgtgtgattcggaccgtgactgcctcgacggaagcgacgaggcttcctgcccggtgctcacctgcggtccggcctccttccagtgcaattcctccacctgcatcccccagctgtgggcttgtgacaacgaccctgactgcgaagatggatcagacgaatggccgcagcggtgcagaggtctgtacgtctttcaaggcgactcgtccccttgctccgcattcgaattccactgcctgtcgggagagtgtatccactcctcgtggcggtgcgatggcggacccgattgtaaggacaagtctgacgaggagaactgcgccgtggcaacttgtcgcccagacgagttccagtgctccgacggaaactgcatccatggcagccggcaatgcgacagagaatacgattgcaaggacatgtccgacgaggtgggatgcgtgaatgtcaccctgtgtgagggacctaacaagtttaagtgccactcaggagaatgcatcactctggataaggtgtgcaatatggccagggactgccgggactggtccgacgaacctatcaaggagtgcgggaccaacgaatgcctggacaataacggtggatgctcccacgtgtgcaacgacttgaagatcggagctgaatgcctctgcccggatgggttccaacttgtggctcagcgccgatgcgaagatatcgacgaatgtcaggacccagacacctgctcccagctctgtgtgaacctcgagggtggatacaagtgccagtgcgaggagggcttccagctcgaccctcacaccaaggcctgcaaggcagtgggctcaatcgcatacctcttctttactaaccgccatgaagtcagaaaaatgactctcgatcgctcagaatacaccagcttgatcccgaacctgcgcaacgtggtggctctcgacacggaagtggccagcaaccggatttactggtcagacctgtcgcagcgcatgatctgctcgacccagctcgaccgggcgcatggagtgtcgtcatatgacaccgtcatctcgcgcgatattcaagcaccggacgggctcgcggtggattggatccattccaatatctactggactgacagcgtcctgggcaccgtgtccgtggccgacacgaaaggagtgaaacgcaagacgctctttagagaaaacgggtcaaagccacgggctatcgtggtggacccagtgcacggctttatgtattggaccgactggggaacgcccgcaaaaatcaagaagggtggactcaatggagtggacatctacagtcttgtgactgagaacatccagtggccgaacggcatcaccttggatcttctgtcagggcgcctctactgggtggactctaaacttcatagcatctcaagcatcgacgttaatggaggaaacagaaagactatcctggaggacgaaaagcggctggcacacccgttctccctcgcggtgttcgaagataaagtgttctggactgacatcattaatgaggctatcttttccgcgaatcgcttgactggatcagatgtgaacctccttgccgaaaacttgctgagcccggaggacatggtgctgttccacaacctcacccaaccgcggggagtgaattggtgcgagagaaccaccctgtcaaatggcggatgtcagtacctgtgtctgccagcgccgcagatcaatccgcattcgcccaagtttacctgtgcatgcccggacggaatgcttctcgcacgggatatgcggtcctgcctcactgaagcggaggccgccgtggccacccaagagacgtcaaccgtcagacttaaagtgtcatcaactgcagtccggacccagcataccacgaccagaccagtcccagatacctcgcgcctcccgggcgcaactccaggactgaccaccgttgagatcgtcactatgtcacaccaggccctgggagatgtggctggccgcggaaacgaaaagaagccatcgtcggtgcgagcactctccatcgttctgccgatcgtgctccttgttttcttgtgcctgggcgtctttctgctgtggaaaaactggcgccttaagaacatcaactcaattaacttcgacaatccagtgtaccagaaaactacggaagatgaagtccatatctgccataaccaggatggatactcgtacccatcccggcagatggtatcgctcgaggatgacgtggcc

SEQ ID NO: 629 - DNA, 2580 bp, Artificial Sequence
  Description of Artificial Sequence: Synthetic Transcript Sequence
atgggcccttggggctggaaactgagatggaccgtggcactcctgctggcagcagccggaaccgccgtaggagatcggtgcgaaagaaatgaattccaatgtcaagacggtaagtgtatatcatacaagtgggtgtgtgatggctccgcagagtgtcaggatggatcggatgaatcacaggaaacctgtctgtccgtgacttgtaagtccggggacttttcgtgtgggggacgtgtgaacaggtgtattcctcagttctggcgctgcgacggtcaagtggactgtgataacggcagcgatgagcaaggatgtccccctaaaacgtgctctcaagatgaattcagatgccatgacggaaagtgtatctccagacagtttgtgtgtgacagcgaccgggattgtctggatggttcggatgaggcatcatgccctgtcctcacctgtggccctgctagtttccaatgtaattcgtcaacctgcatcccgcaactgtgggcatgtgataatgaccctgactgcgaagatggatcagatgaatggccccaaagatgtagaggactgtacgtgtttcagggagattcgtcgccgtgcagcgccttcgagttccattgtctgtctggtgaatgtattcattcctcgtggcgatgtgatgggggtccagattgtaaagacaagtcagatgaggagaattgcgcggtggccacttgtcggccagatgaatttcagtgttccgatggcaactgtattcatggatccagacaatgtgatagggaatacgattgtaaggatatgtctgacgaagtgggttgtgtgaacgttaccctgtgtgagggtcccaacaaattcaagtgccatagtggtgagtgcatcacccttgataaagtgtgtaacatggcaagagattgccgtgattggtcggacgaaccaatcaaggaatgtggtactaacgagtgtctcgataacaatgggggctgttcccatgtgtgcaatgacttgaaaatcggagcggaatgtctgtgccccgatggcttccagctcgtggctcagagacggtgtgaagatatagacgaatgccaagaccctgatacttgcagccagctgtgcgtgaaccttgagggtgggtacaagtgtcagtgtgaagaaggcttccaacttgatcctcacactaaggcgtgtaaggcagtgggatcgatcgcctacctgttctttacgaacagacacgaagtcagaaaaatgaccctggatagaagcgaatacacttccctcattcccaatctgcgcaacgtcgtcgcactcgacaccgaagtggcttcgaatcgcatttactggagcgacctgtcccaaagaatgatttgttcaacccaactggacagagcgcatggagtgagcagctatgataccgtgatctctagggatattcaagcacctgatggactggcagtggactggatacacagtaacatttactggactgactcggtgctgggcaccgtcagcgtggctgatactaaaggtgtgaagagaaagactctgtttcgagagaacggctcgaaaccacgagcaattgtcgtcgatccggtgcacggatttatgtactggaccgactgggggactccagcaaagatcaaaaagggtggtctgaatggtgtggacatctattctttggtgactgagaatatacagtggcctaacgggattaccctggatttgctctctggaaggctttactgggtggactctaagttgcactcgatttcgagcattgatgtcaacggcgggaaccgtaagacgattcttgaggacgaaaagcgccttgcacatccatttagccttgccgtctttgaagataaggtattctggactgacataatcaacgaggcaattttctccgcaaaccgcttgacgggatcagacgttaatctgcttgcagagaacctgctttcgcccgaggacatggtgctttttcataacttgactcagcctagaggagtgaactggtgtgaacgcaccacgctttctaatggagggtgtcagtacttgtgcctgcctgcacctcagatcaatccacactcacctaagtttacgtgtgcgtgtccagatggaatgcttctggctcgggacatgagatcgtgtctcaccgaggccgaagcagccgttgcaactcaggaaacctcaactgtgcggcttaaagtctccagcaccgctgtgcggactcagcacacgaccaccagaccagtgccagatacctccagactgcccggagctactcccgggctgactaccgtggagattgtgaccatgtcacatcaagcacttggcgacgtggcaggacgagggaatgaaaagaaaccgtcctcagtccgcgcacttagcatcgtgctcccaattgtgcttctggtctttctgtgtctcggtgtgtttctcctttggaaaaactggcgcctcaagaacataaactcgattaacttcgacaaccctgtgtaccaaaagaccacggaagatgaggtccatatttgccataatcaagatggctactcgtacccatcgagacaaatggtgtccttggaagatgacgtcgca

SEQ ID NO: 630 - DNA, 2580 bp, Artificial Sequence
  Description of Artificial Sequence: Synthetic Transcript Sequence
atgggcccttgggggtggaaattgagatggacggtggctctattattagccgcagctgggaccgcagtgggtgatagatgcgagcggaatgaattccaatgtcaagatggaaaatgtatttcgtataaatgggtctgcgacggatctgcggaatgtcaggatgggtccgatgaatcgcaagaaacttgccttagtgtcacctgtaaaagtggtgacttttcctgtggcggccgggttaatcgctgcatcccgcagttttggcgatgtgatggacaagttgattgtgacaatggtagtgatgaacagggctgccctccgaaaacctgtagtcaggacgagtttagatgtcatgacggaaagtgcatttcgcggcagtttgtttgcgatagcgatcgggattgtcttgatggctcagatgaggcttcttgccctgtcttgacatgtgggccggcctcttttcaatgtaatagctctacgtgtattccgcagctctgggcctgtgataatgaccctgattgcgaagacggctctgatgagtggccacagagatgtagaggtctatatgtatttcaaggtgattcatctccatgcagtgcctttgagtttcactgtctcagcggagaatgtattcacagcagctggcgatgcgatgggggcccggactgtaaagataaatcagacgaagagaactgcgctgtcgctacatgtcgtccggatgaatttcaatgcagcgatggtaactgcattcatggttctagacaatgtgacagggaatatgattgcaaggatatgtccgacgaagtcggatgcgtaaatgtgacgctttgcgaaggccctaacaaatttaaatgtcactcaggcgaatgcatcacacttgacaaggtttgcaatatggcacgtgactgtcgtgactggtctgacgaaccaatcaaagaatgtggtacaaatgagtgtttggacaacaatggcggatgctctcatgtatgtaacgatcttaaaattggggccgaatgtctttgtccggacggatttcagcttgttgcacaaaggcgctgcgaggatattgatgaatgtcaggacccggatacttgcagccagttatgtgtcaatctagaaggcggatataaatgtcagtgcgaagaggggtttcaattagatccgcacacgaaggcttgcaaagcggtgggttcaattgcctatctgttcttcacgaataggcatgaagtgcggaaaatgacattagatagatcagaatatacaagtttgatcccgaatttgagaaacgtggtagctttagatactgaagtcgcatccaatcgtatttactggagcgacttgagccaaagaatgatctgtagtacgcaactagatcgtgcccatggagtgagcagctacgatacagtgattagcagggatattcaagcgccggacgggttagcggttgattggatccattctaacatttattggaccgatagtgtccttggaacagttagcgtggcggacaccaaaggggtcaaacggaaaacactgtttagagagaatggatcaaagcctagggcgatcgttgtggatccagtacacggttttatgtactggacggattggggaacgcccgcgaaaatcaagaaaggaggccttaatggagtcgatatctactctctcgtgacagagaatattcaatggccgaatggtatcacccttgaccttttgtccggaagactgtattgggtcgacagtaagctgcactcaatttcgagcattgatgtcaatggaggaaacagaaagacgatacttgaggacgaaaagcggttagctcatccttttagcctcgccgtgtttgaggacaaagtattctggacagatatcattaacgaagccattttcagcgcgaatcggctcactggctcggacgtaaacctgttagctgagaatttactgagtcctgaagatatggtcttgtttcacaacttaacgcagccgcgcggtgtcaactggtgtgagcgcacaacacttagtaacggaggatgccaatatctgtgtcttccagctccacagattaaccctcattctccaaaatttacgtgtgcttgtccggatggaatgttgctggcaagagatatgcgcagctgcttgactgaggctgaagcagccgttgcaacccaggaaactagtactgtgagacttaaagtatcttccacagccgtccggacacaacatacaacaactcgaccggtgccggatacaagcagactgccaggcgcaactccaggcttaacgacagttgaaattgtaacgatgtcacatcaggcgttgggggatgtggcgggacgtggcaatgagaaaaaaccaagctccgtacgcgcgcttagcattgtactcccaattgtccttttggtctttctgtgcctgggcgtgttcttactgtggaaaaactggcgcctgaagaacataaactcaattaattttgacaacccggtatatcagaaaacgacggaggacgaagtacatatttgccataatcaggatggttacagttatcccagcagacaaatggtaagtcttgaggacgatgtcgct

SEQ ID NO: 631 - DNA, 2580 bp, Artificial Sequence
  Description of Artificial Sequence: Synthetic Transcript Sequence
atgggcccgtgggggtggaagctcagatggaccgttgcccttttgctggctgctgctggcacagctgtgggagacagatgtgagagaaacgaattccagtgtcaggacgggaaatgcatttcttataagtgggtgtgtgatgggtccgccgagtgccaggacggatcagatgagtcccaggaaacctgtctatctgtcacttgcaagagcggcgatttttcgtgtggcggaagggttaacagatgtatcccacagttttggagatgcgacgggcaggtcgactgcgacaatgggtcggacgagcagggctgtcctccgaagacttgttctcaggatgagtttaggtgccatgacggtaaatgcatttcccgccagttcgtgtgcgattcagatcgtgattgcctcgatggctcagacgaagccagctgccccgttctgacctgcggtccagcttccttccagtgcaattcatccacctgtatcccccagttgtgggcttgtgacaatgatcccgattgcgaggacggaagcgacgagtggccccagcgatgccgtggcctatatgtgtttcagggcgactcctctccctgtagtgcttttgagttccattgtctgtcaggggaatgtatccactcaagctggaggtgcgatggcggacctgattgcaaggacaagtctgacgaagaaaattgtgcggtagctacctgcaggcccgacgagtttcagtgctcagatgggaactgtatccatggatcccggcaatgcgatagggagtacgactgcaaggatatgagcgatgaggtgggctgcgtaaacgtgacattgtgcgaagggcccaataagtttaagtgccacagtggggagtgcatcacgcttgacaaagtgtgtaacatggcacgcgactgtcgcgactggagcgatgagcctataaaagaatgcggtacaaacgagtgcctggacaacaatggaggctgctcccatgtgtgtaacgatctgaaaatcggagcagagtgcctgtgccccgacgggtttcagctggtggcacagcgtcggtgtgaggacatagatgagtgccaggaccccgatacctgtagtcaactgtgtgtgaatctggaaggcggctacaagtgtcaatgcgaagaaggatttcagttggatccccacaccaaagcgtgtaaagcagttggctcaattgcctacctgttcttcacaaatcggcacgaggtccgtaagatgacactggatagatctgaatacacatctctgatccctaatctcagaaacgtggtggccctcgacaccgaggttgcaagcaaccgaatttattggagcgacctgtctcagcggatgatttgctcaacacagttggatcgcgctcatggcgtgtccagctacgacaccgtgatttcccgagacatccaggcccccgatggccttgccgtcgattggatccacagtaacatctactggaccgacagtgtgctgggcactgtgtccgtagctgacacaaaaggagtgaaacgcaagactctttttagagagaatgggtcgaagccgagagcaatcgtggttgaccctgtacacgggtttatgtattggactgactggggaacaccggctaagatcaaaaaggggggtttaaatggtgtcgacatatatagcctcgtcactgaaaatatccagtggcccaacgggattacacttgatctgttgagcggaagactctactgggtcgacagtaagctccactccattagttctatcgatgtaaacgggggcaatcggaaaacaatcctggaagacgaaaaacgtcttgcccatcctttctcattggctgtatttgaggacaaggtgttctggaccgatataatcaacgaggcgatcttcagcgcaaacaggctcaccggaagtgacgtgaacctcttagcagagaatctgttaagtcctgaggacatggtgctattccataatctaacacaaccccgcggtgtcaactggtgtgagcggaccacactgagtaacggcggctgccaatatctgtgcctgcccgcaccccagatcaatcctcattctcctaaattcacatgcgcttgtcctgacgggatgttgctcgcgagggacatgagatcgtgcttaacagaggcagaggccgccgtggctacccaggagaccagtactgtaagactgaaagtgtcttcgacggcggtgcgtacccaacataccacgacacggcctgtgccggatacaagcagacttcctggggcgacgccgggattaaccaccgtggaaatcgtgaccatgtcccaccaagcactaggtgacgtggctggcagaggaaatgagaagaagccatccagcgtacgggcgctaagtatcgtcctgcccatcgtgctcctagtattcctttgtctgggtgttttcttgctttggaaaaactggaggctcaagaacataaattctattaattttgacaatccagtatatcagaagaccaccgaggacgaggtgcacatctgccacaatcaagacggctactcctacccaagccgccagatggtgtcactcgaagatgacgtggct

SEQ ID NO: 632 - DNA, 2580 bp, Artificial Sequence
  Description of Artificial Sequence: Synthetic Transcript Sequence
atgggcccctgggggtggaagctccggtggacagtcgctctccttctcgcggcagccggaacggcggttggagatcgatgtgagagaaatgaattccaatgccaggacggcaagtgtatttcgtacaaatgggtgtgtgatggctctgccgaatgccaagatggctctgacgagtcacaagagacctgtctctccgtcacatgcaagagcggcgacttctcctgcgggggaagagttaataggtgtatcccacaattctggcggtgcgacggccaggtcgattgcgataacgggtccgacgagcagggctgcccccccaaaacgtgcagccaggatgaattccggtgccacgatggcaagtgtatctctcgccagttcgtgtgtgatagtgatagggattgcctggacggctctgatgaagcatcctgtcctgttctgacatgcgggcctgcctcatttcagtgtaacagttcgacatgtataccccagctctgggcgtgcgataatgaccctgactgcgaggatggaagcgacgaatggccccagagatgtagaggactgtatgtcttccagggagactctagtccctgttctgcctttgaattccactgcctgtctggtgagtgtatccattcttcttggaggtgtgatggcggccccgactgcaaggataaatccgacgaagagaactgtgcggttgcgacgtgcagaccagacgagttccagtgcagcgacggaaactgcatccacggttcacggcaatgcgacagggagtacgattgtaaggatatgagcgacgaggttgggtgtgtgaatgtgactctgtgtgagggacccaataagtttaagtgccattccggagagtgtatcactcttgataaggtgtgtaacatggcccgcgattgcagagattggagcgatgagccaataaaggagtgtggtactgcagcatgtctggataataatggaggttgcagtcacgtgtgtaacgcattgaaaatcggcgcagaatgtctctgtcctgatggatttcaactggtcgcccagcggcggtgcgaggacatagacgagtgtcaagacccagacacatgctctcagctttgtgtgaatttggagggtgggtacaagtgccagtgcgaagaaggttttcagctggatccccacactaaagcctgcaaagctgtcggctccattgcctacctgtttttcactaaccggcacgaggtccggaagatgacgttggacagaagcgaatacaccagtttaatcccaaacttgcgtaatgtagttgcacttgacacagaggtcgcttccaaccggatatattggtcagacctgagtcagagaatgatctgttcaactcagttggaccgagcacatggtgtcagctcttacgacacagtcatctccagggacattcaggccccggatggcctagccgtggactggatccatagcaatatttattggacggactccgtcctggggaccgtgagtgtcgccgacaccaagggggttaagcggaaaacactgttccgcgagaacggctcaaaaccccgcgcaattgtcgtagaccctgtgcacggcttcatgtattggacagactggggcactccagctaaaattaagaagggaggcctgaacggagtggatatctactcgctcgtgaccgagaacatccagtggccgaatggcatcaccctggatttgttgtcaggccgcctctattgggttgatagcaaactgcatagtataagttccatagacgtgaatggcggaaataggaaaactatcctcgaagatgagaagaggcttgcccacccatttagtttggctgtgttcgaagacaaggtgttttggacggatataatcaacgaggcaatctttagcgccaaccggttgacaggttcagacgttaacttgttggccgaaaacctacttagtcccgaggacatggtactgtttcacaatctaactcagccacggggggttaactggtgcgagcgaacgaccttatcaaacggtggctgccagtatttgtgtctgcctgccccacagataaacccacactcaccaaaatttacctgtgcgtgtccagacggaatgcttctggctcgagatatgaggagttgtctcactgaagccgaagccgctgttgccacgcaggagacctcaactgtccggctcaaagtctcatcaacagcggtgcgcacacagcatacaacaacccggcctgtgcctgacaccagcagactccccggggcgacaccagggctcaccaccgttgagatagtgacaatgagtcatcaggctctgggcgacgtggcgggaagaggcaatgagaaaaagcctagctctgtgagagctctctctattgtcctgccgattgtgctactggtctttctctgtttgggtgtcttcctgttgtggaaaaactggcggctcaaaaatattaactctattaactttgacaacccagtctatcaaaagacaactgaggacgaggtgcacatctgtcacaaccaggacgggtactcctacccctctaggcaaatggtgtctttagaagatgacgtggct

SEQ ID NO: 633 - DNA, 2580 bp, Artificial Sequence
  Description of Artificial Sequence: Synthetic Transcript Sequence
atggggccatggggctggaaacttcggtggaccgtggcactgctgcttgcagcagcaggaactgcagtgggcgatcgctgcgagcggaatgagtttcagtgccaggatggcaagtgcatttcatacaagtgggtctgtgacggctctgccgaatgccaggacggatccgatgagtcccaggaaacgtgccttagcgttacctgtaagagtggggatttctcctgcggagggcgcgtcaaccgatgcataccccaattctggaggtgtgatggtcaggttgattgtgataacggatcagacgagcagggctgtcccccaaagacttgttctcaagatgaattccgctgtcacgacggcaaatgtattagccgacagtttgtgtgcgacagcgaccgggattgcctcgatggaagtgatgaagcttcatgccccgtacttacctgcgggccagcctccttccaatgtaactctagcacttgcatcccacaactgtgggcctgcgacaacgatccagattgtgaggatggaagtgatgagtggccacagaggtgccgcggcctctatgtctttcagggggacagctctccctgctcagcgtttgagtttcactgtctgtctggtgagtgtattcattcctcctggaggtgcgatggcggccccgactgcaaagacaaaagcgatgaagaaaattgcgcagtcgccacttgccggcctgacgaattccaatgtagtgacggtaactgcatccacgggagccggcaatgtgatcgcgagtacgattgtaaggacatgtcagatgaggtgggatgcgttaatgtcacactgtgtgaaggcccaaacaagttcaaatgccattcaggtgagtgcattacgctggataaggtgtgcaacatggcccgcgactgtagagactggtcagacgaacccatcaaggaatgtggaacagccgcctgccttgataataatggaggatgctctcatgtgtgtaatgctctgaaaatcggagcagagtgtttgtgtcctgatggatttcagctggtggcccagagacggtgcgaggatatcgatgagtgtcaggatccggacacttgctcccagctctgcgtgaacttggagggcggctacaaatgccagtgcgaggaggggtttcagctggatcctcatactaaggcctgtaaggccgtggggtccattgcctacctgttcttcacaaatcggcacgaagtgcggaagatgacactggatcgctccgagtacacctcccttattccaaacctgaggaacgtggtggctctggatactgaggttgccagtaacagaatctactggagtgacctcagtcagaggatgatctgtagcactcaactcgatcgggcccatggcgtgtcatcatacgatactgtgatctctcgagatattcaggctcctgatggattggcggtggactggattcattctaacatttattggaccgattccgtactcggcactgtctccgtcgcagatacaaagggggtaaaacggaagacactgttccgcgaaaacggttccaagccccgagcaatcgtagtcgatcctgtacatgggttcatgtactggaccgactggggcactcccgcaaaaattaaaaaaggcggcctgaatggcgtggacatatacagcctggtcacagagaatattcagtggcccaacggcatcacactggatctgctgtctggccgactctactgggtcgacagtaagttgcactccatcagcagcatcgacgtgaacggtgggaatagaaagactatcctggaggacgaaaagagactggcccacccattcagtctggctgtcttcgaggacaaggtgttctggactgacatcatcaacgaagctattttcagcgctaacagattgactggatcagacgtaaatctgttggctgaaaatttgctctcacctgaggatatggtgctttttcacaacttgactcagccacgaggagttaactggtgcgagcgcactactctgagtaatgggggctgccagtacctttgtctccccgcacctcagattaacccccattcccccaaattcacatgtgcctgccccgacggcatgcttctggccagggatatgaggagctgtcttaccgaggcagaagccgcggtagccacccaggaaacctctacagtacgcctcaaggtctcatctaccgccgtgcggacccagcatacaacaaccaggcccgttcccgacaccagcaggctgccaggcgctacaccaggccttacaaccgtggagatagtcacaatgtctcatcaggccctgggggatgtggccggcaggggcaacgagaaaaagcccagcagcgttagggccttgtccattgtgctgcctattgtcctgctggtgttcctttgcctgggcgtatttttgctgtggaaaaattggcgactgaaaaacatcaactcaatcaatttcgataatcccgtgtaccagaaaacgaccgaagacgaggtgcacatttgccacaaccaagacggctatagctaccccagtagacagatggttagtcttgaagacgacgtagct

SEQ ID NO: 634 - DNA, 2580 bp, Artificial Sequence
  Description of Artificial Sequence: Synthetic Transcript Sequence
atggggccatgggggtggaagctcaggtggactgtggccctcctgctagccgcggccggaacggccgttggagataggtgcgagcggaatgagtttcagtgccaggatggcaaatgcatctcctacaaatgggtctgcgatggctccgcggagtgtcaggatggctccgacgaatctcaagagacttgcctaagcgttacgtgtaagtctggagacttttcctgcggtggtcgcgtcaatcggtgtataccccagttctggcggtgcgacggtcaggttgattgcgataatggatccgacgagcaggggtgtccacctaaaacctgcagccaggacgaatttcgttgtcatgacggtaaatgtatctcccgacagttcgtgtgcgattcagatcgggattgccttgatggcagcgacgaagcttcctgcccagtcctgacctgtggaccggccagcttccagtgcaactctagtacttgcatccctcagctctgggcgtgcgataacgatcctgattgcgaggatggttcagatgaatggcctcaaaggtgtcgaggcctctatgtattccaaggtgacagttccccctgcagcgcctttgagtttcattgcctttctggagaatgtattcactcaagttggaggtgcgatgggggcccagactgtaaagacaaatccgacgaagagaattgcgcggtcgccacgtgtcgccctgacgagtttcagtgctctgatggcaactgcatccatggttcccggcagtgcgatcgcgagtatgactgcaaagatatgtccgacgaggtaggctgcgttaatgttactctatgtgaaggtcccaacaagtttaaatgtcattcgggtgaatgtatcactctggacaaggtttgtaatatggctagggactgcagagactggtctgacgagccaatcaaagaatgtggcacagcggcctgcctcgacaataatggtggctgtagccatgtctgcaacgctcttaaaattggcgctgagtgcctttgccccgatggctttcaactcgtggcacaaagacgctgcgaggatattgacgagtgccaggatcccgatacctgcagtcagctctgtgtgaatctggagggcggctacaagtgccagtgcgaggaggggtttcagctggatccacacacaaaagcctgcaaggcggtgggaagcattgcttatttgtttttcaccaacagacacgaagtcaggaagatgaccctggatcggagcgagtatacgtctctgatcccgaacctgaggaacgtggtcgcactggacaccgaggtggcttcaaaccggatttactggagcgatctgagccaacgcatgatatgctcgacccagcttgatagggcacacggagtctctagttacgatacggtcatcagtcgagacattcaggcccctgacggtctggccgttgattggatacattccaacatttactggactgacagcgtcctcgggactgtttcagttgctgatacaaaaggcgtgaagcgtaaaaccctttttcgcgagaacggatcaaagccccgcgccattgtggtagatcctgtgcacggattcatgtactggacagattggggtacccctgcaaagatcaaaaagggagggcttaacggagtcgatatctacagccttgtcacggaaaatattcagtggccaaatgggattaccctagacctgttgagtgggcgcctgtattgggtcgactctaaactccacagcatctcgtccatcgacgtcaatggcggaaatagaaagacaatactagaggatgaaaaacgactggcccatcccttttcgttagccgttttcgaggataaggtgttctggaccgacattatcaatgaggccatctttagcgccaatcggctcaccgggagcgatgttaatttactcgccgagaacctgctgtcacctgaggacatggttctcttccacaaccttacacagccccgcggggttaactggtgcgagcgaacaacactgtccaatggagggtgccaatacctttgtcttccagctccacagatcaatccacattctcctaaatttacatgtgcatgcccggatggcatgcttttggctcgcgacatgcgaagctgcctgacagaggcagaagccgccgtggccacacaagaaacctccaccgtgcgcctaaaggttagttccacagctgtacgcacacagcatacaacgactcgccccgtgccggatacatcccgcctgcctggcgctacacccggattgaccacagtcgaaatcgtcacaatgtctcaccaggcccttggagacgtagcgggccgcggcaacgaaaagaaaccgtcctcagtgcgagccctgtcaattgtgctgcccattgtactgcttgtcttcctgtgcctcggtgttttcttgctgtggaaaaactggcggttgaagaacattaattcaattaattttgacaatccagtttaccagaaaaccaccgaggacgaggtgcacatttgccataaccaggacggctactcctatccatctcgacagatggtcagcctggaagacgacgttgca

SEQ ID NO: 635 - DNA, 2580 bp, Artificial Sequence
  Description of Artificial Sequence: Synthetic Transcript Sequence
atggggccgtggggatggaagctccggtggaccgtggccctgctgcttgccgctgcaggtacagccgtgggggaccgctgcgagagaaatgagttccagtgtcaggacggcaagtgcatttcttacaaatgggtgtgcgacggatcagccgagtgccaggacggctcagatgagtcccaggagacttgtctgtctgtaacttgtaagagtggcgactttagttgtggagggcgggtgaatcggtgcatcccgcaattctggagatgtgatggccaggtagattgcgataacggatcagacgagcaagggtgccctcccaagacttgctctcaggacgagtttcggtgtcatgacgggaagtgcatttcccgccagttcgtttgtgactctgatagggattgccttgacgggtcagacgaggctagctgtcccgtgctgacatgcgggcccgcttccttccagtgcaattcttcaacctgcattccccagttgtgggcctgcgacaatgatccagactgcgaagatgggtctgacgagtggccgcagagatgccgcggactctatgtatttcagggtgactcaagcccctgcagcgccttcgaattccactgcctgtctggagaatgtattcacagttcctggaggtgcgacgggggcccagactgtaaggataagagcgatgaggagaattgtgcagtcgcaacctgcaggcccgatgaattccagtgcagtgacgggaattgtattcatgggtccaggcagtgtgatcgggagtacgactgtaaagacatgtctgacgaagtcgggtgcgtgaacgtaaccttatgtgagggccccaataagttcaaatgccatagcggggagtgtatcaccctggataaggtgtgtaatatggcccgggattgtcgagattggtccgacgagcctattaaggagtgcgggaccgcagcttgtttagacaacaatgggggatgtagtcatgtgtgcaacgccctgaagatcggggcagagtgcttatgtcctgatggatttcagttggtggcacagaggcgttgtgaggatattgatgagtgccaggatcctgacacctgttcgcaactgtgtgtgaacctggaagggggctacaagtgccagtgtgaagagggctttcagctcgacccacacacaaaggcctgtaaggctgtcggctctattgcctacctgttcttcactaaccgccatgaagtgaggaagatgacccttgacaggtccgaatatacatcacttattccaaaccttcgaaatgtcgtggcccttgacaccgaagttgcatcaaatagaatttattggtccgacctcagtcaacgaatgatatgtagtacacaacttgatcgggcacacggcgtctcttcttacgatactgtgatttccagggatatccaagcacctgacggactagctgtggactggattcattccaatatatactggactgactcggtccttgggaccgtctccgtggccgacaccaaaggtgtcaagaggaaaacacttttcagagagaacggatccaagcctagagccattgtggtagaccccgtgcatggcttcatgtattggacagactggggtactcccgcaaaaatcaagaagggtggcttgaacggcgtggacatctacagcctcgtcacggaaaatatccagtggcctaacggcattactctcgacttgcttagtgggcgcctgtactgggtcgactccaaactccatagcatctctagcatagatgtgaacggcgggaatagaaaaactattctcgaggacgaaaaaaggctggctcatcctttcagtttggcggtgttcgaagacaaggtgttctggacagatattatcaacgaggctattttttccgccaaccgactcacaggttctgacgtcaatcttctggctgaaaatttgctatctccagaggacatggtactttttcacaatctgactcagcctagaggcgtgaattggtgcgagaggactaccctatcaaatggcggctgtcagtatttatgtctccccgcccctcagatcaatccccacagccccaagttcacctgcgcatgtcccgacgggatgctgctggcacgggacatgcgcagttgcctgaccgaggctgaggctgctgtagccacccaagagactagcacagtgcggctaaaagtgtcctcgaccgctgtgcggacgcagcacaccacaacgcgccccgtacctgacactagtagattgccaggagccaccccaggcctgacaaccgtcgagatcgttacaatgtcacatcaggccttgggagatgtcgcaggaaggggcaacgaaaaaaagccctcaagcgtgcgcgcgctctcaatcgtccttccaatcgtgctgctggtcttcctgtgcctaggcgtgttcttgctgtggaaaaattggcggctgaaaaacatcaattctatcaacttcgacaaccccgtataccagaagaccactgaagatgaagtgcatatatgccacaaccaggacggctattcatatccctcaaggcagatggtcagtctggaggacgatgttgcc

SEQ ID NO: 636 - DNA, 2580 bp, Artificial Sequence
  Description of Artificial Sequence: Synthetic Transcript Sequence
atgggcccctggggatggaagctgcggtggaccgtcgcactgctactagccgccgctggaaccgccgtgggagacaggtgtgagagaaatgaattccagtgtcaggacggcaaatgcatcagttataagtgggtgtgcgatggctccgccgagtgccaggacggctcagacgagtctcaggaaacatgcttgtcggttacttgcaagtccggcgatttctcgtgtggaggccgagtgaacaggtgcataccccagttctggaggtgtgacggacaggtcgactgcgacaatggcagcgacgaacaggggtgcccaccaaagacttgctctcaggatgagttccggtgtcacgacggcaagtgcatttcccggcaattcgtgtgcgatagcgaccgggactgtttagacggctccgacgaggcttcctgtccagttcttacatgcgggccagccagctttcagtgcaatagctcaacctgtattccccaactgtgggcatgtgataacgatccggattgtgaagacggcagcgatgagtggccccaaaggtgtcggggcctttatgttttccagggggacagttcaccttgcagcgcgtttgagttccactgcttgtcaggagaatgtattcacagcagctggcgctgcgatggaggccctgattgcaaagataaatcggacgaagaaaattgtgcagttgctacgtgtagaccggacgaattccaatgctccgacgggaattgcattcatggcagtagacagtgtgatagggagtacgactgcaaggacatgtccgatgaggttggctgcgttaatgttacactgtgcgaaggtccaaataaattcaagtgtcactcgggggaatgcatcaccttggacaaggtgtgtaacatggccagggactgtcgggactggagtgacgagccgattaaggagtgcgggacagctgcgtgcttggataataatgggggatgctcccatgtctgcaacgctctaaagatcggcgctgagtgcctatgccctgacgggtttcagctagttgcacaaaggcggtgtgaggacatcgatgagtgccaagatcccgatacatgctcccaattatgcgtgaacctggagggaggatacaagtgtcaatgtgaggaaggatttcagctcgacccccatacaaaggcctgtaaggccgtcggcagtatcgcatatttattttttacaaacagacacgaagtgagaaagatgaccttggatagatctgagtacaccagcctgattcctaacctgaggaatgttgtcgcccttgacaccgaagtggcctccaaccgaatctactggagcgacttgagtcagcgtatgatttgtagcacacagctggaccgggcacatggcgtgtcgtcatatgacaccgttatttcacgtgacatccaggcacccgacggcctcgctgtggactggatccactctaacatttactggacggatagcgttcttggtacggtgagcgtagccgacaccaagggcgtgaagcggaaaacattgtttagggagaatggcagtaaaccaagggctattgtggtggacccagtccacggtttcatgtactggaccgattgggggactcctgccaagatcaaaaagggcgggctcaacggcgtggacatctactctttagtgactgaaaacatccagtggccgaatgggatcacactggacctcctctcagggcgcctgtactgggttgatagcaagctgcactctatcagttccatcgatgtaaacggcggtaataggaaaaccatccttgaagatgagaagcgcctggcacatcccttttctctggccgtgtttgaagataaggtattctggacagacatcatcaacgaagccattttttcagctaaccgattgactggaagcgacgtcaatcttttggccgagaatcttctgagccctgaggacatggtgctgtttcacaacctgactcagccccgcggagttaattggtgcgagagaacaacactgagtaacgggggttgtcagtatctctgtctgcccgccccacagataaatccgcactcacccaaatttacctgtgcctgccccgatggcatgttactggctagggacatgagatcttgtctgaccgaggctgaagctgccgtggctacacaagaaacgtcgacggtacgcctgaaggtgagttcaactgccgtccgcacccagcacacgacaacgcggcctgtccccgacacctcccgcctccctggagcaacccccggattgactacggtagaaattgtgaccatgtctcaccaggcactaggagacgtggccggaaggggaaacgaaaagaagccgtcttccgtgcgcgcgctatctatcgtcctgccaatcgtcttgctagtatttttgtgccttggagtattcttactctggaagaattggagactcaaaaacatcaactccataaactttgataatcccgtgtatcaaaaaaccactgaggatgaagtgcacatttgccataatcaggatggatactcctatccctcgcgccagatggtcagcctggaggacgatgtggct

SEQ ID NO: 637 - DNA, 2580 bp, Artificial Sequence
  Description of Artificial Sequence: Synthetic Transcript Sequence
atgggtccctggggatggaaactgcgctggaccgtcgccctcctcctggccgctgctggcactgccgtcggggatcgctgcgaacggaacgagttccaatgccaagacggtaagtgtataagctataaatgggtgtgcgatggttccgcagaatgccaagacggatctgacgagtcgcaagaaacttgtttgtccgtgacatgtaagtcaggagattttagttgtggtgggagagtgaaccgatgtataccacaattctggaggtgcgatggccaggtcgattgcgataacggatcggatgagcaaggttgccctcccaaaacttgcagccaggacgagtttcggtgtcatgatgggaagtgcattagccgtcagtttgtgtgtgactccgaccgtgattgtctggatgggagcgacgaagcttcctgccctgtgttgacttgtggaccagcaagttttcagtgtaacagctccacctgcattccacagctgtgggcctgcgataatgatcctgattgtgaagacgggtctgatgagtggccacagagatgccgggggctctacgtatttcagggcgattccagcccgtgctcagcatttgagttccactgcttgagtggcgagtgtatccactcatcctggaggtgcgacggtggccccgactgcaaggacaaatcagacgaagagaactgcgcagtagccacgtgtcggcctgatgaattccagtgtagcgatggaaattgcattcacggtagtagacaatgcgatcgtgagtacgactgtaaggatatgtctgacgaggtgggatgtgtcaatgtgaccctgtgcgagggcccgaataagtttaaatgtcactccggcgaatgcatcactctcgacaaggtgtgtaacatggcccgcgattgccgagattggtccgacgaaccaatcaaagagtgtgggacagccgcctgtctcgacaataacggtggctgtagccacgtgtgcaatgccctgaaaataggcgccgagtgtctttgccctgacgggttccagctggtagcacagcgaaggtgcgaggatatcgatgagtgccaggatcccgatacctgtagccagctctgtgtcaatttggaaggcggatataaatgccaatgcgaagagggttttcagctggatccgcatacgaaggcgtgtaaggcggttggatccattgcctaccttttctttaccaatcgtcatgaggtgcgcaaaatgacacttgatagatcggagtacacatcattaattcccaaccttcgaaatgttgtggcacttgacactgaggtggcttcgaaccgcatttactggtccgatctgtctcagcggatgatttgttcaactcagcttgatagagctcacggggtttcatcttacgacactgtgatttcaagagatatccaggcccccgacggcctggccgtggattggatacacagcaatatctactggaccgactccgtccttggaaccgtctcagtcgccgacaccaagggtgtgaaacggaaaaccctgttcagggagaatggcagtaagcctcgggccatcgtagttgatccagtacatggctttatgtattggaccgactggggcacacctgcaaagattaagaaaggcgggctgaacggggtcgacatctattcgctggtgacagagaatatccagtggcccaatggcattactttggacttgttgagcgggcggctgtactgggtggacagcaagctgcatagcataagtagcattgatgtgaatggggggaaccgcaaaacaatcctcgaagatgaaaaacgtctagcacaccccttcagtttggcagtattcgaggacaaagtgttttggacggatattatcaacgaggccatcttttccgcgaatcggctgaccggcagtgacgtgaatttgctagccgagaacctgctgagtcctgaggacatggttttgttccataacttaacccagccaagaggcgtcaattggtgcgagagaacaactttatcgaacggaggatgccaatacctgtgcttacccgcaccccagattaacccccattccccgaaatttacctgcgcctgtcctgatggcatgctactcgctcgagacatgaggtcttgtcttactgaggctgaggccgccgtcgccactcaggaaacctcaacagtgaggctcaaagttagcagtaccgcagtaaggacacagcacaccacgactcgcccagtgccagacacttcacgtctgccaggcgccaccccggggctgaccaccgttgagattgtgactatgtctcaccaagcattaggtgacgtcgccggaagagggaacgaaaagaagccatccagtgttagggcacttagcattgtcttaccgatagtgctgttagtgttcctttgccttggggtcttcttactgtggaagaactggagactgaagaacatcaatagcatcaactttgacaacccagtgtatcagaagactactgaagatgaagtccacatctgtcacaaccaggatggttactcatacccctctcgacaaatggtgtcactggaagatgacgtcgca

SEQ ID NO: 638 - DNA, 2580 bp, Artificial Sequence
  Description of Artificial Sequence: Synthetic Transcript Sequence
atgggaccgtggggatggaaactgaggtggactgtggccctcctcctggcggcagctggcacggccgtgggcgatagatgtgagcggaatgagttccaatgtcaggacggtaagtgcatctcctacaagtgggtctgtgacggatcggcagaatgccaagacggatcagatgagagccaagagacttgcctgagcgtgacttgcaaatcgggagatttctcctgtggaggacgcgtgaaccggtgcatccctcagttctggcgctgcgacggccaggtggattgtgacaatggatcggacgagcagggctgcccgccaaagacctgctctcaggatgaatttaggtgccacgacggaaagtgtatctcgcgccagttcgtgtgcgacagcgacagagactgcttggatggctccgatgaggcgtcgtgcccagtgctgacttgcggaccggcatcattccaatgcaatagctcgacttgcatcccacaactctgggcgtgcgacaacgatcccgactgtgaagatggatctgatgaatggcctcagaggtgccgcggactctatgtctttcagggcgactcgtccccatgctcagccttcgaattccactgcctcagcggagaatgtattcattccagctggcgttgcgacggaggcccggattgcaaggacaagtcggacgaggaaaactgcgccgtggccacttgccggcctgacgagttccagtgcagcgacggaaactgtatccacggcagcaggcagtgcgaccgggagtacgattgcaaagacatgtccgatgaagtgggttgtgtgaacgtcaccctctgtgaaggaccgaacaagttcaagtgccactcaggagaatgcattactctcgataaggtgtgcaatatggcccgagactgccgcgattggtcggatgaacccatcaaagaatgtggaactgccgcctgcctggacaacaatggagggtgctcgcacgtctgcaacgccctgaaaattggagctgagtgcctgtgcccggacgggttccagcttgttgcccagagacgttgcgaggacattgatgagtgtcaggaccccgatacttgcagccagctctgcgtcaatttggagggaggctacaagtgtcaatgcgaggagggattccagctggacccacataccaaggcctgcaaggctgtgggatccatcgcgtatttgtttttcacgaatcgccacgaggtgcgcaaaatgacgcttgatcggtcggagtacacttctctgatacctaatcttagaaatgtggtggccctcgacacggaagtggctagcaaccggatctattggtccgacctcagccagaggatgatctgttcgacccagttggaccgggcccacggcgtgagcagctatgataccgtgatctccagagatatccaggccccagacggactcgcggtggactggatccattccaacatctactggaccgattccgtgcttggtaccgtctcggtcgcagatactaagggagtgaagaggaaaaccctgttccgcgaaaatggatccaaaccgcgggctatcgtggtggaccccgtccatggattcatgtactggaccgactggggaaccccggcaaagatcaagaagggaggacttaacggcgtcgacatctactcactcgtgaccgagaacatccagtggcctaacggaatcaccctggatctgctcagcggtcggctgtactgggtggatagcaaattgcattcgatctcctcaatcgacgtcaacggcgggaaccgcaaaaccatcctggaggacgaaaagcgccttgcccacccgttttcacttgccgtgtttgaagataaggtgttctggaccgatatcattaacgaagccatcttctcagctaatcggttgactggatcggacgtgaacctgctggccgaaaatctcctgagcccggaggatatggtgctgttccacaacctgacccaaccgcggggagtgaattggtgcgagcgcaccacgctctcgaatggaggctgtcagtacctgtgcttgcctgctcctcagatcaatccgcactcgccaaagttcacgtgtgcctgcccggacggaatgctgctcgccagagacatgcgctcctgcctgaccgaggccgaagcggcggtggcaacccaggagacgtctaccgtgcgcctgaaagtctcgtcaaccgcagtccggactcagcataccaccaccagaccggtgccggatacttcacgcctgccgggagccaccccgggactcactactgtggagatcgtgactatgagccaccaagctctgggagacgtcgctggacggggtaacgaaaagaagccgtcatcagtgcgcgcgctgagcatcgtgctgccgatcgtgctcctggtctttctgtgcctgggagtgttcctgctctggaaaaactggaggcttaagaacatcaactcgatcaatttcgacaacccggtctaccaaaagactaccgaggatgaggtccacatctgccataatcaagacggttacagctacccctcacggcagatggtgagcctggaagatgatgtggca

SEQ ID NO: 639 - DNA, 2580 bp, Artificial Sequence
  Description of Artificial Sequence: Synthetic Transcript Sequence
atggggccatgggggtggaagttgcggtggactgtggctctgctgctggcggcggcgggcactgcagtcggagacagatgcgaacggaacgaattccagtgccaagacgggaaatgcatcagctacaagtgggtgtgcgatggaagcgcggagtgccaggatggaagcgacgaatcccaagagacttgcctctcagtgacctgtaagtctggtgactttagctgtggcggtagggtcaacagatgcattccacaattctggaggtgcgatggtcaagtcgattgcgacaacgggtcagacgaacaggggtgtccgccaaagacttgctctcaggatgagtttagatgccacgacggcaagtgcatttcaagacaattcgtgtgtgactccgaccgcgactgcctggacggctccgatgaggcttcgtgcccggtgctgacctgcggccccgcgtcgtttcaatgcaacagttcgacctgtattccccagctctgggcatgcgataacgacccggactgcgaagatggtagcgacgaatggccccagcggtgccgcggcctctacgttttccaaggagattcctccccttgctcggcctttgagttccattgcctctcgggggaatgcatacatagctcgtggcgctgcgatggaggacctgactgcaaggataaatcagatgaggagaactgcgccgtggctacctgccgaccagacgagttccagtgctccgacggaaactgtatccacggcagccgccagtgcgatcgcgaatacgattgcaaggacatgtcagatgaagtggggtgcgtgaacgtcactctgtgcgagggacccaataagttcaaatgccattcgggcgagtgtatcacccttgataaggtgtgcaacatggcacgggactgccgcgactggtcagacgagcctatcaaagagtgcggcaccgcagcctgcctggacaacaatggaggttgctcccatgtttgcaatgctctcaaaatcggcgccgaatgtctgtgcccggacggatttcagctggtggcccagagacgctgcgaagatatcgacgaatgccaggatcctgacacctgcagccagctgtgtgttaatctcgagggaggatacaagtgccagtgcgaggagggatttcagctcgacccacacaccaaggcctgtaaggcagtgggaagcatcgcttacttgttcttcactaaccggcatgaagtgaggaagatgaccttggaccgcagcgaatatacttccctgattccaaacttgcggaacgtggtcgcgctggacaccgaagtcgcttccaaccgcatctactggtcagacctgagccaacgcatgatctgctccacccagctggaccgcgcccacggggtgtccagctacgatactgtcatctcccgggatattcaggcaccggacgggctcgcggtggattggattcattccaacatctattggacggacagcgtcctcggcaccgtgtcagtggccgacaccaagggagtgaagagaaaaaccttgtttagagaaaacggttcgaagccgcgggcgatcgtcgtggaccccgtgcatggattcatgtactggaccgactggggcaccccggccaaaatcaaaaaaggcggcctgaatggagtggatatctactcactggtcaccgagaatatccagtggccaaacggaatcactctggaccttttgtcagggaggctctactgggtggattccaagctccactcgatttcctcgatcgacgtaaacggaggaaaccgaaaaactatcctggaagatgagaagcgcctcgcgcacccgttctcgctggccgtctttgaggataaagtgttctggacggacatcatcaacgaagcgatcttcagcgcgaatcgcctgactggttcagacgtcaacctcctggccgagaatctcttgtcgccagaggacatggtgttgttccacaatttgactcagccgcgaggagtgaattggtgcgagcgtaccaccctctcgaatggaggatgccaatacctgtgcctgccagctccacaaatcaacccgcactccccgaaattcacttgcgcctgccctgatggtatgctgttggcccgcgacatgagatcgtgccttaccgaagccgaggcggcagtggcgacccaggagacttccacggtcagactgaaggtgtcctcgactgccgttaggactcaacataccactactcggccagtgccggacaccagccgtctccccggagcgaccccgggcctcacgactgtcgagatcgtgactatgtcgcaccaggcgctcggcgacgtggcgggacggggaaacgagaagaaaccaagctccgtgcgagcgcttagcattgtcctgccgatcgtccttctcgtgttcctctgcctcggagtgtttctcttgtggaagaattggcggcttaagaacattaactctatcaacttcgacaatccagtgtatcaaaagaccactgaggatgaggtccacatctgtcacaatcaggatggatacagctacccgagccgccagatggtgtcgttggaggatgacgtagcg

SEQ ID NO: 640 - DNA, 2580 bp, Artificial Sequence
  Description of Artificial Sequence: Synthetic Transcript Sequence
atgggcccctgggggtggaaacttcgctggacggtggcactgctccttgcggccgcggggaccgcagtgggcgatagatgcgaacgtaatgagtttcaatgtcaagacggaaaatgtatatcgtacaagtgggtgtgtgatgggtcagcggagtgccaagacggatcagatgaatcgcaagaaacctgtctgtcggtgacctgcaaatccggagacttctcctgtggtggtcgcgtgaatcggtgtattccacagttctggcgttgtgatggccaagtcgattgtgacaacggctccgacgagcaagggtgtcctcctaagacttgttcgcaagacgaattccggtgtcacgatggaaagtgcatctcacgacagtttgtctgtgattccgaccgcgattgtcttgacggttcggacgaagcctcgtgtcctgtgcttacgtgtgggccagccagcttccaatgtaattcctcgacgtgtatacctcaactttgggcgtgtgataatgatcctgattgtgaagatgggtcggacgagtggccccaaagatgccgtggtctgtacgtgtttcaaggcgattcatcaccatgttcagccttcgagtttcattgtctgtctggcgaatgtattcattcgtcctggagatgtgatggcggacctgattgcaaggataagtccgatgaggagaattgcgctgtggcaacttgcaggcctgatgagttccaatgttcggatggaaactgtatccatggaagcagacagtgtgatcgggaatacgactgtaaggatatgtcggatgaggtcggctgtgtgaacgtgaccttgtgtgagggtccgaacaagtttaagtgtcacagcggtgagtgtattaccctggataaagtctgtaacatggcccgtgattgccgagactggtccgatgaaccgattaaggagtgtgggactgcagcgtgcctggacaataacgggggatgtagccacgtctgcaacgcgctgaagatcggcgcggaatgtctctgtcccgacggttttcaacttgtggcacaaagacggtgtgaagatattgatgaatgccaggatcctgatacctgttcccaactgtgcgtgaacttggaaggtggttacaagtgtcaatgcgaagaaggcttccaactggacccgcataccaaggcatgtaaggcggtgggttcaatcgcatatctcttctttaccaatagacacgaggtccgcaagatgactctcgatcgctcagaatacacctcgctgatacctaatctgcgcaacgtggtggcactggataccgaagtggcaagcaatcgaatttactggagcgacttgagccagcgaatgatatgctcaacccagctggaccgggctcatggggtcagctcgtacgataccgtgatttccagggatattcaagcacctgacggtctggcagtggattggatccatagcaacatatactggactgacagcgttctcgggaccgtgtcagtggcggatactaagggtgtgaaacgaaagactctgtttagagaaaacggatcgaagccaagagccattgtcgtggatccagtgcatggatttatgtactggacggattggggcaccccggcaaaaatcaagaaggggggacttaatggggtggatatctactcgcttgtcactgagaatatccaatggcctaacggaataactctcgatcttctgagcggtcggctctactgggtcgactcgaaacttcattcaatttcatcgattgatgtgaatgggggaaaccgaaaaactattttggaagatgaaaagaggctggcacatcctttttcgctcgctgtgttcgaagataaagtgttttggactgacattatcaatgaagcgattttctctgcaaatcgacttaccggttcggatgtgaatcttcttgccgaaaacctgctttccccagaagatatggtgctctttcataaccttactcaacctaggggcgtcaattggtgcgaaagaaccacccttagcaacggtggatgtcaatacctctgccttccagctcctcagattaacccacactcacccaagtttacttgtgcctgtcccgatggaatgctccttgcccgcgacatgagatcctgcctgaccgaagcggaagccgcagtggctacccaagaaacttcaaccgtccgactgaaagtctcctctaccgcagtccgcacgcaacatactaccaccagaccagttccagataccagccgtctgccgggagcaacccctggtctgaccactgtcgaaattgtgaccatgagccatcaagctcttggtgacgtcgcaggaagaggtaacgagaagaaaccgtcctcagtgcgggcgctgtcaattgtgctgccaatagtgctcctcgtgtttctgtgtctgggagtctttctgctttggaaaaactggcggcttaagaacattaactcaattaactttgataacccagtctaccaaaagaccactgaagatgaagtccacatctgtcataaccaagacggctactcctatccctcgcgacagatggtgagcctggaggatgacgtggct

SEQ ID NO: 641 - DNA, 2580 bp, Artificial Sequence
  Description of Artificial Sequence: Synthetic Transcript Sequence
atgggcccatggggatggaaactcaggtggacagtcgccttgctgctggctgccgctggtactgctgtgggcgaccgttgtgagaggaatgagttccaatgccaggatggcaaatgcatctcttataaatgggtatgtgacggctcagcagaatgtcaggacggctcggacgaaagtcaggagacttgtctttcagtcacgtgtaaaagtggtgatttctcatgtggaggtcgcgtgaatcggtgcatcccccagttttggcgctgtgatggccaggttgattgcgacaacggatctgatgaacagggttgtcctccgaagacatgcagtcaggacgagtttcgctgccacgatggcaaatgcatttccagacagttcgtttgcgactcagatcgagattgtttagacgggagtgatgaggcctcatgcccggtgctcacttgcgggccagcaagctttcagtgtaactcctccacctgcatccctcagttgtgggcctgcgacaatgacccagactgcgaggatgggtctgatgagtggccccagagatgccgggggctgtacgtgttccaaggagattctagtccgtgttcagcatttgagtttcattgtctctccggcgagtgcatccattcttcctggcgctgtgatggaggcccagattgcaaggacaagtctgatgaggagaattgcgcagtcgccacctgcaggcctgacgagttccagtgcagtgacggaaattgtatccacggctctaggcagtgtgatcgcgagtacgactgcaaagacatgagtgatgaagtaggctgcgtgaacgtgaccttgtgcgaagggcccaacaagtttaagtgtcattcgggggagtgcattactttagataaggtgtgcaatatggctcgggactgccgcgattggagcgatgaacccatcaaagaatgtggcacagcagcctgtctagacaataacggaggatgttcccacgtctgtaacgcactcaagattggggctgagtgtctgtgccccgacggattccaattggttgctcaacggcggtgcgaggatattgacgagtgccaggatccagacacgtgttcgcagttgtgtgttaatcttgaaggaggttataagtgccagtgtgaggagggcttccagctcgacccccacaccaaggcgtgcaaggccgttgggtctattgcatacttgttttttactaatcggcatgaagtgaggaagatgactctggatcggagcgagtacacatctctaatacccaacctgcggaacgtggtggccctcgataccgaagtagcatccaatagaatatactggagtgatttaagccagcgcatgatctgctccactcaacttgatagggctcatggggtctcgtcctatgacactgtgatcagtagggatatccaagcccccgacgggcttgccgtggactggattcattcaaacatttattggaccgactcggtgctggggactgttagcgtggcagacaccaagggcgtaaaacgcaaaacactgtttagagaaaacggtagtaaacctagggccatcgtagtcgatccagtgcacggcttcatgtattggaccgactggggcacccccgctaaaattaagaaaggggggttgaatggcgtggacatctattcgctggtgactgaaaacatacagtggcctaatggaattactctggatctgctcagcggaaggctgtattgggtggatagtaagctgcattctatttcgagcattgacgtaaacgggggaaatagaaagacaattctagaggatgagaagagactggcccatccattttctttagccgtttttgaagacaaagtgttttggacagatattatcaacgaggccatttttagcgcgaaccgactcaccggaagtgacgtgaacctgcttgctgagaacttgttaagtccagaggatatggtgctgttccataacttgacacagccacggggtgtcaattggtgcgagcgaaccacattgagtaacggagggtgccagtatttgtgtctccccgctccccagataaacccccattcaccaaagttcacatgtgcctgcccagacggaatgctactggcacgggacatgcgttcatgcctgactgaggctgaggccgcggtggccacccaggagacatccaccgttcgcttaaaagtgagttctactgcagtgcggactcaacatacaacgactcgacccgtgcctgacacttcccgtcttcctggggctacaccaggactcaccactgttgaaatcgtaacaatgagtcatcaggccctgggggatgtggctggccgggggaacgaaaaaaaaccttccagcgtgcgcgccttatctatcgtgctccctatcgtgttgctggtgtttttgtgcctgggtgtgttccttctctggaaaaattggcgcctgaagaacattaactctatcaattttgataaccctgtctatcagaaaactacagaagatgaagtgcacatctgtcacaatcaggatggctatagttatcctagccgccagatggtgtccctggaagatgacgtagcc

SEQ ID NO: 642 - DNA, 2580 bp, Artificial Sequence
  Description of Artificial Sequence: Synthetic Transcript Sequence
atggggccatgggggtggaagctccgctggaccgtcgcattgctgctggccgccgccggtaccgccgtgggagatcgctgcgaaagaaacgaatttcaatgtcaagacggaaaatgcatatcctacaaatgggtgtgtgacggatcggctgaatgtcaggatggatcggacgagtcgcaagaaacctgtctgagcgtcacctgtaagtcgggagatttcagctgcggaggaagagtgaaccgctgcattccgcaattttggcgctgtgacgggcaagtggactgcgacaacggttccgacgaacagggatgcccaccaaagacttgttcacaagatgaattcaggtgtcatgacggaaagtgcatttctcgccagttcgtctgcgattcggaccgcgattgcctcgatggatctgacgaggcctcctgcccagtgctgacctgcggccctgctagcttccaatgcaactcctcgacttgcatcccgcagctgtgggcttgcgataatgatcctgactgcgaggacgggtcagatgagtggccgcaaaggtgtcggggactctacgtgtttcagggagattcttcgccgtgctcagcgttcgaattccactgcctgtcgggggaatgcatccacagctcttggagatgcgacggggggcctgattgcaaagacaaatctgatgaggagaactgcgcagtggcaacttgccgccctgacgagttccaatgttcggatggaaactgcatccacggcagccggcagtgtgacagagaatacgactgcaaagacatgtccgatgaggtgggatgtgtgaatgtgaccctgtgcgaggggccgaacaagttcaaatgtcacagcggcgaatgcatcaccctggacaaggtctgtaatatggccagagattgccgcgattggtcggacgaacctatcaaggagtgcggcaccgcggcctgccttgataacaatggaggctgttcgcacgtgtgcaacgcactgaaaatcggagctgaatgcctctgcccggacggattccagctcgtggcgcagagacgctgcgaagatatcgacgagtgtcaagacccagatacttgctcccagctctgcgtgaacctggaggggggatacaagtgtcagtgcgaagaaggtttccaacttgacccccataccaaggcgtgtaaggcggtgggttcgattgcatacctgtttttcactaatagacacgaagtgaggaagatgaccctggatcgcagcgaatacacctcgctgatccccaatctccgaaacgtcgtcgcccttgataccgaggtcgcatcgaaccggatctactggtcggacctgagccagagaatgatatgctcgacccagcttgaccgcgctcatggggtgtcgtcctacgataccgtcatctcacgtgatatccaggcaccggacggactggcagtcgactggatccattcgaacatctactggactgattcagtgctcggaactgtttcagtggctgacactaaaggagtcaagcggaaaactctgttccgcgaaaacggatcgaaaccgcgggcgatcgtggtggacccggtccatggtttcatgtactggaccgactggggcactccagcgaagattaagaaaggtggattgaacggagtggatatctactccttggtgacggagaatatccagtggccgaatggaatcactcttgatctgctgtcaggacggctctactgggtcgattcgaagttgcacagcatctcatccatcgacgtgaatggaggaaaccgcaagactatcctcgaagatgaaaagagattggcccacccgttcagcctggccgtgttcgaggacaaggtgttctggaccgatatcatcaacgaagctatcttctccgctaaccgtctgactggctccgacgtgaacctgctggcggagaacctgctgtcgccagaggatatggtcctcttccacaacctgacccagcctcggggcgtgaactggtgcgagagaaccactctttccaatggtgggtgtcaatacctgtgccttcctgccccgcagatcaatccccattcgcctaagttcacctgcgcctgtccggatggaatgctgttggcgcgggatatgcggtcgtgcctgaccgaagccgaggcggcagtcgccactcaagaaacgtccaccgtgagactgaaagtgtcctcgactgctgtgaggacccagcacaccactaccaggccggtcccagatacttcccggcttccgggagctactccgggactgactaccgtcgagatcgtgaccatgtcgcaccaggcactgggagacgtggcgggacggggcaacgagaagaaaccttcatcagtccgcgcactgtcgatcgtgctgccgattgtgctgctggtctttctttgcctgggagtctttctgctgtggaagaactggcggctcaaaaacatcaactccatcaattttgacaatccggtgtaccaaaagaccaccgaggacgaggttcacatctgccataaccaggacggatactcctatccgtcacggcaaatggtgtcattggaggacgacgtggcc

SEQ ID NO: 643 - DNA, 2580 bp, Artificial Sequence
  Description of Artificial Sequence: Synthetic Transcript Sequence
atgggtccgtggggttggaaactacgttggacggttgcgttattattagcggcggcgggtacggcggtaggtgatcgatgtgaacgtaatgaatttcaatgtcaagatggtaaatgtatatcgtataaatgggtttgtgatggttcggcggaatgtcaagatggttcggatgaatcgcaagaaacgtgtttatcggtaacgtgtaaatcgggtgatttttcgtgtggtggtcgtgtaaatcgatgtataccgcaattttggcgatgtgatggtcaagtagattgtgataatggttcggatgaacaaggttgtccgccgaaaacgtgttcgcaagatgaatttcgatgtcatgatggtaaatgtatatcgcgtcaatttgtttgtgattcggatcgagattgtttagatggttcggatgaagcgtcgtgtccggtattaacgtgtggtccggcgtcgtttcaatgtaattcgtcgacgtgtataccgcaactatgggcgtgtgataatgatccggattgtgaagatggttcggatgaatggccgcaacgttgtcgtggtctatatgtatttcaaggtgattcgtcgccgtgttcggcgtttgaatttcattgtctatcgggtgaatgtatacattcgtcgtggcgatgtgatggtggtccggattgtaaagataaatcggatgaagaaaattgtgcggttgcgacgtgtcgaccggatgaatttcaatgttcggatggtaattgtatacatggttcgcgtcaatgtgatcgtgaatatgattgtaaagatatgtcggatgaagttggttgtgtaaatgtaacgttatgtgaaggtccgaataaatttaaatgtcattcgggtgaatgtataacgttagataaagtatgtaatatggcgcgagattgtcgagattggtcggatgaaccgataaaagaatgtggtacggcggcgtgtttagataataatggtggttgttcgcatgtttgtaatgcgctaaaaataggtgcggaatgtttatgtccggatggttttcaattagttgcgcaacgacgttgtgaagatatagatgaatgtcaagatccggatacgtgttcgcaactatgtgttaatctagaaggtggttataaatgtcaatgtgaagaaggttttcaactagatccgcatacgaaagcgtgtaaagcggtaggttcgatagcgtatttattttttacgaatcgacatgaagttcgtaaaatgacgttagatcgatcggaatatacgtcgttaataccgaatctacgaaatgttgttgcgctagatacggaagttgcgtcgaatcgtatatattggtcggatctatcgcaacgaatgatatgttcgacgcaattagatcgagcgcatggtgtttcgtcgtatgatacggtaatatcgcgagatatacaagcgccggatggtctagcggttgattggatacattcgaatatatattggacggattcggttctaggtacggtttcggtagcggatacgaaaggtgtaaaacgtaaaacgttatttcgagaaaatggttcgaaaccgcgagcgatagtagtagatccggtacatggttttatgtattggacggattggggtacgccggcgaaaataaaaaaaggtggtttaaatggtgtagatatatattcgttagtaacggaaaatatacaatggccgaatggtataacgctagatttattatcgggtcgtctatattgggttgattcgaaactacattcgatatcgtcgatagatgttaatggtggtaatcgaaaaacgatactagaagatgaaaaacgtctagcgcatccgttttcgttagcggtatttgaagataaagtattttggacggatataataaatgaagcgatattttcggcgaatcgattaacgggttcggatgtaaatttattagcggaaaatctactatcgccggaagatatggtactatttcataatttaacgcaaccgcgtggtgtaaattggtgtgaacgtacgacgttatcgaatggtggttgtcaatatttatgtctaccggcgccgcaaataaatccgcattcgccgaaatttacgtgtgcgtgtccggatggtatgttactagcgcgagatatgcgatcgtgtctaacggaagcggaagcggcggtagcgacgcaagaaacgtcgacggtacgtttaaaagtttcgtcgacggcggttcgtacgcaacatacgacgacgcgaccggtaccggatacgtcgcgactaccgggtgcgacgccgggtctaacgacggtagaaatagtaacgatgtcgcatcaagcgttaggtgatgtagcgggtcgtggtaatgaaaaaaaaccgtcgtcggtacgagcgctatcgatagtactaccgatagttttattagtttttttatgtctaggtgtttttctattatggaaaaattggcgattaaaaaatataaattcgataaattttgataatccggtatatcaaaaaacgacggaagatgaagtacatatatgtcataatcaagatggttattcgtatccgtcgcgtcaaatggtatcgctagaagatgatgttgcg

SEQ ID NO: 644 - DNA, 2580 bp, Artificial Sequence
  Description of Artificial Sequence: Synthetic Transcript Sequence
atgggaccctggggatggaagctcagatggactgtcgccctgctcctggccgcagccggcaccgctgtcggtgatcggtgcgaacggaacgaattccaatgtcaagacggaaagtgtataagctacaaatgggtctgcgatggttcagccgaatgtcaagatgggtcggacgaatcacaggagacgtgtttgtcagtgacctgtaagagcggagattttagctgtggcgggcgagtgaaccgctgtatcccacaattttggaggtgtgatgggcaagtggattgtgacaacggttccgatgaacaaggttgccccccaaaaacctgctctcaagatgagttcaggtgtcatgatggcaagtgtattagcagacaatttgtctgtgattcagacagggattgcctcgacggtagtgacgaagcatcgtgccctgtgcttacgtgtggtcccgcatcatttcaatgcaactcttctacttgtatccctcaactgtgggcgtgcgacaacgatccagattgtgaggacgggtcggacgagtggccacaaaggtgtcgtgggctttacgtttttcagggggactctagcccctgctcggccttcgaattccactgtctgtcgggcgagtgcatacattcctcctggcggtgtgatggtggacctgactgtaaggataagtccgatgaggaaaattgtgccgtcgcgacttgtaggcctgatgagtttcaatgctcagacggaaactgcattcacgggagcagacagtgtgaccgggaatacgattgcaaggacatgagcgatgaagtgggatgtgtcaacgtgaccctttgcgaaggaccgaacaagtttaagtgtcattcaggagaatgcattacccttgacaaggtgtgtaacatggcgcgggactgcagagactggtccgacgaacctatcaaggagtgtggaacggcggcctgtttggataacaacggaggctgctcacatgtgtgcaacgcattgaaaataggggcagaatgtctgtgtcccgatggtttccaacttgtggcacaaagacgctgtgaagatattgatgaatgtcaggatccagacacctgttcgcaactgtgtgtcaaccttgaggggggttacaaatgtcaatgtgaagaaggatttcagctggatccgcatacgaaggcgtgtaaggcagtcggttcgatagcatacctgttctttactaaccgccacgaagtgcgaaaaatgactctggaccgttcggaatacacttcccttattcccaatcttcggaatgtggtcgcgctggatactgaggtggcatcaaaccgcatttactggtcggatctctcccaaagaatgatttgttccacccagctggaccgggcacatggcgtgtcaagctatgatactgtcatttcaagagacatacaagccccagatggacttgctgtggactggatccattcaaacatttactggactgatagcgtgctcggtaccgtgtccgtggcagacactaagggagtcaagaggaaaaccctctttagggagaacggatccaaaccccgcgctatcgtggttgatccagtccatgggttcatgtactggactgactggggcactcctgcaaagattaagaaaggtggtcttaatggggtggacatttactcgctggtcaccgaaaacatccaatggcctaatggaattaccctcgatttgctttcggggcggctgtactgggtcgattccaaacttcattccattagttctatcgatgttaacggaggcaatcgcaaaactatactggaggacgagaagcgactcgcccatccgtttagcctggcagtctttgaggacaaggttttttggaccgacattatcaacgaagcaatcttctcagcaaatcggcttaccggatccgatgtgaatctcctggcagagaacctgctgtcacctgaagatatggtgttgttccataacctcactcaacctaggggtgtcaattggtgtgaacgcactacgctgtcaaacgggggctgtcaatacctttgcctgcctgcaccacaaatcaatcctcactccccaaagttcacctgcgcctgtcctgacgggatgctcctggcgcgcgatatgaggagctgcctgactgaagcagaagctgcagtggcaactcaggaaaccagcactgtccgtctgaaggtcagctcaaccgctgttcgtacccaacacaccaccactcgaccagttccggacacctcgcgcctccccggagccacccccggcctcaccaccgtggaaattgtgaccatgagccatcaggcattgggagatgtcgcaggaaggggaaatgagaagaagccttccagcgtgagggcgctctcaattgttcttccaatcgtcctgcttgtgtttctgtgtctgggtgtgtttctgctgtggaagaattggcggcttaagaacattaactcaatcaattttgataatccagtgtaccaaaagactactgaagatgaagtgcatatctgccataatcaagatgggtactcctacccttcaagacaaatggtgtcacttgaagatgatgtggcg

SEQ ID NO: 645 - DNA, 2580 bp, Artificial Sequence
  Description of Artificial Sequence: Synthetic Transcript Sequence
atggggccgtgggggtggaaacttcggtggaccgttgctttattgctggccgctgcaggtaccgccgttggcgaccgctgcgagagaaatgagttccaatgtcaggatgggaaatgtatctcatacaagtgggtctgtgatggaagtgccgaatgtcaggacggttccgacgagagtcaggaaacctgtctgagtgttacttgtaaatccggggatttcagctgtgggggaagggttaacaggtgcattccacagttttggcggtgtgatgggcaagtggactgtgacaatgggagtgatgagcagggctgccccccgaagacctgtagtcaggacgagttccgctgccacgacggtaaatgcatttcaagacaatttgtctgtgattctgaccgcgactgcctggacggatcagacgaggcttcttgtcctgtcttgacgtgtggaccagccagtttccagtgcaatagtagcacttgcatcccacagctttgggcttgtgataacgaccccgactgtgaagacggatctgacgagtggccccagcgctgtaggggactgtacgtgtttcagggcgactcttctccttgctctgccttcgaattccactgtttaagtggagagtgtatccacagctcgtggcgctgcgacggaggcccagattgtaaggacaagtctgacgaagagaactgtgcagttgctacctgtcggcctgacgagtttcaatgctccgacggaaattgtatccatggtagcagacagtgtgatagagagtatgactgcaaggacatgtccgacgaagtgggctgtgtcaacgtgactctgtgcgagggtcctaacaaatttaaatgccatagtggtgagtgcatcactctcgataaggtgtgcaacatggcccgggattgtagagattggtctgatgagcctatcaaggagtgtggcacagccgcatgtctggataataatggaggttgctcccatgtctgtaatgcgttgaagataggagcggagtgcctctgccccgacgggttccagttggtagcccagcgacgctgtgaggacatagatgaatgccaggatccggacacatgcagtcagctttgtgtgaacctcgagggaggatacaagtgccagtgcgaggagggctttcagctggatccacacacgaaagcatgcaaggcggtaggctctattgcctatttattctttacgaaccggcatgaagtgagaaagatgaccctagatcgcagcgagtacacttccctgatccccaacctgcggaacgtggtggctctcgataccgaggtggcgagtaataggatttactggagcgacttgtcccaacggatgatatgcagcactcagctcgacagggcacacggcgtgtcatcctatgacactgtgataagccgggacatacaggcaccagacgggctcgccgtcgactggatccactcaaacatctactggacagactccgtcctggggaccgtttccgtcgcggacactaagggggttaaacgcaagacactgtttagagagaacggctcgaagccaagagcaattgtggtggaccccgtgcatggatttatgtactggactgattggggaacccctgcgaagatcaagaaaggcggtttgaacggggtggacatttacagcttggtgaccgagaatatccagtggccaaacggaataactttggatctcctttcaggaaggctctactgggtggattcaaagcttcactccatcagctctatcgacgtcaatggcgggaaccgtaaaaccatcctcgaggacgaaaaacgactggcccacccattcagccttgccgtgttcgaggataaggtgttctggacagatatcataaatgaagcaatttttagcgctaacagactaactggctcggatgttaacctcctggcggagaatctgttgtctccagaggacatggtgttgttccacaacttgacccagccgagaggggtgaattggtgcgaaagaactaccttgtctaatggagggtgccaatatctgtgcttgccggcacctcagataaatccgcattccccaaagtttacctgcgcctgtcctgatggtatgctcttggcgagggacatgaggtcttgtctgaccgaggccgaggcggcggtagctacacaggaaacctccactgtgaggctaaaggtctcttcaacagccgtcaggacacagcacaccacaacaagacccgtgcccgatacctcgcgtcttcccggagccacgcccggcttgaccacagtggagatagtcactatgagtcatcaggcactcggtgacgtggctggcaggggtaacgaaaagaagcccagctccgtacgcgcactttcaatcgtcctgcctatcgttctcctggtgttcctatgcttgggcgtgttccttctgtggaagaactggcgactgaagaacattaactccattaacttcgacaaccctgtgtatcaaaaaactaccgaggatgaagttcatatctgtcataatcaggatggatattcataccccagcagacaaatggtgtctctggaagatgatgtggcc

SEQ ID NO: 646 - DNA, 2580 bp, Artificial Sequence
  Description of Artificial Sequence: Synthetic Transcript Sequence
atgggtccctgggggtggaagctgcgatggacggtcgctttgctattggcggccgcgggtacagcagtgggtgataggtgcgagcgcaatgagttccaatgccaggacggcaaatgtatatcatataagtgggtgtgcgatggttcggcggagtgtcaggacggaagcgacgagagtcaggagacgtgcctgtccgtgacctgcaaatccggggacttctcgtgtggtggccgcgtgaataggtgtattccacaattctggcggtgcgacggccaggttgactgtgacaatggaagcgacgagcagggctgtccgccaaagacgtgcagccaggacgagtttaggtgccacgatggaaagtgtatcagtcgtcagtttgtctgtgatagcgaccgggattgcctagacggatcagatgaggcaagttgtccagtgctgacttgcggccccgccagttttcagtgcaattcttcgacttgtatcccacagctttgggcttgcgacaatgatcccgattgcgaggatggatccgatgagtggccgcaacgctgccgaggtctatacgtgtttcagggtgacagttcgccttgtagcgccttcgaatttcattgcctgagcggcgaatgcatccacagtagctggcgctgtgacggtggaccagattgcaaagataagagcgatgaggaaaactgcgctgtggcaacttgtagacccgacgagtttcagtgcagcgatggaaattgcattcacggctcccgccagtgcgatcgtgaatacgactgcaaggatatgagtgatgaagtcggctgtgtgaatgttacgttatgtgaaggtccgaacaagttcaagtgccattcgggagaatgtataaccctggataaggtgtgcaacatggctcgggactgccgcgactggagcgatgaacccattaaggagtgcggaacagcggcttgtctagacaataatggtggttgcagccacgtttgtaacgcgctgaagatcggcgcagagtgtttatgcccagatggattccagctggtggcacagcgcagatgtgaggacatagacgaatgccaggaccccgatacatgctcccaactctgcgtgaacctggagggcggctacaaatgtcagtgcgaagaggggtttcaattggatcctcacacaaaagcttgcaaagccgtgggttcgatcgcctatctcttctttaccaatcgtcacgaggtgagaaagatgaccttggatcgttccgaatatacgagcctgattcccaacctgcgaaatgtggtggccctggatacagaggtggcctcgaaccgcatttactggagtgacttgagtcaacggatgatttgcagcacccagctggaccgcgctcacggcgtgtcgagctacgatactgtcatctcgcgggatatacaggcccccgatggtctagccgtcgattggattcattcgaacatatattggaccgattcagtgctgggaacggtgtcggtcgctgacactaaaggcgtgaagcgcaagacactcttccgggaaaatggcagcaagccccgcgctatcgtggtggatcccgtgcacggctttatgtactggactgattggggcactccagccaagatcaagaagggtggactgaatggtgtggacatctattccctggtgactgaaaatatacagtggccaaacgggataactctggacctgctgtcaggccgactttactgggtggacagtaagttgcactcgatctcatccattgatgtcaacggtggcaaccgcaagactatcctggaggatgaaaaacgtttggcccaccccttttcgctggcagtcttcgaggataaggtgttctggacagatattatcaacgaagccatattctccgccaatcggctaaccggtagcgacgtgaatctgttagccgagaacctgctgtcgccagaggatatggtattatttcacaatctgactcagccccgaggagttaactggtgcgagcgtacgaccttgtccaacgggggctgccagtacctgtgccttccagccccccagataaatccgcattcgcctaaattcacctgcgcttgccccgacggcatgctcctggcacgcgatatgcgctcgtgtctgactgaggcagaagctgcggtagcaacccaggagacaagcactgtgcgcctgaaagtgtctagcaccgcagttcgtacccagcatacaaccacccgtccagtacccgatacgagtcggctgcccggtgcgacccccggattgaccaccgtagaaatcgtgaccatgagccatcaagctctcggagacgtggcggggagaggtaacgagaagaagccatcgagtgtgcgggctctttcaatcgtactgccaatagtgctcctggtgtttctatgtctgggtgtcttcctgctgtggaagaattggcgtctgaaaaatatcaattccatcaattttgacaatcccgtgtatcagaaaacgacggaggacgaggtgcacatctgtcataatcaggacggttactcatatccgtctagacagatggtctctctggaggatgacgtcgcg

SEQ ID NO: 647 - DNA, 2580 bp, Artificial Sequence
  Description of Artificial Sequence: Synthetic Transcript Sequence
atgggcccctggggctggaaactccgatggaccgtggcccttttgcttgccgctgctgggaccgcagtgggcgataggtgtgaacgcaacgagtttcaatgtcaagacggaaaatgtatcagttataagtgggtctgtgatggcagcgccgagtgtcaggatggaagtgatgaaagccaagagacttgcctgtctgtcacatgcaagtccggcgacttcagttgcggcggacgggttaacaggtgcataccgcagttctggaggtgtgatggacaggttgattgcgacaatggctcagacgagcagggatgccctccaaagacttgttcccaggacgaattcagatgtcacgacggtaaatgtatttcacgccagtttgtatgtgactctgacagggattgcctggacgggtctgacgaggcaagttgcccagtcctcacctgtggcccagcctcgtttcagtgtaactcatcaacttgtatcccacagttgtgggcctgtgacaatgatcccgactgcgaagacggctctgacgagtggccccaacggtgccggggcttatacgtgtttcagggcgatagctctccctgctcagcctttgagtttcactgccttagcggtgaatgtatccacagttcttggcgatgtgatgggggaccagactgtaaagacaaatctgacgaggagaactgcgcggtggcaacatgtcggcccgacgagtttcagtgctccgatggaaactgcattcatgggagccggcagtgcgaccgggagtacgattgcaaagacatgagtgacgaggtggggtgcgtcaacgtgaccctgtgtgaaggaccgaataagtttaagtgtcactccggagagtgtatcacactggataaggtctgtaatatggcaagggactgtagggactggagcgacgagccaatcaaagagtgcgggacagctgcttgtctggataataatggggggtgtagccacgtgtgtaatgctttgaaaatcggagccgagtgcctgtgcccggacggcttccagctcgtagctcagcggagatgcgaggatatcgatgaatgtcaagatcccgatacatgcagtcaactgtgtgtaaatcttgaaggcggctacaaatgccaatgtgaggaagggtttcagctcgacccccacacgaaggcatgtaaggctgttggaagtattgcttatctttttttcaccaacaggcatgaggtgaggaaaatgactcttgaccgaagtgagtacacctcactcatccccaacctgcgaaacgttgttgccctggacactgaagttgcttcgaatcgaatctactggtccgacctcagccagagaatgatatgctcgactcagctggacagggcccatggagtgagtagctacgatacagtaatctccagggacattcaagcccctgacggcctcgccgtcgactggattcatagtaacatctactggactgattctgtgctcggtacagtgtctgtggccgatactaaaggggtcaaacgaaagacactcttccgcgagaacggttccaaacctagggctatagttgtagatccggtgcacggattcatgtattggaccgactgggggacacctgcgaagatcaagaagggagggctgaacggagtggacatctactccctagtcaccgagaacatacagtggcctaatggaatcacgctggatctgttgtccggccggctctactgggtggactccaagctgcactccatatcttccatcgatgtcaatggtggcaacaggaagaccatcctggaagatgagaagcgcctcgcccacccattcagcttggccgtgttcgaggacaaggtgttttggactgacattataaacgaagccatcttctctgctaaccggcttacggggagcgacgtcaatctgctcgcagagaatctgctttcccctgaggacatggtactctttcacaacttaacacaacctcgcggcgtcaactggtgcgagcgaacaactctgagcaacggaggctgccagtatctatgcctgccagccccacagataaacccgcattcccccaagtttacctgcgcttgcccagacgggatgcttctggcaagagatatgagaagttgcctgacagaagcggaggctgccgttgctacccaggagacctccaccgtgcgattgaaggtttcatccacagccgtgaggacgcagcacacaactacacgtcctgtccccgatacaagcaggctccccggcgcaacaccggggttgacaaccgtggaaatcgtgaccatgagccaccaggcactgggggatgttgcaggtagaggaaacgagaagaagccttctagcgttcgtgcgttgtcaattgtgcttccaatagtgctgttggtctttctgtgcctcggggttttcctgctctggaagaattggagattgaagaacattaactctataaatttcgataatcctgtgtatcagaaaacaacagaggacgaggtgcacatttgtcataatcaagacggttattcctatccaagtaggcagatggtaagcctggaggatgatgtggcc

SEQ ID NO: 648 - DNA, 2580 bp, Artificial Sequence
  Description of Artificial Sequence: Synthetic Transcript Sequence
atgggaccttggggctggaagctcagatggactgtggccctcctgctggctgccgcgggtaccgccgtgggtgatcgctgtgagagaaacgaattccaatgtcaggatgggaaatgtatttcgtacaagtgggtgtgtgacgggagcgcggaatgccaagacggttcagatgagtcccaagaaacttgtctgtccgtgacctgtaagtctggagatttctcctgtggtggtagggtgaaccggtgtattccgcaattctggaggtgtgatggtcaagttgattgtgacaacggatcggacgagcagggatgtccacctaaaacgtgctcccaggatgaattccgctgtcacgatggtaagtgcatttcacggcagtttgtctgtgattcggacagagactgtctggatgggtcagatgaggctagctgcccagtgctcacctgcggtcctgcatcatttcaatgtaattcctccacctgcatcccacaactgtgggcgtgtgataacgatccggactgcgaagatggcagcgatgagtggccgcagagatgtcgtggcctttacgtgtttcaaggtgattcctcgccctgttcggcattcgagtttcactgcctgagcggcgaatgtattcactcatcctggcggtgcgatggaggacctgactgcaaagacaaatcagatgaggaaaattgtgcagtagcgacctgtaggcccgatgagtttcagtgctcggacggtaactgtattcatggttccagacaatgcgatagggaatacgactgcaaagatatgtcagatgaagtgggctgtgttaacgtcactctttgtgaaggaccaaacaagttcaagtgtcattcgggtgagtgtataacccttgataaggtttgtaatatggcccgggattgtcgtgattggtcggatgagcctatcaaagaatgtggcaccgcggcatgtctggataacaacggaggctgcagccatgtgtgtaatgcacttaagattggggcagaatgtttgtgcccagatggtttccagctcgtggcacaacggagatgcgaagatatagacgaatgtcaagatccagatacttgctcgcaactttgtgtcaacctggaaggaggatacaagtgtcagtgtgaggaagggtttcagcttgacccccatactaaggcctgtaaggcagtggggtcgatagcatacctcttctttaccaacaggcacgaggtcaggaagatgacccttgatcgatccgaatacaccagcctgatccctaatctgcggaatgtggtcgcacttgacaccgaagtggcatcgaatagaatttactggtcggaccttagccaacggatgatttgttccacccaactcgaccgggcacacggggtgtcctcgtacgacactgtgatctccagagacatccaagccccagatggactcgcagtggattggattcattctaacatttactggactgattcggtgctgggaactgtgtcggtcgctgataccaagggagtgaagcggaaaactctgtttcgtgaaaacggttccaagccacgagcaattgtggtcgatcccgtgcacggtttcatgtactggaccgattggggaactccggcaaagattaagaaagggggtcttaacggtgtggacatttactctctggtgaccgagaacattcagtggcccaacggtataactctggatctcctgtccggcagactctactgggtggattcgaagctccattcgatttcatccatcgacgtgaacggagggaatagaaagactatactggaagatgaaaagagacttgcacacccatttagccttgcagtgttcgaggacaaggtgttttggactgacataatcaacgaagctatattctcggccaaccgtctgaccggaagcgatgtcaaccttctggccgaaaatcttttgagccctgaggacatggtgctgtttcataacctgacccagcctcgcggagtgaactggtgtgaacgcactactctttccaatggtggttgccagtacctttgcctgcctgctcctcagattaacccccattccccaaagttcacttgtgcatgtcctgacggaatgttgctggcccgtgatatgcgttcatgcctcactgaggcagaggccgcggtggcgactcaggaaacttcgaccgtgcggctgaaggtcagctccaccgcggtcagaactcagcatacgacgactagaccagtgcccgatacctcgcgacttccaggtgcaacccccggtctgaccactgtggaaattgtgactatgtctcatcaagctctgggggacgtggcaggtagaggcaacgaaaagaagccatcgagcgtcagagcactgtcgatagtcttgcctatagtgctccttgtgttcctgtgtcttggcgtgttcctgctgtggaagaactggaggctcaaaaacataaactccatcaattttgacaaccctgtttaccaaaagaccactgaggatgaagtgcacatttgtcacaaccaagatggttactcgtacccttcccggcagatggtgagcctggaagatgacgtggca

SEQ ID NO: 649 - DNA, 2580 bp, Artificial Sequence
  Description of Artificial Sequence: Synthetic Transcript Sequence
atgggcccttgggggtggaagctgcggtggactgtcgccctgctgctggctgctgccggcactgcggtaggcgaccgttgtgagcgtaacgaatttcagtgtcaggacggcaagtgtattagttataaatgggtctgtgatgggtccgctgaatgccaagatggatcggatgagagccaggagacatgtctgagcgtgacctgtaagtcaggggacttcagctgcggcggccgggtgaaccgttgcataccccagttctggcgctgtgatggccaggtggattgtgataatgggagcgatgaacagggatgtccaccaaaaacgtgctctcaggacgagtttaggtgtcacgacggaaaatgtatctccaggcagttcgtgtgtgattccgatcgtgactgcctggatggttctgacgaggccagctgccctgtgcttacttgtggacccgcctcttttcaatgcaacagttctacttgtattcctcagctgtgggcttgcgacaacgaccccgactgtgaggacggtagtgacgagtggccccagcgctgcaggggtctttatgtttttcagggagacagctccccttgctctgccttcgaatttcactgtctcagtggcgagtgcattcactccagttggcgctgtgacggaggcccggactgtaaagacaaaagtgatgaagagaactgcgccgtggcaacatgccgcccagatgaatttcagtgcagtgatggcaactgtatccatggctctcgccagtgcgacagagagtacgattgtaaggatatgtccgacgaggtcggttgtgtcaacgtgactctatgcgaggggcctaacaaatttaagtgccactctggtgagtgcatcactctagataaagtatgcaacatggcaagagattgccgcgactggagcgatgaacccatcaaggagtgcggcacggccgcttgtctggacaataatgggggatgctcacatgtttgtaacgctttgaagattggggcagaatgtctgtgtcccgatggctttcagctcgtggcccagaggcgctgcgaagatattgacgaatgtcaggacccagacacctgttcacaactgtgcgtcaacctagagggcggatacaaatgccagtgtgaagagggtttccagttggatccccacaccaaggcgtgtaaagcagttgggagcatcgcatacctcttcttcacaaatcggcacgaagtcagaaagatgacgctggaccggagtgaatacacctctctgattccgaaccttaggaatgtcgtggctcttgatacagaggtcgctagcaacaggatttactggtcagatctgtcccaacggatgatttgctccacgcaactcgatcgggcccatggggtgtcctcctatgacactgtgatctccagggacatccaagccccagatggcctcgcagtagactggattcactcgaacatttactggacggattctgtcctgggaaccgtgtcagtagccgatactaagggagtaaaaagaaagactttgttcagagagaacggaagcaagccgcgcgcaattgtggtggacccagtgcacggattcatgtactggactgactgggggacacccgctaagatcaaaaaggggggactcaacggggtagatatttatagccttgtgactgaaaacattcagtggcccaacggaatcacccttgatttgctttcaggcaggctgtactgggtggacagcaaactccacagcatctcctccatcgacgtgaacgggggaaatagaaaaactattttggaggacgagaaacgtctggcccatcctttttctctggccgtgtttgaggataaggtgttctggactgacataataaacgaagctatcttttccgcgaatcggctcaccggatcagatgtgaacctattggccgagaacctcctgtcccctgaggacatggtcctattccataaccttacacagcctaggggagttaactggtgtgagcggacgactctctccaatgggggttgtcagtacctgtgtctgcctgctccccagatcaatccccactctcctaagtttacctgtgcgtgtccagatggcatgctgttggcgagggacatgcggtcatgtctcacggaggctgaggctgccgtggcaactcaggaaactagcacggtccgcctaaaggtgtcctctactgcagtgagaacacaacacactactactcgccctgtgcccgacacttctagacttccaggtgctacccctggacttacaacggtggagatcgtgaccatgtcccatcaggctctaggggacgtggcaggcagggggaacgaaaaaaagcctagttctgtccgcgcattgtccatagtgctgccaattgttctcctggtgtttctgtgcctcggggttttcctcctatggaagaactggagattaaagaatattaacagtatcaactttgataatccagtgtaccagaagactacagaagatgaggttcacatctgccataaccaagacggctacagctatccctcccgccagatggtcagcctggaagacgatgttgca

SEQ ID NO: 650 - DNA, 2580 bp, Artificial Sequence
  Description of Artificial Sequence: Synthetic Transcript Sequence
atgggaccatgggggtggaagctccgctggaccgtggcgttgctccttgcagccgccgggactgctgtgggagatcggtgcgaaaggaacgagttccagtgccaggacggcaaatgcatcagttacaagtgggtctgtgatggatcggcagagtgtcaagacggaagcgatgaatcgcaagaaacctgtctgtcggtgacctgtaagtctggggatttctcgtgcgggggcagagtgaaccgctgcattccacagttttggagatgcgatggacaggtcgattgtgacaatgggtctgatgaacaaggatgtcctcctaagacgtgcagccaagatgaattccgctgccatgacggtaaatgtataagccgacaatttgtgtgtgactcggatcgggattgcctggatggaagcgacgaagcgtcatgccccgtgctcacgtgcggtccagcatcgtttcagtgcaactcgtccacctgtatcccccagttgtgggcgtgtgataatgatccagactgtgaggacggatcagatgaatggcctcagaggtgccgaggactctacgttttccaaggggattcatcgccatgttccgcatttgaattccactgtcttagcggagaatgtattcactcaagctggcgttgcgatggtggccctgattgtaaggataagagcgatgaagaaaactgtgccgtggcaacttgtagacccgatgaatttcagtgctcggatggcaactgtattcatgggtcaaggcagtgtgacagagaatacgattgtaaggacatgtccgacgaggtcggatgtgtgaatgtgaccctgtgtgagggacccaataagttcaagtgtcattccggagagtgtattactcttgataaggtttgtaatatggctagagattgtagagattggagcgacgaaccaattaaggaatgtggtactgcggcatgtctggacaacaacggcggctgctcacatgtgtgtaatgctctcaagatcggcgcagaatgtttgtgtcctgatggatttcaactcgtcgcacaacggagatgcgaggatatcgatgaatgccaagatcccgatacttgtagccaactttgtgtgaacctggaaggtggatacaagtgtcagtgtgaagagggattccaactggatcctcacaccaaagcctgcaaggcggtgggatccatcgcctacttgttctttaccaacagacacgaagtgcgaaagatgacccttgacagatcggagtacacgtcgcttatacctaatctgcgaaacgtggtggcgctggataccgaggtggcgtccaaccgaatctactggagcgatctttcgcaacgcatgatatgctcgacgcaattggaccgagcacatggtgtgtcgtcctacgacactgtgatctcgcgggatattcaagctccggatggcctggcagtggattggattcactcgaacatttactggactgactcagtgcttggcaccgtgtcagtggcagatactaaaggggtgaagagaaagactctctttcgagaaaatggcagcaagccgcgagcaattgtcgtggatccagtccacggctttatgtactggactgattggggaactccagccaagatcaagaaaggcggacttaacggcgtggatatctactcccttgtcacggagaacattcagtggcctaatggaattaccctggatctcctgtccggtagactgtactgggtcgactcaaagctccattcaatatccagcattgatgtcaacggaggaaaccgtaagactatacttgaggacgaaaaaaggcttgctcaccctttttcccttgcggtgtttgaagataaggtgttttggaccgacattatcaacgaggcaattttctctgcaaataggttgaccggctcagacgtcaaccttctcgccgaaaatcttctttctcctgaagatatggtcctgttccacaaccttactcagcccagaggcgtgaactggtgcgagcggactactctgagtaatggaggttgtcagtacctgtgccttcctgcaccacaaatcaatccacattctcccaaattcacgtgtgcctgccccgatggtatgcttctcgcacgagacatgcggagctgcctcactgaagccgaggctgcagtggccacccaggaaacctcgaccgtccgtctgaaagtcagctcgaccgccgtccgcacccaacataccaccacgcgacctgtgcccgatacctccagactgccgggagcaactcctgggcttaccaccgtcgaaatagttaccatgtcacaccaggcgcttggagacgtcgccggcagagggaatgagaagaagccatcctcagtgcgagcgctcagcatcgtgttgccaatcgtgcttctcgttttcctctgccttggcgtgtttctgctgtggaaaaactggcgtctcaagaacatcaactccatcaacttcgataaccctgtgtaccaaaaaaccactgaggacgaagtccatatttgccacaatcaggatgggtactcctacccatcgcgccaaatggttagcttggaggacgatgtggca

SEQ ID NO: 651 - DNA, 2580 bp, Artificial Sequence
  Description of Artificial Sequence: Synthetic Transcript Sequence
atgggaccatggggatggaagttgaggtggaccgtggcactcttgcttgcggctgccggcactgccgtcggcgataggtgtgaaaggaacgaattccagtgccaagacggaaagtgcatctcctacaagtgggtttgtgatgggtcagcggagtgtcaggatggcagtgacgagtcacaggaaacctgtctgtctgtgacctgtaagagtggggactttagctgtggcggcagagtaaacaggtgtatcccccagttttggcgctgcgacggacaggtggactgtgacaacggctcagacgagcaggggtgcccgcctaagacatgttcacaagatgaattcagatgtcatgacggaaagtgcattagtagacaattcgtgtgtgatagtgatcgcgattgccttgatggcagcgatgaagctagctgtccagtgctaacctgcggtcctgctagttttcagtgcaactcctccacatgcatacctcagctttgggcgtgtgataacgaccctgactgtgaagatggatctgatgagtggcctcagagatgcagggggctgtatgtgttccaaggagacagttctccctgctctgcatttgagttccattgtctatctggggaatgcatccactcgtcttggcgctgtgatggaggtccagattgtaaggacaagtccgacgaggagaattgcgcggtggcgacttgcaggccggacgagtttcaatgttccgacggaaactgtattcatggctcacgacagtgcgatagagaatatgattgcaaagacatgagtgacgaagtgggctgcgtgaatgtgaccttgtgtgagggtcccaataagttcaagtgccactcaggagagtgcatcaccttagataaggtctgtaacatggcccgagactgtcgagactggtctgatgaacccatcaaagagtgcggcaccgctgcctgcctagacaacaatggcggctgcagccatgtctgcaatgctttgaaaatcggggccgaatgcttatgtcctgatgggtttcagctggtcgcccagagaaggtgtgaagacatcgatgagtgccaggatcctgatacctgttcccagctgtgtgtcaacctggagggaggatataaatgccagtgcgaggagggattccagctcgaccctcataccaaagcctgcaaggcagtgggctctatcgcctacttgtttttcaccaatagacacgaagtgcgcaagatgacgctggacagatcggagtatacatcccttatccccaatttaagaaatgtggtggccctcgacactgaagtggcaagtaaccgaatttactggtcagatctgagtcagaggatgatctgtagtacccaattggatagggcacatggcgtgagctcttatgatacagttatcagcagagatatccaggcaccagacggattggccgtagactggattcactccaatatctattggacagacagtgtactcgggacagtgtctgtagcagacaccaagggtgttaagaggaagacgctcttcagagaaaacggatctaagcctagggcaatagtagttgaccctgtgcacggcttcatgtattggacggactggggaaccccggccaagatcaagaagggcggattaaatggagtggatatctactccttagtgactgaaaatatccaatggccgaatgggataacgctggatctcctgtctggaagactgtattgggtggatagcaagttgcactctattagcagcattgatgttaacggcggaaatcgaaagactattttagaggatgaaaagagactggctcaccctttttccctcgctgtgtttgaggataaggtgttttggaccgacattataaacgaggcaatcttttccgctaatagactgacgggcagtgacgtcaacctgcttgccgagaacctcctgtcgccggaggacatggttctcttccacaacctgacccaaccaagaggagtaaattggtgtgagaggactacactcagcaatggggggtgtcagtacctctgcctgccagcacctcagataaatcctcattccccaaaatttacatgtgcatgtccagatgggatgcttctggcaagagatatgaggagctgtctgaccgaggctgaggctgccgtggctacccaagagacaagcactgtgcgactcaaggttagcagtaccgcagtgcgaacccagcatactacaactcggcccgtgcctgacaccagtagattgccgggggcgactccaggcctgaccaccgtggaaattgtgacaatgtctcaccaggccttgggtgacgttgcggggcggggtaatgagaagaaaccttccagcgtgagagccttgagcatcgttttaccaatcgtgctgctggtctttctctgtctgggcgtattccttctgtggaaaaattggaggttgaagaatatcaactcaataaattttgataaccctgtgtatcaaaagaccaccgaggacgaggtccacatatgtcacaaccaggacggttactcgtatccaagcagacagatggtgtccctcgaggacgacgtcgcc

SEQ ID NO: 652 - DNA, 2580 bp, Artificial Sequence
  Description of Artificial Sequence: Synthetic Transcript Sequence
atgggtccgtggggttggaaacttcgctggactgtggcgcttttattagctgcggccggcaccgcggtcggggacagatgcgaaaggaatgaatttcagtgtcaagatggcaagtgtatttcatacaaatgggtgtgtgatggctcagcagagtgtcaagacggctcggatgaatctcaagagacttgcctgtcagttacctgcaaaagcggtgacttttcttgcggcggcagagtcaaccggtgtatcccgcaattttggcgttgcgatgggcaagtcgattgcgacaatggaagtgatgaacaggggtgtccgcctaaaacttgttcacaagatgagttcagatgtcatgatggaaaatgcatttctaggcaatttgtgtgcgactcagatagagattgcctagacggatctgatgaggcgtcctgtccggtgttgacatgcggtccggccagctttcaatgcaactcaagcacgtgtataccgcagctttgggcctgcgataatgaccctgattgtgaagacgggtcagatgagtggccgcagagatgtcggggcctttatgtgtttcaaggcgactcatccccttgttcagcttttgaattccactgtctcagcggggaatgtatacattctagctggagatgcgacggcgggccggattgcaaagataaatccgacgaagaaaattgtgcagtagcgacatgtcgtccggacgaatttcagtgctccgacggaaactgcattcatggatcacgtcaatgtgatagagaatacgattgcaaagatatgagtgatgaagtcggctgtgttaatgtgacgttgtgcgaaggacctaataaatttaaatgccatagcggagagtgcatcacattggataaggtatgcaacatggcgagagattgccgcgactggtcagatgaaccaatcaaggaatgcggcactgcggcgtgcttagataataacggggggtgttctcacgtgtgtaacgctttaaaaatcggggctgaatgtttatgccccgatggctttcaactggttgctcaaagaagatgtgaagacattgatgaatgtcaggacccggatacctgttcgcaactttgtgtgaatcttgagggaggatataagtgccaatgtgaagaagggtttcagctggatccgcatacaaaagcgtgtaaagcagtgggcagcattgcttatttattcttcacaaacagacatgaggtcagaaaaatgacactggaccgttctgaatacacaagccttatcccgaatcttcgcaatgtggtggcgcttgacactgaggttgcatcaaaccgcatttattggtcagatttatctcagcgtatgatttgttccacacagcttgatcgagcacatggagtgtccagctatgatactgttatcagtcgagatattcaggcgccggacggtttagccgttgattggatccatagcaacatctattggacagattcagtattgggcacggtgtcagttgctgatacaaagggggtgaagcgtaagacattattccgggaaaacggctcaaagccaagggctatcgttgttgatccggttcatgggtttatgtactggacggattgggggacgcccgcaaaaataaaaaagggagggttaaacggtgtcgatatttattcattagtgacagagaacattcaatggcctaacggaatcacgctcgatttacttagtggcagattgtactgggttgatagcaaacttcactcaattagcagtattgacgtcaacgggggtaacaggaaaacaatactggaagacgagaagcgcttagcccatccattcagtttagctgtctttgaagacaaagtgttctggactgatattattaacgaagccattttctcagcgaatcgccttacgggatcagatgttaatctgctggcagaaaatcttctcagtccggaagatatggttctgtttcataacctgacacaacctcgcggcgtcaattggtgcgaacgaactacactgtcaaacggaggatgtcagtatctttgtcttcctgcgccgcaaatcaaccctcattctcctaaatttacatgtgcgtgcccagatggaatgcttcttgcgcgtgatatgagaagctgtttaactgaggcggaagcggctgtcgctacgcaggaaacaagtacggtaaggttgaaggtttcatccactgctgttagaacgcagcatactaccacaagacctgtaccggatacctcccgcctgcccggagctacgccaggtttaactactgtggaaattgtcaccatgtcccatcaggctttaggagacgtcgccggacgcggcaatgaaaaaaaaccgtcttctgtcagggccttgtcaattgttctgcctatcgtgttgttagtttttctttgtctcggagtctttctgctgtggaaaaattggcgccttaaaaacattaattctataaattttgataatccggtgtatcaaaaaacgacggaagatgaagtccatatttgccacaatcaggacggatactcttatccgtctagacaaatggtgtccctggaagacgatgtagct

SEQ ID NO: 653 - DNA, 2580 bp, Artificial Sequence
  Description of Artificial Sequence: Synthetic Transcript Sequence
atgggaccatggggttggaagctgcggtggactgtcgcccttctcttggcagctgctggtactgcagtgggggatagatgtgagagaaacgaatttcagtgccaagacggcaaatgtatatcctacaaatgggtgtgcgacggctctgcggaatgccaggatggttcggatgaatcgcaagaaacttgtctctcggtgacgtgtaaaagcggggacttttcctgtggcggacgggtgaatagatgcataccccaattctggcgctgcgatggtcaggtcgactgcgataacggatcagacgaacaggggtgtcctcctaagacttgctcccaagacgaattccgctgtcacgatggaaaatgcatttcgaggcagtttgtgtgcgactccgaccgggactgcctcgacggctccgatgaggcatcctgtcctgtccttacctgcggacctgcatcgtttcaatgcaactcgtccacctgtatcccgcaactgtgggcatgtgacaacgatcccgattgtgaagatggatccgatgaatggcctcagagatgtcggggtctttacgtgtttcagggagacagttcgccatgctccgcattcgaatttcactgtctctccggagaatgtatacactcttcctggcgatgcgatggtggtccagattgcaaggacaagtcagatgaagagaactgtgcagtggccacttgtcgacctgacgagtttcagtgttcggatggtaactgcattcacggcagccgacaatgcgatcgtgaatacgactgtaaagacatgtctgacgaagtgggttgtgtgaatgttacgctgtgtgaaggcccgaataagtttaagtgtcattcaggagaatgtatcacgcttgataaggtgtgtaatatggctcgggactgccgagattggtcggatgaacccattaaggagtgtggtactgcggcatgtctcgacaataacggaggatgttcacatgtctgtaacgcgctcaaaattggagcagaatgtttgtgtcccgatggatttcagctggtggcccaacgccggtgcgaagatatcgacgagtgtcaggatccggacacctgttcacaactgtgtgtcaaccttgaaggaggctacaagtgccaatgtgaggaaggattccaacttgacccgcacacgaaggcatgtaaggcagtgggctcgatagcatacctgttctttactaatagacacgaagtgagaaagatgactctggatcgttcagaatacacctcgcttattcccaatctgaggaacgtcgtggctttggataccgaagtggccagcaatcgaatttactggagcgatctttcgcaaaggatgatttgttccacgcagcttgacagggcacatggtgtgtcatcgtacgataccgtaatctcccgcgatattcaagcacctgatggactcgccgtcgattggatccatagtaacatttactggacggacagcgtgcttggtacggtgtcagtggccgataccaaaggggtgaagagaaagaccctttttagagagaacggatccaagccccgggccatagtcgtggatcccgtgcatggttttatgtactggaccgattggggtactcccgccaagattaagaaggggggcctgaacggtgtggacatttactcccttgtcaccgagaacattcaatggccaaacggcatcactctcgacttgctgtcaggaaggctttactgggttgactcgaaacttcattccattagctcaatcgatgtgaacgggggaaataggaaaaccatcttggaagatgaaaagcgtctggcgcatcctttttcgcttgcagtgtttgaggataaggtgttttggacggatatcattaatgaagccatcttttcagcaaacagactcactggttccgatgtcaatcttctggcagaaaacttgctttcgcctgaagatatggtgctcttccacaacctgactcaaccacggggcgtgaactggtgtgaaagaactactctcagcaacggaggttgtcagtatctgtgtctgccagcaccccaaatcaacccccactcgcctaaattcacttgtgcctgtccggatgggatgctgctggcccgagatatgagatcatgcctgactgaggcagaagccgcggtggcgactcaagagacttccactgtcagacttaaggtcagctccactgctgtcagaacccagcataccactactagaccggtcccggacacctccagacttcccggagcaacccctggtcttactactgtcgagatcgtcactatgtcccatcaggcacttggcgacgtggcaggtcgagggaacgaaaagaagccgtccagcgtgcgagcactctctattgtgctgcctattgtgcttctcgtgtttctgtgtctgggagtgtttcttctttggaagaactggagattgaagaacatcaattcgatcaattttgacaaccctgtgtaccagaaaaccaccgaggatgaagtacatatctgccataaccaagacggctactcgtatccttcgcgacaaatggtgtcgctggaagatgatgtggct

SEQ ID NO: 654 - DNA, 2580 bp, Artificial Sequence
  Description of Artificial Sequence: Synthetic Transcript Sequence
atgggaccttggggttggaagttacgctggactgtggccctgttactggcagcagcgggaactgctgtcggcgacagatgcgagcggaatgaatttcagtgccaagatggcaagtgtatttcgtacaaatgggtctgtgacggttctgctgagtgtcaagacgggtctgacgaatctcaggaaacatgcctctctgtcacgtgtaagtccggagatttcagctgcggcgggagggtgaacaggtgcatcccacaattttggaggtgtgacgggcaagttgattgtgacaacggctctgacgaacagggttgcccgccgaaaacctgttcacaggacgaattccgatgtcatgacgggaaatgcatctctcgacaattcgtttgcgacagtgaccgggattgcttggatggctcagacgaggcctcctgtcccgtactaacctgtggacctgcttcttttcagtgtaactcatcaacctgcataccacagttgtgggcctgtgataacgatccggactgtgaggatggctctgatgagtggcctcaaagatgtagagggctgtatgtcttccagggggactcctctccctgttcagcattcgagtttcactgtctgagcggggagtgtattcatagtagctggcggtgtgatggtggacccgattgcaaagataagtctgacgaagaaaattgtgccgtagccacttgtagaccggacgaattccagtgttcggacggaaactgcattcacggcagtaggcagtgcgacagagagtatgactgtaaggatatgtctgacgaggtgggatgcgtgaacgttactctgtgcgaaggcccaaacaaatttaagtgtcattcaggagagtgcattactctggacaaagtgtgcaacatggctcgagactgccgggattggagcgatgagccaatcaaagaatgcggaacagccgcttgcctcgacaacaatggcggatgttcgcacgtgtgcaacgcgcttaagatcggggccgagtgcttgtgccctgatgggtttcagctcgtggctcaaagacgatgtgaggatattgatgaatgccaggatccagacacctgcagccagctgtgcgtcaacctggaagggggctataagtgccagtgtgaggaagggttccagctcgacccgcacactaaagcttgcaaggcagtcggcagcatcgcatacctgttttttacaaatcggcacgaagtgagaaaaatgacgctcgacagatctgaatatactagtcttatcccaaatctcagaaacgtggttgccctggacacagaggtcgcttctaaccgaatctactggagcgacctgtcccagcgtatgatttgttcgacccagctcgacagagctcacggagtgagttcatatgataccgtgataagcagggatatccaggcccctgacggactggctgtggattggatccactccaacatatattggactgatagtgtgctgggaacagtctcagtcgccgataccaagggcgtgaagcgtaagacgctcttcagagagaatggttcaaagcccagagcgatcgtggtagatcccgttcatggtttcatgtattggacagattggggtacccccgcaaaaattaaaaagggggggctgaatggcgtcgacatctattccttggttactgagaatatccagtggccaaatggtattacgttggatctgctgtcaggtcgcctctattgggttgacagtaaactacattctatcagcagcattgacgtcaacgggggcaaccgaaaaacgattctcgaggatgagaaacggctggctcatcctttttccttggccgtgttcgaggacaaggtcttttggaccgacatcatcaacgaagccattttctcggccaataggttgacgggctctgatgtgaaccttctggccgagaatttgctctctcccgaagacatggtgttgttccacaatcttacccagcctcgcggagttaattggtgcgagaggactaccctgtcaaatggtggatgtcagtacctctgcctccctgcaccccagatcaacccccactcgcctaagtttacttgtgcctgccccgacggaatgctcctggcacgggatatgcgaagttgcttaaccgaggcggaagccgccgtggctacacaagagacatccacagtgagactaaaggtgtccagcaccgccgtaaggacccagcatacgacaactcgccccgtgcctgataccagccggctgcccggcgccacacccggcttgacgaccgtggagatcgtcaccatgagccaccaggcactgggcgatgtggcaggcagagggaatgaaaaaaagccttccagcgtgcgggccctgagtatcgtgctgcctattgtcctactggttttcctgtgtttgggagtcttcctcttgtggaaaaactggaggctgaagaacattaattccattaactttgacaatccagtgtatcagaaaaccacagaagacgaagtgcatatttgtcacaatcaggacggttactcttacccctcccgccagatggtgtctttggaagacgatgtggct

SEQ ID NO: 655 - DNA, 2580 bp, Artificial Sequence
  Description of Artificial Sequence: Synthetic Transcript Sequence
atgggtccttggggatggaagctgagatggacagttgcactgcttctggctgcagccggtacagctgttggcgataggtgtgaacgtaacgaattccagtgccaagatggtaagtgtatatcttataaatgggtgtgtgacggaagcgctgagtgccaggatggttccgatgaatcacaagaaacatgtctgtctgttacatgcaagagtggcgacttttcctgtggtggcagagtcaacaggtgcataccccagttctggaggtgcgatggccaggtggattgcgacaacggtagcgacgaacagggttgccctcctaagacatgctctcaggatgagttcaggtgtcatgatggtaagtgcatcagtaggcagttcgtgtgcgacagcgaccgcgactgcttggacggatctgatgaagcttcctgcccagtcctgacatgtggacctgcatcttttcaatgcaactctagtacttgtattcctcagttgtgggcttgtgacaacgaccctgattgcgaggacggatcagacgagtggcctcagagatgcaggggcctctatgtttttcagggagattcttctccctgttccgcctttgagtttcattgtctttctggagagtgtattcatagcagctggagatgtgacggcggtccagactgcaaggacaagtccgacgaagagaactgtgcagttgccacttgccgtcccgacgaattccagtgctccgacggcaactgtatccatggttccaggcaatgcgacagggagtacgactgtaaggatatgtccgacgaggtaggctgtgttaacgtgactctttgtgagggaccaaacaaattcaagtgccacagcggtgagtgtattacactcgacaaggtctgcaacatggcccgtgactgtagggattggagcgacgagcctattaaggagtgtggaaccgcagcttgtctggataacaatggaggttgctctcacgtgtgtaacgccttgaagatcggtgccgagtgcctgtgccccgatggtttccagttggttgctcaaaggagatgcgaggacatcgacgagtgtcaggacccagacacctgctcacaactgtgtgtcaaccttgaaggcggctacaaatgccaatgtgaggagggttttcaactggaccctcacactaaggcttgcaaggccgtcggatccatagcctacctgttttttacaaaccgtcatgaggttaggaagatgactttggatcgctccgaatatacttccctgattcctaatttgcgcaatgtagttgctttggatacagaagtggcttctaaccgtatttattggagcgatctctctcaaaggatgatttgttcaacccagctcgacagggcccacggtgtctctagctacgacaccgtaatatccagggacatccaagccccagacggactcgccgttgactggatccactcaaatatctattggactgactcagtacttggaaccgtctccgtcgctgacacaaagggtgtaaagaggaagactcttttcagggagaatggtagcaaaccaagagcaattgttgttgatccagttcatggtttcatgtactggacagactggggaacccccgctaagattaagaagggtggactgaacggcgtggatatctattcactggtgaccgaaaacatccaatggcccaatggaataaccctcgatctcttgtctggaagactgtattgggtggattctaaactccacagtatttcaagcattgacgtaaatggaggaaataggaagaccattctggaggacgagaagaggttggctcatccattctcactcgccgtctttgaagacaaggtgttctggaccgacatcatcaatgaggccatcttctcagcaaacagactgactggatctgatgtcaacctgttggcagaaaatttgctttctcccgaggatatggtcctgtttcacaatcttactcagccacgtggagtgaactggtgcgaacgtacaactctgagtaatggaggatgccagtacctgtgtctgcctgccccacagattaacccccattcccctaagtttacctgcgcttgtcctgatggtatgctgctggctcgcgatatgcgttcctgcctgaccgaggccgaggccgctgtggcaactcaggaaacctctacagtcagattgaaagtcagttcaaccgccgtaagaacccagcatactactacacgccccgtgcccgacacatctcgcctgcccggtgctacaccaggactcacaactgttgaaatcgtaacaatgagtcaccaagcccttggtgatgttgcaggcagaggcaatgagaagaagccatcctctgtcagagcattgtctattgtcttgccaattgtgctcctggtgtttctttgcctgggagtgtttctcctctggaagaactggagactgaagaacattaactctatcaacttcgacaaccctgtttaccagaaaacaaccgaggacgaagtccacatatgtcacaaccaggatggctatagctacccttcccgccagatggtctctctcgaagacgatgtagcc

SEQ ID NO: 656 - DNA, 2580 bp, Artificial Sequence; identical to SEQ ID NO: 636
  Description of Artificial Sequence: Synthetic Transcript Sequence

SEQ ID NO: 657 - DNA, 2580 bp, Artificial Sequence
  Description of Artificial Sequence: Synthetic Transcript Sequence
atgggaccttggggatggaaacttcgctggactgtcgccctgctgctggcagctgccggcaccgccgtcggagatcgctgcgagcggaacgagttccaatgccaggatgggaaatgcatcagctacaagtgggtgtgcgacggatcggcagagtgccaggacggttctgacgaaagccaagaaacctgtctgtcggtgacctgcaaatcgggggacttttcctgcggcggacgcgtgaatcggtgtattccacagttttggcgctgcgatggacaggttgattgcgataacggttcagacgaacagggatgccctcccaagacttgcagccaggacgaattcagatgccacgacggaaaatgcatctcacgccagttcgtgtgtgactccgaccgggactgcttggacggatcagacgaagcctcatgtccggtgctgacttgcggaccggccagctttcagtgtaatagctcaacctgtatcccacagctctgggcctgcgacaacgacccggactgcgaggacggatcggacgagtggccgcagcgctgcagaggactctacgtgttccaaggagattcctccccctgctccgcgtttgaattccattgtctctcgggtgaatgtatccacagtagctggaggtgcgacggaggtccagactgcaaggacaaatcagatgaggagaactgcgcagtggcgacctgtcggccagacgaattccagtgtagtgacggcaactgcatccatggctcgcgtcaatgcgacagagaatacgactgcaaggatatgtcggatgaggtcggatgcgtgaatgtcaccttgtgcgaaggccctaacaaattcaagtgccattcaggcgagtgcatcactctggacaaggtctgtaacatggcacgggactgccgggactggtcagatgaaccaatcaaggaatgcggaactgccgcttgtctggataacaatggtggttgttcccacgtgtgtaacgccttgaaaataggtgcggagtgcctgtgcccggacggtttccaattggtggcccaacgccggtgcgaagatatcgacgagtgtcaggatccggatacctgctcgcagttgtgcgtgaatctggaaggcgggtacaagtgccaatgcgaagaaggattccagctggacccgcacaccaaagcctgcaaagccgtggggtccatcgcctacctgttcttcaccaatcggcacgaggtgcgcaaaatgactttggacaggtcggaatacacttcattgatccccaatctccggaatgtggtggcacttgacactgaagtcgctagcaatcggatttactggtcagacctgtcgcagcggatgatctgctcgactcagcttgaccgcgcacatggggttagctcctacgacaccgtgatcagccgggatattcaggcccccgacggtctggccgtggactggatccactctaacatctactggacggacagcgtgctcggtactgtgagcgtcgctgacaccaagggagtgaagcgcaagaccctgtttcgcgaaaacggatccaagccgcgggcaatcgtggtggaccctgtgcacggattcatgtactggaccgattggggaaccccagccaagatcaaaaagggcggcctgaacggcgtggacatatactccctggtgaccgagaacatccaatggcccaacggaatcactttggacctgctcagcggacgcctctactgggtcgactcaaaactccactcgatttcatccattgatgttaatggtggaaacaggaaaactatcctcgaagatgagaagcggctggcccacccgttctcgctcgctgtgttcgaggacaaggtattttggaccgacatcattaacgaagcgattttctccgccaaccggctgaccggaagcgatgtgaaccttctggcggaaaacctgctcagcccggaagatatggtgctcttccataacttgactcagccgaggggggtgaactggtgtgaaagaaccactttgtccaacggaggctgccagtatctgtgcctgccggccccccagatcaacccgcactccccgaagttcacgtgcgcctgccctgatggcatgctcctcgcccgcgacatgcgctcgtgtcttactgaggccgaagccgccgtggcgacccaggagactagcactgtgaggctgaaagtgtccagcactgcggtccggactcaacataccaccacccgccctgtccccgataccagccgcctgcccggagccacgcccggactgaccactgttgagatcgtcactatgtcgcaccaggctctcggagacgtggcgggacgcggcaacgaaaagaagcctagctccgtgcgcgctctgagcattgtgctgccaattgtgctgctggttttcctgtgccttggagtctttctgctctggaagaattggcggctgaagaacatcaattcgatcaatttcgacaaccccgtgtaccagaaaaccacggaagatgaggtccatatctgtcataatcaggacggctactcctacccgtcccggcagatggtcagcctggaagatgatgtcgcc

SEQ ID NO: 658 - DNA, 2580 bp, Artificial Sequence
  Description of Artificial Sequence: Synthetic Transcript Sequence
atgggtccttggggttggaagctccggtggactgtggcactgctgctcgccgccgcgggcactgccgtgggtgacaggtgtgaacgcaacgagttccaatgtcaggatggtaaatgcatttcctacaagtgggtctgcgatgggagcgctgagtgtcaagacggatccgacgagtctcaagagacttgtctttctgtgacttgtaagtccggtgatttttcgtgtggcggccgtgtgaatcgctgtatccctcaattctggcgatgtgacggacaggtcgactgtgataatggatcggatgaacaaggatgcccccctaagacctgttcgcaggacgagtttcgatgccatgatggtaagtgcatctcccgccagtttgtgtgtgacagcgaccgggattgtcttgacggttccgatgaggcatcctgcccagtgctcacctgcggccctgcctcgtttcagtgtaactcaagcacctgtatcccacagctctgggcatgcgataacgaccccgattgtgaggacggaagcgatgagtggccgcagaggtgtagaggtctttacgtgttccaaggagattccagcccgtgttcggcatttgaattccactgtctctcgggggaatgtattcattcgtcctggaggtgcgatggcggtcctgattgcaaagataagtcagatgaagagaactgcgcagtggcaacttgtcggccagatgaattccaatgttccgatggaaattgtatccatggctcccggcagtgtgaccgtgaatacgattgtaaggatatgtccgacgaagttggatgcgtcaacgtgactctttgtgaaggtccgaacaagtttaagtgtcatagcggggagtgcattaccctcgataaggtctgtaatatggcacgcgattgtagagattggtcggatgaacctattaaggagtgcggaaccgctgcttgcctcgataacaatggtggttgtagccatgtctgcaacgcccttaagatcggagccgaatgcctgtgcccagacggattccagctggtggcccagcggcgctgcgaagatatcgatgaatgtcaagatccagatacttgttcgcagctgtgtgtcaaccttgagggagggtacaagtgtcagtgtgaggaaggctttcaactggatccgcacaccaaagcctgcaaagccgtgggctcaatagcatacctgtttttcactaaccgccacgaggtgcggaaaatgaccctggatcggagcgagtacacttcgctgatccctaacctgcggaatgtcgtcgcccttgatactgaggtcgcaagcaacaggatttactggtctgatctctctcagcgtatgatatgttccactcaactcgatcgagcacatggagtgtcctcctacgatactgtcataagccgcgatatccaagcacccgatgggctggcagtagactggatccattcgaacatatactggaccgacagcgtgcttgggaccgtctcagttgccgatactaagggcgtcaagcggaaaactctttttagagaaaatggctcaaagccacgcgcaatcgtggtggatcctgtgcatgggttcatgtactggacggactggggcactccagctaagattaagaaaggcgggctcaacggagttgacatctatagccttgtcactgaaaacattcagtggccaaacgggattacgctcgacctgctcagcggtcggctgtactgggtggatagcaaactccactcgatttcctcgattgatgtgaacggtggcaaccgcaagacgattctggaggacgaaaagcggctggcccaccctttttccctcgcagtgtttgaggacaaggtgttctggaccgatatcataaacgaagcgatattctcggcgaacagattgactggctccgacgtgaatctcttggccgagaatctcctttcaccagaggacatggtgctgtttcataaccttacccaaccaaggggagtgaattggtgtgaacgaactactctttccaacggtggttgccagtatttgtgccttccagcccctcagataaatcctcattcgccaaagtttacttgcgcatgccctgacggaatgctgctggcaagagatatgcggagctgtcttaccgaagccgaagctgcagtggcaacccaagaaacctcaaccgtgcgcctgaaagtctcaagcaccgcggtcaggacgcaacataccaccactcgacctgtcccagataccagcagactgccgggcgcaactcctggcctcaccaccgtcgagattgttaccatgtctcatcaagccctcggcgatgtcgcaggtcggggcaacgagaagaaaccatcctcggtccgcgccctttccattgtcctgcccatcgtgctgctggtgtttttgtgtttgggtgtgtttctgctttggaagaattggcgtctgaagaacattaactcgatcaattttgataaccccgtgtaccaaaagaccacggaagatgaagttcacatctgccataaccaagacggttactcgtacccgagccgtcaaatggtcagcttggaagatgatgtggca

SEQ ID NO: 659 - DNA, 2580 bp, Artificial Sequence
  Description of Artificial Sequence: Synthetic Transcript Sequence
atgggcccgtggggttggaagctacggtggaccgtagcgctgctcctggcagcggctggaacagctgtgggggatagatgcgagcgaaatgaatttcagtgtcaagacgggaagtgcattagctacaagtgggtgtgcgacggctcagcggagtgccaggacgggtcggatgaaagtcaggagacatgcctatccgttacatgtaaaagcggtgatttctcatgcggcgggcgcgtgaatagatgtatccctcagttttggcgctgtgacggccaggttgactgtgacaatggatccgacgagcaggggtgtcccccaaaaacgtgcagtcaggatgaatttcggtgccatgacggcaaatgcattagtcgccagtttgtttgtgactcagatagagactgtcttgacggctcagacgaggcatcttgccctgtactgacttgtggcccagcgagtttccagtgtaattcctcaacttgtatcccgcagctgtgggcctgtgataatgatccagactgcgaggacggatccgatgagtggccacagagatgtcgtgggctgtacgtttttcaaggagacagttcaccttgcagcgcctttgagttccactgcctgtcaggcgaatgcattcactcctcctggagatgcgacgggggtccggactgcaaagataagagcgacgaggaaaattgcgctgtggccacttgccggcccgacgagtttcagtgctcagatggaaattgcatccacgggtcccgccagtgtgatagagaatatgattgcaaggacatgtccgacgaggtaggatgtgttaacgttaccctgtgcgaaggcccaaacaaatttaagtgccacagtggggagtgtattactctggacaaagtgtgcaatatggcgcgggactgccgagattggtccgatgagccaattaaggagtgtggaaccgcggcttgcctggataataatgggggatgctcccatgtctgtaatgctctgaaaatcggagctgaatgcttgtgcccagacggctttcagcttgtggcccagcggaggtgtgaggatatcgatgaatgtcaggaccctgatacctgttctcaactctgcgttaacttagaagggggctataagtgccagtgtgaagagggcttccagttagatccacacactaaagcctgcaaggccgtgggctccatcgcttatttgttcttcacaaacagacacgaagtgcgcaaaatgacattagatcggtctgaatacacttctctgattcccaatctgagaaatgtcgtggctctcgatacagaggtggcctctaatcggatatactggagcgatcttagccagagaatgatatgttccacacagctcgatagagcccacggcgtgagcagctatgatactgtaatctctcgcgatatccaagctcccgacggacttgctgttgactggatccactctaatatatactggactgatagcgtcctgggaaccgtaagcgtggccgatactaagggcgtcaagcgtaagacactctttcgcgaaaatggctctaaaccacgggcaatcgtggtagatcctgtacacggcttcatgtactggactgactgggggaccccagcaaagatcaagaagggggggctgaacggtgtagacatctatagtcttgtgacagaaaatattcagtggccgaacggcatcacattggacttgctgtctggtcgcctgtattgggtggatagcaagctgcactctatctcctcgattgacgtcaacggaggtaatcgcaagacgatcctggaggatgaaaagaggttagcgcatcccttctccctggcagtcttcgaagacaaggtcttttggacagacatcatcaacgaagcgattttctctgctaacagacttaccggctcagacgtgaacctgctggccgagaacctgctgtcacccgaggatatggtgctatttcacaatctgacgcagccaagaggcgttaactggtgcgaacgaaccacgttgtctaatggcggctgccagtacttatgcctccctgccccacagattaatcctcatagcccaaaatttacatgcgcctgccccgatggcatgctgctcgctcgggacatgaggtcatgcctaacagaagccgaagctgcggtcgccactcaagagacttctaccgttaggcttaaggtctcctcaacggcagtacgaacacagcacactactactcgccctgtccctgacaccagtaggttgcccggcgccacgccgggactgactacggtggaaatcgttaccatgtcacaccaggccctgggcgacgtggccgggaggggaaatgagaaaaagccatcctccgtgcgtgcactgtcaatagtgttgccaattgtgctcctggtgtttctttgcctgggcgtatttctgctctggaaaaattggagactcaagaacatcaactcaattaactttgacaacccggtctaccagaagaccaccgaagatgaggtccatatctgtcacaatcaggacgggtactcctatccttcaagacagatggtgtcactcgaggacgatgtagcc

SEQ ID NO: 660 - DNA, 2580 bp, Artificial Sequence
  Description of Artificial Sequence: Synthetic Transcript Sequence
atgggaccttggggatggaaacttagatggacagtcgcactacttttggctgcagctggaacagcagttggagacaggtgcgagagaaacgagttccagtgtcaggacggaaaatgtatcagctacaaatgggtatgcgacggatccgctgaatgccaagacggatccgacgaatcccaagagacatgtctaagtgtaacatgcaaatccggagatttttcatgtggaggacgtgtaaatagatgtatccctcaattctggagatgtgatgggcaagtggattgtgataatggctccgatgaacagggttgtccacccaaaacctgttctcaagatgaattcaggtgtcacgacggcaagtgtatttcaaggcagttcgtttgcgactcagatagggattgcttggatggctctgatgaggcttcttgtcctgttttgacttgcggtcctgcctcatttcaatgtaactcttcgacctgcatcccacagctttgggcgtgcgacaacgacccagattgcgaggacggctctgatgaatggcctcaaagatgcaggggcttgtacgtttttcaaggggatagttctccttgcagcgctttcgagtttcattgccttagtggggaatgcatacattcctcctggagatgcgatggagggccggactgtaaagacaagtcagatgaagaaaactgcgccgttgccacttgccgacctgatgagttccagtgttcggacggaaactgcattcatggttcacgccagtgcgatagagagtacgattgcaaggatatgtccgacgaggtgggatgcgtcaacgttaccttgtgtgaggggccaaataaattcaagtgtcactctggcgagtgtataaccctcgataaggtgtgcaatatggcgcgtgattgtagggattggtcggatgaacccatcaaggaatgtggaacagctgcatgtcttgacaacaacggagggtgctcccatgtgtgtaacgcactaaagattggagcagaatgcttgtgccctgatggtttccaattggtggcacagagacgatgcgaagacatcgatgaatgtcaggatcctgacacatgctcccaactctgcgtgaatttggaaggaggttacaagtgtcaatgcgaagaaggtttccaactagatcctcatactaaggcatgtaaggctgtaggctcgatcgcatatttgtttttcactaacaggcatgaagtgcggaaaatgacattggataggtctgagtataccagtctgattcctaacttaagaaatgttgttgctcttgacacggaggttgctagtaatagaatttattggtcagatctttcacaaaggatgatatgttctacacaattggatagagcacatggtgtctcctcctatgacactgtgattagtagggacatccaagcgccagatggattagctgttgactggatccattccaatatatattggacagacagcgtattgggtacagtttcggttgcagacaccaagggtgtcaaacgtaaaactctcttcagagagaatggctccaaaccaagagcgatcgtggtagatcctgtccatgggtttatgtattggacggattggggaacacctgcgaaaattaaaaagggaggtctaaatggagttgatatctatagtctcgtcactgagaacattcaatggccgaacggaattactttggacttgttgtccggcagattatattgggtcgattctaagttgcatagcatttcatctatcgatgtgaacggaggaaaccgaaagaccatattggaagatgagaagagactggctcaccctttttctttggcagtcttcgaggacaaggtcttttggactgatataatcaatgaagcaattttctcagcaaatcgtttaacaggaagcgacgttaatctccttgcagagaaccttctctctcctgaagacatggttcttttccataatttgacgcagcctcgtggtgttaattggtgtgagcgaactactttgtcaaacggagggtgtcaatatttgtgtctacccgctcctcaaattaaccctcactctcccaagttcacctgtgcctgtcccgatggcatgttgcttgctagagatatgaggtcatgcttgactgaagctgaagctgctgtcgctactcaggaaacttcaacggtgcgcttgaaggtgagttcgacagccgttaggacgcaacatactactaccagaccggtgcctgatacctcgagattgccgggagctacaccaggactgaccactgttgaaatcgttacaatgagtcatcaagcactcggtgatgttgcaggtaggggtaacgagaagaaaccatcctcagtgcgcgctttgagtatcgtgctaccgattgttttgctggtgtttctctgcctaggagttttccttctctggaaaaattggaggcttaagaacataaattctataaatttcgataatcctgtctaccaaaaaactaccgaggatgaggtgcatatctgccacaaccaagacggttacagctatccgtcccgacagatggtttctttggaggacgacgtggct

SEQ ID NO: 661 - DNA, 2580 bp, Artificial Sequence
  Description of Artificial Sequence: Synthetic Transcript Sequence
atggggccttggggctggaagctgcgatggactgtggctctcctcctcgccgctgctggcacggctgtgggagataggtgtgaacgaaatgagtttcaatgtcaagacggaaagtgtatctcctacaagtgggtttgcgacggctcagccgaatgccaagacggctccgacgagagccaggaaacctgcctgtcagtgacgtgcaaaagtggcgatttttcctgtggtgggcgggtgaataggtgtatccctcagttttggcgctgtgacggccaggtggattgcgacaacggtagcgacgaacagggatgcccccccaagacatgtagtcaagacgaatttcgatgtcacgacggaaaatgtatctcaagacagtttgtttgtgattcagaccgcgactgtttggatggatctgacgaggccagttgtcccgttctgacctgcgggcctgcgagttttcagtgtaatagctctacttgtatccctcagctttgggcttgcgacaacgatcctgattgtgaagacggaagtgacgagtggccgcaaagatgtcggggcctctatgtgttccaaggagatagcagtccctgttccgcctttgaattccattgcctgtccggcgagtgcatccatagctcatggcggtgtgatggtggccctgactgcaaagacaaaagcgacgaggagaattgcgctgtggccacctgcagaccagacgagttccaatgctctgatggcaactgcatccatgggtctagacagtgtgatagagaatacgattgcaaggatatgtcagacgaggtggggtgtgtgaatgtaacactgtgtgaaggaccaaataagtttaaatgtcactctggtgaatgtattaccctggacaaagtgtgtaacatggctagggactgccgtgactggagtgatgaacccataaaggagtgtgggacggcagcttgtcttgacaacaacgggggctgctctcacgtctgcaacgcgctcaaaatcggagccgaatgtctgtgccctgatggcttccagctggtggcgcaacggcgttgtgaagacatcgatgagtgtcaggatcccgatacttgttcacagctttgtgtgaacctcgaggggggctacaagtgccagtgtgaagaaggtttccagctggacccccatactaaggcttgcaaggccgtgggctccatcgcatacctctttttcaccaatcgccacgaggtgaggaagatgaccctggaccgaagcgagtacacttcactcataccgaacctgaggaacgtagtggcgctggatacggaggttgctagtaaccgcatttactggagcgaccttagccagaggatgatatgttccacgcaactggacagagcacacggggtgtcctcctacgataccgtgataagccgagacatccaagctcctgacggtctggccgtcgactggatccattctaatatttattggaccgattcagttctggggacagtctcagtggcagatacaaagggtgttaagcggaagaccctatttcgcgaaaatggatctaagccccgggcgatagttgttgacccggtgcatgggtttatgtattggacggattgggggaccccagcaaagatcaagaaaggcgggctgaatggtgtggacatttactccctggttacagagaacattcagtggcccaacggaataaccctagacttactgtccgggcggctgtattgggtggattctaagctacacagcatcagtagcatcgacgttaatggaggcaacaggaagactatactggaagatgaaaagcgactcgcgcaccctttctccctcgccgtctttgaggacaaagtgttttggaccgatattatcaacgaagctatcttcagtgcaaatcgtctgacgggatctgacgtgaatctgttagctgagaacctactgtctcccgaggacatggtgctgttccacaatctcacacaacctagaggagtgaactggtgtgagcgcactactctttcgaatggcggttgtcagtacctgtgcctgccggctccccagattaaccctcattcgccgaagtttacgtgtgcctgcccagatggaatgttgttagcgagggatatgcggagctgcttgacagaagctgaggctgccgtggctacccaggaaacatccacagtacggctgaaagtaagctcaacggccgtgaggactcaacacaccaccactcggcctgttcctgacacatccaggcttccgggcgccactcctgggttgaccacagtggagatagtcactatgagccatcaggccctgggcgatgtggcaggaagaggtaacgagaaaaagccatccagcgtcagagctcttagcatcgttctcccaatagtgctcctagtgttcctctgcttgggcgtgttccttctgtggaaaaactggaggctcaagaatattaacagcattaattttgacaatccagtgtaccagaagacaacagaggatgaggtccatatctgccacaatcaggacggctacagttatccttccaggcagatggtctctttagaggatgatgtcgcg

SEQ ID NO: 662 - DNA, 2580 bp, Artificial Sequence
  Description of Artificial Sequence: Synthetic Transcript Sequence
atgggaccttgggggtggaaactcaggtggaccgtggcactcctactggcagcggctggtacggctgtcggggacaggtgtgagcgcaacgagttccagtgccaggatgggaagtgtatttcatacaagtgggtctgcgacggtagcgcagaatgccaagacggctctgacgagtctcaggagacctgtcttagtgtcacttgcaagtcaggcgatttttcctgcggaggaagagtgaacaggtgcattccacaattctggagatgtgacggccaagtagactgcgacaatggcagcgacgaacagggctgccccccaaagacctgttcgcaggatgagttccgctgccacgacggaaagtgtatctcccggcagttcgtgtgcgattccgatagggattgtttggatggtagcgacgaggctagctgccccgtgttgacctgcggacccgcctcatttcaatgtaactcatccacttgcattccgcagttgtgggcctgtgacaacgacccagactgcgaggacggttcagacgagtggcctcaaaggtgcagagggctgtatgtgttccagggcgatagcagtccttgttccgcattcgaattccattgcctcagcggcgaatgtatccattcgagctggcggtgtgacgggggtccggattgcaaggataaatctgacgaagagaactgtgcggtggctacttgtcgtcctgatgaatttcaatgcagtgatgggaactgtatccacgggtctcgccagtgtgaccgagaatacgactgcaaggacatgtccgacgaggtgggatgcgtaaatgtgacactctgtgagggccctaacaagtttaagtgccacagcggagagtgtatcaccttagacaaggtatgtaacatggccagagattgcagagattggtccgacgaacctattaaggagtgcggtacggctgcctgcctcgacaacaacggcgggtgttcccatgtctgcaacgccctcaagataggagccgagtgcctgtgccccgacggatttcagttagtggcccagcgtcgatgtgaggacatcgatgagtgccaggaccctgatacctgttcccagctctgtgttaacctggagggtggctataaatgccagtgtgaagagggcttccagctggatccacatacgaaggcctgcaaggccgtgggatcaatcgcgtacctgttctttaccaaccgacacgaggtccgtaagatgactctcgatagaagtgaatacacttctctgattcctaacctgaggaatgtggtggcactcgataccgaggtcgcatctaacagaatctactggagcgacctgtctcagcgtatgatttgttcaacccagttggaccgagcccatggcgttagtagttacgacactgtgatctccagagacatccaggcccctgacgggctcgccgtagattggattcattctaatatttattggaccgactctgtgctggggactgtgagcgtagctgataccaagggggtgaagagaaaaaccctgtttcgagagaatggctccaaaccccgggccattgtagtggacccagtgcacggctttatgtactggactgactggggaacaccagccaaaatcaaaaaaggtggattgaacggagttgatatctattccctcgtcacggagaacatccagtggccgaacggcatcacactcgatctgctgagcggtcggctctactgggtggacagtaagctgcatagcatcagtagtattgatgtgaacggtgggaacaggaagactattttagaggacgagaagaggttggcacatcccttctcccttgcagtgttcgaagataaagtcttttggacagacatcatcaacgaggccattttctccgccaaccggttgaccgggtccgatgtgaacctcctcgccgaaaatctactcagtcccgaggacatggtactgttccacaatctgacccagcctagaggggtgaactggtgcgagaggactacgctgtccaatgggggctgccagtacctgtgcctgcccgctccccagattaatcctcattccccaaagttcacctgtgcgtgcccagatggcatgctactcgccagagacatgagatcttgtttgactgaagcagaagccgccgtggccacgcaggaaaccagcacagtgcgcctgaaagtctcaagtactgccgtgaggactcagcataccacgacccggccggtgccagatacaagtcgtttgcctggtgccacccctgggctcacgaccgtcgaaatcgttaccatgagtcaccaggcactgggagatgtcgcaggaagagggaacgagaagaagcccagtagtgtccgggctttgtcgatcgtgcttccgatcgtattattggttttcctgtgtcttggagtcttcctcctgtggaagaactggcggttaaagaacatcaactccatcaattttgataaccctgtgtatcagaaaactactgaagatgaggtgcacatatgccataaccaagacggatatagctatccctctcggcaaatggtctcccttgaagatgatgtcgcc

SEQ ID NO: 663 - DNA, 2580 bp, Artificial Sequence
  Description of Artificial Sequence: Synthetic Transcript Sequence
atgggcccttggggctggaaactgcgctggactgttgccctgctgctcgccgcggctggtaccgccgttggcgatagatgtgaaaggaacgaatttcaatgccaggatggcaaatgtatttcttacaagtgggtgtgcgatggatcagcggagtgtcaggacggctcagatgagtctcaggagacgtgtctgtcagtgacctgcaagtccggagatttcagttgcggaggaagagtcaatagatgtatcccgcaattttggaggtgtgatggtcaggtagattgcgataacggctctgacgagcaaggatgtccccctaagacgtgtagccaggacgagtttagatgccatgacggaaagtgcattagcagacaatttgtgtgcgattccgatagggactgtctcgacggatcagatgaagcgtcttgccccgtcctgacgtgtggtccggctagcttccaatgcaacagtagtacatgcatcccccaactctgggcttgcgataacgatcctgactgcgaagacggctccgacgaatggccacagaggtgcagaggactgtatgtattccagggagactcaagcccgtgcagcgcatttgagtttcactgcctgtccggtgagtgcatccacagtagctggcgctgtgatggaggtcctgactgtaaggacaagagcgatgaagagaactgcgcggtcgccacctgtagacctgatgaattccaatgctctgacggcaactgtatccatggttctcgccagtgcgatcgcgaatatgactgtaaagatatgagcgatgaagttggctgcgtaaacgtcactctctgtgaaggtcctaacaagttcaaatgccacagcggtgagtgcattactctcgataaggtatgtaatatggcaagggattgcagagactggtcagatgagcccataaaggaatgtggaaccgcagcttgtcttgataacaacggcggatgctcacatgtttgcaacgctctgaagatcggcgctgagtgcctttgccccgatggattccagctcgtagcacagaggagatgcgaagacatagacgagtgtcaagaccctgatacctgtagtcaactgtgtgtaaacctcgaaggtggttacaaatgccaatgcgaggagggcttccaactggacccacacaccaaagcgtgtaaagctgtcggatctatcgcttacctgttcttcaccaatagacatgaagtaaggaaaatgacactggacagaagtgagtacacctcccttataccaaatctccgcaacgtcgtagcccttgacaccgaagtggcgtctaatagaatctattggtccgacctgagccaacgcatgatctgctccacccaactggatcgcgcccacggagtttcctcctacgatactgtgatctctagggacatacaggctcctgacggccttgcagtcgactggatccactccaacatctattggactgactctgtattgggcacagtgtctgtggcggatacgaagggagtcaagagaaaaaccttgttccgcgagaacggatccaagccccgcgctattgtggtggatcccgtgcacggtttcatgtattggactgattggggcacacccgccaaaataaaaaaaggaggccttaatggtgtggacatctatagcttggtgacggaaaacatccaatggcctaacggaataactctggatctcctgagcggcagactgtattgggtggattctaaactgcactcaatatcttccatcgatgtgaacggaggcaaccgcaagactatcttggaggacgaaaaaagactggcacatccttttagcttggccgtgttcgaagacaaagttttctggaccgatatcatcaacgaggcaatcttctctgcaaacaggttgaccggatccgatgtgaatctcttggctgagaaccttcttagtccagaagacatggtattgtttcacaatctcacccagcccagaggtgtcaactggtgtgagaggacgacactctctaatggtggttgccagtacctgtgtcttcccgcgccacagattaacccccattcccccaagttcacgtgtgcttgccccgatggtatgctccttgctagggatatgcgctcctgcttgacagaggccgaggctgccgtggctacccaggaaacatccacggttcgcctcaaggtgtcctctacagctgtgaggacccaacacaccaccacgcgccctgtacccgacacatcaagattgccaggtgcgactcccggactcaccaccgtggagatagtgaccatgtcacaccaggcccttggagacgttgccggtaggggaaacgagaagaaaccatcctctgttagggccctctcaatagtgctgcccatagttcttcttgtcttcctgtgtctcggcgtgttcctgctgtggaagaactggaggcttaagaacattaactccatcaattttgacaaccccgtgtaccaaaagaccaccgaagacgaagtgcacatctgccataaccaggacggatattcttatccctccaggcaaatggtttctctggaggatgacgtggcg

SEQ ID NO: 664 - DNA, 2580 bp, Artificial Sequence
  Description of Artificial Sequence: Synthetic Transcript Sequence
atgggtccatggggctggaagctgagatggaccgtggcccttctcctcgccgccgctggtacagctgtcggagaccggtgtgagcgaaatgagttccagtgccaagacggcaagtgtattagttacaagtgggtgtgtgacggatcagcagagtgtcaagatgggtctgatgagtcacaggagacctgtctgtccgtcacatgtaaatccggggacttctcatgcggagggcgcgttaatcggtgtatcccacagttctggaggtgtgacggccaggtcgactgtgataacgggagtgatgagcaggggtgtccccccaagacatgctctcaggacgagtttcggtgtcacgacggtaagtgtatctccaggcagttcgtgtgtgattccgatcgggactgcctggacggttctgatgaggcatcttgcccagttctcacctgtggcccagcttcctttcaatgtaattctagtacttgcatcccgcagctgtgggcatgcgataatgaccctgattgtgaagacggttctgatgagtggccccagaggtgccgcggactgtacgttttccaaggcgatagctcaccttgcagtgcattcgaatttcactgtctcagcggggaatgcatccactcctcctggcgctgcgacggcgggcccgactgcaaggacaaaagcgatgaagagaactgtgcggtggcaacctgtcggcctgatgagttccagtgcagcgatggtaattgcattcacggcagccgccagtgcgatcgcgaatatgattgtaaggatatgagcgacgaggtcgggtgtgtgaacgttacactgtgtgaggggcctaacaaattcaaatgtcacagcggagaatgcattacactggacaaagtgtgtaacatggcacgggattgtcgggactggtccgacgaacctatcaaggagtgcgggaccgccgcctgtttggacaataacggcggctgcagccatgtttgtaacgccctcaagattggggcggaatgtctttgtcccgacggctttcagttggtggcccaaagacggtgtgaagacatcgatgaatgccaagaccccgacacttgttctcagttgtgtgtgaacctggagggcggctataagtgtcagtgcgaggaaggattccagttggacccacacaccaaggcctgcaaagcagtcgggtctatcgcctacctgttctttaccaacaggcacgaggtcaggaaaatgacccttgaccggtctgagtacacgtctctgatccctaacttgaggaatgtggtggcgctggatacggaagtggcttccaatcggatttactggtccgacctgtcccagaggatgatctgcagtactcaacttgaccgcgcccacggggtcagttcatatgacaccgtaatctctcgggacattcaggctcctgatggacttgccgtagactggatccattctaatatttattggacagactccgtactgggcaccgtcagcgtggctgacaccaagggcgtgaaacggaaaaccctgttccgggaaaatggttcaaagcccagagcaatcgtagttgaccctgtacatgggtttatgtactggaccgactggggaactccggctaagatcaagaaaggaggtctgaatggagtggacatatatagtctggtcacggagaacattcagtggccgaatgggatcacactggaccttctgagcggaaggctgtactgggtcgattcaaagctgcattcaattagctctatcgacgtcaacggcggaaaccggaaaaccatcttggaagacgagaaaaggctggcccacccctttagcctggccgtctttgaggataaggtgttttggactgatatcatcaatgaggctatttttagcgccaaccgcctgacaggcagcgatgtgaaccttcttgcagagaacctgctgtccccagaagacatggtcctcttccataacctgactcagccgcgcggcgtgaactggtgtgaacgaacaaccctgtccaacggcggttgtcaatacctgtgcctgcctgctccacagatcaacccgcacagccctaagtttacctgtgcctgtcctgacggcatgttgctggctcgggatatgcggagctgcttgacagaagcagaagcagccgtggccacccaggagacctctactgttcggttgaaggtgtctagtactgccgtaaggacccaacacacgaccacccgcccagtgcccgatacaagtcggctccctggggccacaccaggactcactacagtcgagattgttaccatgtcccaccaggccctcggcgacgtggcggggaggggtaatgaaaagaaacctagttccgtgagagcactgagcatagtgctccctatcgttctgttggtattcctgtgcctcggtgtgtttcttctctggaagaactggcggctcaagaacatcaacagtatcaatttcgacaaccctgtgtaccagaagacaactgaggacgaggtgcacatctgccacaatcaggacgggtacagttatccaagtcgccagatggtctcactcgaagacgacgtagcc

SEQ ID NO: 665 - DNA, 2580 bp, Artificial Sequence
  Description of Artificial Sequence: Synthetic Transcript Sequence
atggggccgtggggttggaagttgaggtggaccgtcgcgcttctgctggctgcggcaggaaccgcagtgggcgacagatgcgagcgcaacgaattccagtgccaggatggaaaatgcatttcatacaaatgggtgtgtgacggctcggcagaatgccaagacggttcagacgagtcacaagaaacctgtctgagcgtcacgtgtaagtccggggatttctcatgcggagggagagtgaaccgctgcattccgcagttctggcgctgcgacggccaggttgattgcgacaatggatcggacgagcaaggatgtccgccaaaaacctgctcacaggatgagttccggtgccatgacggaaagtgcatcagcagacagttcgtctgcgattccgacagagattgcctcgatggttcggatgaagcctcctgcccagtgcttacctgtggacccgcgtccttccagtgcaattcgtccacttgcatccctcagttgtgggcctgtgacaatgatccagactgtgaagatgggtccgacgaatggccgcaacggtgcaggggactgtacgtctttcagggcgattctagcccgtgtagcgcctttgaatttcactgcctgtccggagagtgcatccattcatcatggaggtgtgatgggggtccggactgtaaggataagagcgacgaagagaactgcgccgtggccacttgtcggccggatgagttccaatgttctgatggaaattgcatccatggttctcgccaatgcgatcgggaatacgactgcaaagacatgagcgatgaagtggggtgcgtgaacgtgaccctgtgcgagggcccgaataagtttaagtgccacagtggtgaatgtataactttggataaggtctgcaacatggccagggactgcagagattggtcggatgagccgattaaggagtgcggcactgcagcctgtttggataacaatggcggatgctcacacgtgtgcaacgcgcttaagatcggagccgagtgcctgtgcccagatgggttccagctcgtggcccagcgcaggtgcgaggatattgatgagtgccaggacccggatacttgctcccagctgtgcgtcaacctggaaggcggttacaagtgtcagtgtgaagagggatttcagctggaccctcacactaaagcctgcaaggccgtcggttcaatagcttacctgttcttcaccaaccggcatgaagtgagaaagatgaccctggatagatcagaatataccagcctgatccccaacctgcgaaacgttgtggccctcgacactgaggtggcgagcaaccggatctactggtcagacctgtcgcagagaatgatttgtagcacccaacttgacagagcgcacggagtgtcctcctacgacacggtgatctcgcgggacatccaggcgcccgacggacttgctgtcgactggatccactccaatatctactggactgattccgtgctcggaacggtgtccgtggcagacactaagggcgtgaaacggaaaaccctgttccgggaaaacggaagtaagcctcgggctatcgtggtggacccggtgcacggatttatgtactggactgactggggaactccggccaagatcaagaagggaggccttaacggcgtggacatttactcactggtcactgagaacatccagtggcccaacgggatcactctggacctcctgtccggccggttgtattgggtggattcgaaactgcattcgatctcctcgattgatgtgaacgggggtaatcggaaaaccatcctggaggacgagaaacgccttgcccatcccttctccttggcagtgttcgaggacaaagttttctggaccgatatcatcaacgaggccatcttctccgcaaacagactgaccggttcggacgtgaacttgctcgccgagaatctcctgtccccggaggacatggtgctgtttcataacctgactcagccccgcggagttaattggtgcgaacgcaccaccttgagcaacggaggctgtcagtacctgtgcctgcctgcaccacaaatcaacccgcattcccccaagttcacttgcgcctgcccagatggcatgctgctggctcgcgacatgcgctcgtgcctgacggaggctgaggcggctgttgcaacccaggaaactagcactgtgagattgaaggttagctctacggccgtgcgcacccagcatactactacccgcccagtgccagacacttcccgcctgcctggagcaaccccaggactcactaccgtggaaattgtgactatgtcacaccaagcccttggggacgtggccggcaggggaaacgaaaagaaacccagctccgtcagggcgctgtcgatcgtattgccgatcgtgctgctcgtgttcctctgtcttggtgtgttcctgctctggaagaattggcgcctgaagaatatcaactccattaacttcgacaatccagtgtaccagaaaaccactgaagatgaagttcacatttgtcataaccaagatggatactcgtacccgtcccggcagatggtgtctttggaggacgatgtggct

SEQ ID NO: 666 - DNA, 2580 bp, Artificial Sequence
  Description of Artificial Sequence: Synthetic Transcript Sequence
atgggaccttggggatggaagctgcggtggaccgtggctctcctgctcgcggcggccggaaccgcagtgggcgaccggtgcgaacggaacgaattccagtgccaggatggaaagtgtatctcctacaaatgggtttgcgatggatccgccgaatgccaggacggcagcgatgaatcccaggaaacttgcctcagcgtcacttgcaagtcgggcgacttttcctgtggtggacgcgtgaaccggtgtattccacagttctggagatgtgatggacaggtggactgtgacaacggatccgacgaacagggatgcccgcctaagacgtgctcccaagacgagttcagatgccacgatgggaagtgtatctctcggcaattcgtttgtgacagcgaccgcgactgcctggatggaagcgatgaggcctcttgccctgtgctcacgtgcggcccggcgtcgttccagtgcaattcttcaacctgtatcccgcaactctgggcatgtgacaacgaccccgactgcgaggacggctcggatgagtggcctcagaggtgccggggactgtacgtttttcaaggtgactcgtccccatgctcagctttcgagttccactgcctctcgggagagtgcatccattcgtcctggcgctgtgatggaggaccggactgcaaagataagtcagatgaggaaaattgcgcagtggctacgtgtagaccggacgagttccaatgcagcgacgggaactgcattcatggctcgcggcagtgcgaccgtgaatacgactgcaaggacatgagcgacgaagtgggatgcgtcaatgttaccctctgcgaaggcccgaacaagttcaagtgtcactctggagaatgcatcaccttggacaaggtgtgcaacatggcacgcgattgcagggactggtccgatgaaccaatcaaagaatgtggtaccgcagcatgtctcgacaataacggaggatgctctcatgtctgcaacgcccttaagatcggagctgagtgcctgtgccccgacggctttcaactggtcgcgcagcggcgctgcgaagatatcgacgagtgccaggatccagacacttgctcccaactgtgcgtgaatctggaaggcggctacaagtgtcagtgtgaggaaggtttccaactggatccgcacaccaaggcatgcaaagcggtgggctctattgcgtacttgttcttcaccaatcggcacgaggtcagaaaaatgaccctggatcggagcgagtacacctccctcatcccgaatctgcggaatgtcgtcgccctggatacggaagtggcgtccaaccgcatctattggtccgacctgtcgcaaaggatgatttgttctactcagctggaccgcgctcatggcgtcagctcctacgacacggtgatcagccgcgatatccaggctcctgacggtttggccgtcgattggatacactcaaacatctactggactgactcagttctgggcactgtgtccgtggccgacactaagggggtgaaaagaaaaactctgtttcgggaaaacggatcgaagccgagggccatcgtggtggacccggtgcacgggttcatgtactggacggattggggtactcctgctaagatcaaaaagggaggtctgaatggagtggatatctactcgctcgtgactgaaaacatccagtggccgaacggaatcaccctcgatcttctcagcggacgcctgtactgggtggactccaaactccattcgatcagctcgattgatgtgaacggagggaaccgcaaaactatactggaggatgaaaagcgcttggcccacccattctcgctggctgtgttcgaggataaggtgttctggaccgacatcatcaacgaggccatattctcagccaaccgcctgaccggctcggacgtcaatctgctggccgaaaatctcctgtccccggaggacatggtgttgtttcacaacctgacccaaccccgtggagtgaattggtgcgagcggactactctgagcaatggtggttgccagtatctgtgcttgcccgcgccccagatcaatcctcattcacccaagttcacttgcgcgtgcccggacggcatgcttcttgccagagacatgcgatcatgtcttactgaggccgaagccgcagtggcaacccaggaaacgtcgactgtgcgccttaaagtctcgagcactgcagtcaggacccaacatactaccactcgaccggtcccggacacctcccgactccccggggccacgccggggctcaccaccgtggagattgtgacgatgtcgcatcaagcccttggggacgtcgccgggcgcgggaacgaaaagaagccatcttcggtccgcgcattgtcaattgtcctcccaatcgtgctgttggtttttctgtgtctgggagtctttctgctgtggaagaactggcgcttgaagaatatcaactcaatcaactttgataaccctgtgtaccaaaagaccactgaagatgaagtccacatttgccacaaccaggacggatacagctacccatccagacagatggtgtcccttgaggatgacgtcgca

SEQ ID NO: 667 - DNA, 2580 bp, Artificial Sequence
  Description of Artificial Sequence: Synthetic Transcript Sequence
atgggtccgtggggatggaaacttagatggactgtggccttgctgctggccgcagccggcactgcagtgggagacagatgcgaacgcaacgagtttcagtgccaagacggaaagtgcatcagctacaagtgggtgtgtgatgggagcgcagagtgccaggatggctccgacgagtcccaggagacttgtttgtccgttacgtgtaagtccggagacttctcatgcggaggccgggtcaacaggtgtatcccacaattctggcgctgcgatggtcaagtggactgcgataatggatcggatgaacagggatgcccacctaaaacttgcagccaagatgaattccggtgccacgacggcaagtgcatctcgcggcagttcgtgtgtgattcggatagagactgcctggacgggtccgacgaggccagctgtccggtgcttacctgtggccctgcatcatttcagtgcaattcgtctacttgcatcccgcagctctgggcgtgcgataacgatccagactgtgaggacgggtctgacgaatggccccagcgctgccgcggactgtacgtgttccaaggggactcgagcccatgctccgcgttcgagtttcactgcctctccggcgaatgcattcacagctcgtggcgatgcgatggtggacccgactgcaaagacaagtcagacgaggaaaattgtgcagtggccacttgtcgcccagatgaattccagtgctccgacggtaattgcatacatggatcaaggcagtgcgacagggaatacgactgcaaggatatgagcgacgaggtgggatgcgtcaatgtgactctgtgcgaaggaccaaacaagttcaagtgccatagcggcgagtgcattaccctggacaaggtctgcaatatggcccgcgactgtagggactggtcggatgagcctatcaaagaatgcggaaccgccgcttgccttgataacaacggaggctgctcacacgtgtgtaacgcactcaaaatcggagccgaatgcctgtgtccggacggcttccaactcgtggcccagaggcggtgcgaggatatcgacgaatgccaagatccagacacttgttcccagctgtgcgtcaatctcgaaggaggatacaaatgtcagtgcgaagaaggattccagcttgaccctcacactaaggcgtgtaaggccgtcggatcaatagcatacttgttcttcaccaaccggcatgaagtgagaaagatgactctggatagatcagagtacacgtccctgatcccaaatctccgcaacgttgtggcgcttgatactgaagttgcgtcgaaccgcatctactggtccgacttgagccagagaatgatttgtagcacgcaactcgatcgggcccacggtgtgagctcgtacgacactgtgatcagccgcgacatccaggcccctgatggcctggcagtggactggatccatagcaacatttactggacggattccgtgttgggaacggtttcggtggccgatactaagggagttaagagaaagaccctgttcagagagaacgggtccaaaccgcgggcaatcgtggtcgaccctgtgcacggctttatgtactggactgactggggaactccagctaagatcaagaagggtggactcaacggcgtggatatctactcgctggtgaccgaaaacatccaatggcccaatggcatcaccctggatcttctgtccggtcgcctgtattgggtcgatagcaaactccactcaatctcgtccatcgacgtgaacggcggcaaccgtaaaaccattctggaggatgaaaagaggctcgcgcatcctttctccttggccgtgttcgaggacaaggtgttctggaccgacatcatcaatgaggctatcttttcggctaatcgcctgaccggtagcgacgtgaatttgctggccgaaaacctcctctcgcccgaggacatggtgctctttcacaacctgacccagccgcggggagtcaactggtgcgaacggaccaccctgtcgaacggaggatgccagtacctgtgcctgcctgccccacaaatcaatcctcattcgccaaaattcacctgtgcatgcccggatggaatgctgttggcacgcgatatgcgctcctgcctgaccgaagctgaggcggctgtggcaacccaggaaaccagcacggtgagattgaaggtgagcagcactgctgtcagaactcagcatactaccacccgccccgtcccagacacgagccggttgccgggcgcgaccccgggcctgacgactgtggaaattgtgactatgtcgcaccaagccctcggagacgtggcgggaagaggcaatgagaagaagccgtcatcggtcagagcactcagcattgtcctcccaatcgtgctgttggtgtttctctgcctcggagtgttcctgctgtggaaaaactggcggctgaagaatatcaactcaatcaattttgacaacccggtgtatcaaaagacgacggaggacgaagtgcacatctgtcacaatcaggacggatactcatacccctcgcgccagatggtgtcgctggaagatgacgtcgcc

SEQ ID NO: 668 - DNA, 2580 bp, Artificial Sequence
  Description of Artificial Sequence: Synthetic Transcript Sequence
atgggtccctggggctggaagctccgctggaccgtggcacttttgctagcagcagctggcaccgccgtcggagatcgatgtgaacgcaatgagtttcaatgccaggacgggaaatgtatctcttacaaatgggtctgcgatggtagtgccgagtgccaggatggctccgatgagagtcaggagacatgccttagtgtgacctgcaagtccggtgacttttcatgtggggggcgtgtgaataggtgtatcccacagttttggaggtgtgatggtcaggtggattgtgataatggatcagatgagcagggctgcccacctaaaacatgtagccaagacgaatttagatgtcatgacggaaagtgcatatcccggcagtttgtgtgcgatagtgatcgagactgtctcgatggcagtgacgaagctagctgtccagtgttaacatgtggacctgcctccttccaatgcaactcttctacttgtatccctcagttatgggcttgcgacaacgaccccgattgtgaggatgggtctgatgaatggcctcagaggtgtcgtgggctctacgtgttccagggagactcctcaccatgctcagcattcgaatttcactgcttgagcggagagtgcatacactccagctggcgctgtgatggcggacctgattgtaaagataaatccgatgaggagaactgtgccgtggccacatgcagaccagacgagtttcagtgtagcgacggcaactgcatccacggtagccgacaatgtgatcgtgagtacgactgcaaggatatgtctgacgaggttgggtgtgtgaacgtcacactgtgtgagggaccaaacaaattcaagtgtcatagtggggagtgcatcacgcttgataaggtgtgcaatatggccagagactgccgggactggtctgatgagccaatcaaagagtgcgggacggccgcttgtctcgacaacaacggtgggtgttctcacgtttgcaacgccctgaagattggggcagagtgtttgtgtcctgatgggtttcagctggtagcacagcgtagatgtgaagacatagacgaatgtcaggacccagatacatgttcgcagttgtgcgtgaacctggaaggggggtataaatgtcagtgcgaggaggggtttcaactggatccccataccaaggcgtgcaaggcggtggggtccatcgcttacctcttttttaccaacaggcacgaggtgagaaagatgactctggatcgtagtgaatataccagtttaatacccaatctccggaatgtggtggcactggatacagaagtggcgtcaaatcggatttactggagcgatcttagccagcggatgatctgctccacgcaactggatagggcccacggcgtgtcaagctatgatacagttatttctcgggatatccaggctcccgacggcctagcagtcgattggattcacagcaatatctactggacggactcagtgttgggcacggtaagcgtcgcagataccaaaggagtgaaaagaaaaacactgttccgagagaatggaagtaaacctcgcgcaattgtagtagaccctgtgcatggattcatgtattggaccgactgggggactcccgcgaaaatcaagaaagggggcctgaatggggtggatatttattccttagtcactgaaaatatccagtggcccaatggcattactctggatttgctgtctgggcgcctttactgggtggattccaagctgcactccatctctagcatcgatgtgaacggcgggaacaggaaaacaatcttagaggatgagaagcggcttgcccacccattcagcctggccgtgttcgaagataaggtgttttggaccgacattataaacgaggccatattttcggcgaaccgtctgaccggctcagacgttaacctcttggcagagaatttgctatcgcccgaggacatggtgctgttccataatctcacacagccacgtggggtcaactggtgtgagcggactacattgtcaaacgggggctgccaatacctgtgtctgccagcgccccagatcaatccccattcccctaaatttacgtgcgcctgccccgacggcatgctgctggcaagagacatgaggtcctgcctgactgaggctgaagcagccgtggccacacaagagactagcaccgtgcgcctgaaagtatcttccactgccgtccggactcagcacaccaccacaagacccgtccctgatacttctcgactgccgggggccacgccggggctgacaaccgtggagattgtcaccatgagccaccaagctctcggggatgtggccggcagagggaatgaaaagaagccgtcatcagtgcgggctctgtctattgtgctcccgatcgtgctgctagtgtttctgtgcttaggggttttcctcctctggaagaactggagactcaagaacatcaacagcataaacttcgacaaccccgtatatcagaaaactactgaagatgaggtacatatttgtcataatcaggatggatactcgtacccttcaagacaaatggtgtctctggaagatgacgtcgcc

SEQ ID NO: 669 - DNA, 2580 bp, Artificial Sequence
  Description of Artificial Sequence: Synthetic Transcript Sequence
atgggcccatggggatggaagctgcgctggactgtggcgctgctgctggcggcggccgggaccgcggtgggtgaccgctgtgaaagaaacgagtttcagtgtcaagacggaaagtgcatctcctacaaatgggtgtgcgatggctccgcggagtgccaagacggctcagatgaaagccaagagacttgcctgtcggtgacttgcaaaagcggagattttagctgcggaggtagagtgaacaggtgcatacctcagttttggaggtgtgatgggcaggtcgattgtgataacgggtcggacgaacagggatgccctcctaaaacttgctcgcaggacgagttccggtgccacgacgggaagtgcatctctcggcagtttgtgtgcgactccgatcgggactgtctcgatggatcagacgaagcctcctgtccagtgctgacttgcgggccggcttcattccagtgtaacagctcgacttgtatcccgcagctctgggcatgcgacaatgaccccgactgtgaagatggctcagatgagtggccgcaacgctgtagaggactgtacgtgttccagggcgattcaagcccatgctcggctttcgagtttcattgtttgagtggagagtgcatccactcctcgtggaggtgcgacgggggaccggattgcaaggataaatcggacgaagagaattgcgcagtggcgacctgtcgccctgatgaattccagtgttccgacggaaattgcatccatggatcccggcaatgtgaccgcgagtacgactgtaaggacatgtccgatgaagttggatgcgtgaatgtcacgctctgcgaaggaccaaacaagttcaaatgtcactcgggcgagtgcatcactctcgacaaggtttgtaacatggcacgggactgcagagactggtcggacgagcccattaaggagtgcggaaccgccgcatgccttgacaacaacggtggctgctcgcacgtctgtaacgctctgaaaatcggcgcggaatgcctctgccccgacggctttcaactggtcgctcagaggcgctgcgaagacatcgacgagtgtcaggacccggatacctgcagccagctctgcgtgaacctggaagggggttacaagtgtcaatgcgaggagggatttcaactggatccgcatactaaggcatgtaaggccgtgggttcgattgcgtacctgttctttaccaatagacacgaagtgaggaagatgactctggaccgctcggaatacacttcgctgatcccgaatctgcgcaacgtggtggccctggacaccgaagtcgcttcgaatcgcatctactggtccgatcttagccagagaatgatctgttcaacccagctcgacagagctcacggtgtctcctcctacgacaccgtgatctcgcgggacatccaggcgccggacggactggcggtggattggatccactctaacatctactggaccgattcggtgcttggaaccgtgagcgtggcagacactaaaggcgttaagcgcaaaaccctcttccgcgaaaacggctcaaagccgcgggcgatcgtcgtggatccggtgcacggcttcatgtattggactgattgggggaccccggccaagatcaaaaagggcggactgaacggagttgacatctacagcctcgtcaccgagaatatccagtggccgaacggaattactctcgatctgctctcgggacgcctttactgggtcgatagcaagctgcattcgatctcttccatcgacgtgaacgggggcaatcgcaagacgatcttggaagacgaaaaacggctcgcccacccgttctcattggccgtcttcgaagataaggtgttctggactgacatcatcaacgaagctattttctcagcaaatagactcactggatcggacgtgaatctcctcgcagaaaatctgttgtcgccggaggacatggtgctgttccacaacctgactcagccacggggagtgaactggtgtgagcgcactaccttgtcgaacggggggtgccaatacctgtgcctgccggccccacagatcaatccacactcacctaagttcacctgcgcctgccctgatggcatgctgctggctagggacatgagaagctgtctgactgaagccgaagcggctgtggcgactcaggaaacgtcgactgtgagacttaaggtgtctagcactgctgtgcgcacccagcacactactactcgaccggttccggacactagcagacttccgggtgcaaccccaggcctcactaccgtggaaattgtgaccatgagccatcaggccttgggcgacgtggcgggtcgcggaaatgaaaagaagccgtcctcagttagagcgctgtcgatcgtgctcccaatcgtgctcctggtgtttttgtgcctgggagtgttcctgctgtggaaaaattggcgcctcaaaaacatcaattcgatcaacttcgataatccggtctaccagaagaccaccgaagatgaagtgcatatctgtcacaatcaggatgggtacagctacccgtcccgccaaatggtgtcactggaggatgacgtggcg

SEQ ID NO: 670 - DNA, 2580 bp, Artificial Sequence
  Description of Artificial Sequence: Synthetic Transcript Sequence
atgggaccttgggggtggaaactgaggtggactgtcgcccttctcctcgccgccgctgggactgctgtcggggatagatgcgaacgaaatgagtttcagtgccaggacgggaagtgcatctcatacaaatgggtctgcgatgggagtgccgagtgccaggacggttccgatgagagtcaggagacgtgtctgtccgtgacctgcaagtccggtgatttttcctgtggcgggcgggtgaaccgatgcatacctcaattttggcgttgtgatgggcaggtggactgcgacaatggatccgatgaacaggggtgcccccccaagacttgctcacaagatgagtttcgttgccatgacggtaagtgtatatcacgacaattcgtatgcgattctgacagggattgtctggatggaagcgatgaggcatcttgcccagtgctgacgtgcggacccgcaagcttccagtgtaactctagcacctgcattccacaattgtgggcctgcgacaatgaccccgactgtgaggacgggagtgatgagtggcctcagcgctgccgtggtttgtatgtatttcagggagacagttctccatgtagtgcctttgaatttcactgtctgagcggtgagtgtatccactcatcttggagatgtgacggaggacccgactgtaaagacaagtcggacgaggaaaattgtgccgtcgccacctgtcgaccggatgaatttcagtgcagtgacggcaactgtatccacggatcgagacagtgcgacagggagtacgactgtaaagatatgtcagatgaggtggggtgcgttaatgtgacactttgtgagggccccaataagtttaaatgtcatagcggtgagtgcattaccttagataaggtttgtaacatggcgagggactgccgtgactggagtgatgaaccaatcaaagagtgcggcacggccgcgtgcttggataacaacggtggatgttcccacgtttgcaacgccctcaaaatcggcgctgaatgcttatgtcccgatgggtttcagttggtggcccagcggcgctgtgaggacatcgacgaatgccaggatcccgatacctgtagccagctgtgtgtcaatctggagggagggtacaagtgtcagtgtgaggaaggcttccaattagacccccacacaaaggcttgcaaagcggtcggttcaatcgcctacctcttcttcacaaaccgccatgaagttaggaagatgacattggatagatccgaatacactagtctaattcctaacctacggaatgtggtggcattagacacagaagttgcaagtaatcgcatctactggtccgacctgtcacagcgcatgatttgtagcacacaactcgatcgtgcccatggtgtgagtagttacgacacagtgatctctagggatattcaggcacctgatggcttggccgtggattggatacacagtaacatttactggactgacagtgttcttggaactgtttctgtggccgacacgaagggcgtcaaacggaagacgctgtttcgggagaatggcagcaaacctcgcgccattgtggttgatcccgtgcacggattcatgtactggactgactggggcaccccggcaaaaattaagaaaggggggttgaatggagttgacatctactctttggttacggagaatatccaatggcccaatggtattactctagatctgttaagtggacgactgtactgggtggactccaagttgcactctatttcctccatcgacgtgaatggtggcaacaggaagactatactagaggatgagaagagactcgcccatcctttctccctcgccgtattcgaggataaggtcttttggacggacattatcaatgaggctattttctctgctaaccgtctcacaggctccgatgtgaacctgctagctgaaaacctgctgtctccagaggatatggtgcttttccataacctgacgcagcctcgaggggttaactggtgtgaaagaactaccctctcgaacgggggttgtcagtatctctgtctccctgccccgcaaattaatcctcattctcccaagtttacctgcgcttgccctgacggtatgctactcgcccgcgacatgcgttcttgccttactgaggcagaagccgctgttgccacccaggagacctccacagtgcggttgaaggtaagtagcacagcggtgcgaactcagcacaccacaacacggccagtcccagatacatctcgcttacccggcgctacccctggacttaccacagtggagatcgtgactatgagccaccaggccttgggggacgtcgccggcagagggaatgaaaagaagccttcgtctgtccgagccctgtctatagtgctgcccattgtgctgttggtgtttctctgtctgggagtgttcctgttgtggaaaaactggcggctaaaaaacattaattccatcaactttgacaatccagtataccagaagaccaccgaggatgaagtccacatctgccacaatcaggatgggtactcttacccctcccgccagatggtgtctctcgaagacgacgtcgca

SEQ ID NO: 671 - DNA, 2580 bp, Artificial Sequence
  Description of Artificial Sequence: Synthetic Transcript Sequence
atgggcccctggggctggaaactgcggtggacagtcgccctcttactcgccgctgctggtacagctgtgggtgatagatgtgaacgaaatgagttccagtgtcaggacgggaaatgtatctcctacaagtgggtctgtgacggctctgcagagtgtcaggatggaagcgacgagtcccaagaaacttgcctgagcgtcacatgcaagtccggcgactttagttgcggaggtcgcgttaatcggtgcattcctcagttttggagatgcgacggacaggtggattgcgacaatggctcggatgagcagggctgtcctcccaaaacctgttcccaagacgaattccgctgccacgatggtaagtgcatcagcaggcagtttgtttgcgatagtgaccgcgattgcctcgacggatcagacgaagctagctgtcctgtcctgacatgtggacctgcatcattccagtgtaacagttctacttgcattccccagctctgggcgtgtgataatgacccggactgcgaggatggcagcgatgaatggccacagcgttgccgtggtctttatgtttttcaaggggacagctcgccttgttcagccttcgaattccattgtttatccggagaatgtattcactccagttggcggtgtgacggaggccctgattgtaaagataaaagtgacgaggagaactgcgccgtggccacttgccgccctgacgaattccagtgctctgatgggaattgtatccatggaagtagacagtgcgaccgagagtacgactgtaaagatatgtcagacgaggtggggtgcgtgaatgtgaccttgtgcgaggggcctaataaatttaagtgtcactcaggtgaatgcatcacactggacaaggtctgtaatatggcccgggactgtcgtgactggtccgatgaaccaattaaggaatgcggcaccgccgcctgtttggacaataacggaggatgctcgcatgtctgtaacgcccttaaaataggggccgaatgcctctgtccagatggtttccaactagttgctcagagacgatgtgaagacatagatgagtgtcaggaccccgatacttgttcgcaattgtgtgtcaacttggaaggaggctacaaatgccagtgtgaagaggggtttcagttagatcctcataccaaggcctgtaaagcagtaggatctattgcctatctcttctttacaaatcggcacgaggttcgtaaaatgaccctggataggtcagagtataccagcttaatccctaatctcaggaatgtcgtcgctctggacaccgaagttgcaagcaatcgaatctactggagtgacctgtcgcaaagaatgatctgcagcacccagttggaccgcgcacacggggtttcctcctatgacacggttattagtcgcgacatccaggcaccggacggactggccgtggactggattcattcaaatatctactggacagattcagtgttgggcaccgtgagcgttgccgatacgaagggcgtcaaaaggaaaacgctgttcagagagaacggaagtaaacctcgagctatagtcgttgaccctgtacacggctttatgtactggacagattgggggacccctgctaagatcaagaaggggggacttaatggagtcgacatttactccctggttacagagaacatccagtggcctaatgggatcactttagacctccttagcggtaggctgtattgggtggattctaagctgcattctatctctagcatcgatgtgaacggaggcaacaggaaaaccatcttagaagatgaaaagcgcctggcccaccctttttcactcgcagttttcgaagataaagtgttttggaccgacattataaatgaggctattttttccgctaatcggctgaccggtagtgatgtcaatctcctggccgagaatttactcagccccgaagacatggtcctgttccacaacctcacccagccccggggtgtgaactggtgcgaacggactaccttatcgaacggcggttgccagtacctatgcctgcctgccccccagattaatccccactccccgaagttcacctgcgcctgtccggatgggatgctactggcacgagacatgcggtcgtgtcttactgaggctgaggccgccgtagctactcaggagaccagcaccgtaagacttaaagtctcatcaactgcagttagaacccagcacacaacaactcggccagtaccggacacctcgcgactgccgggcgcaacaccggggctgacaaccgtggaaatagtcacaatgtcccatcaggctctgggagatgttgctgggaggggaaatgagaagaagcccagctctgtaagggctctctccatagtactccctatagtgctgttggtcttcctgtgcctgggcgtctttctgctatggaaaaattggcggttgaagaacatcaactctatcaattttgacaatcccgtttaccagaaaacaacggaggacgaggttcatatatgccacaaccaggacggatacagctacccttctagacagatggttagtctggaggacgatgtggcc

SEQ ID NO: 672 - DNA, 2580 bp, Artificial Sequence
  Description of Artificial Sequence: Synthetic Transcript Sequence
atggggccgtggggatggaaacttagatggaccgttgcattgttgttggcggcggcaggcacagcagtaggggacaggtgtgagcgcaacgagttccagtgtcaggatggaaagtgtatttcatacaaatgggtgtgcgatggaagcgctgagtgccaggacggaagcgacgaaagccaagagacatgcttgagtgtaacatgtaagtccggcgattttagctgcggggggcgcgttaacaggtgcatcccgcaattctggaggtgtgacggccaggtggactgtgataacggtagcgatgagcagggctgcccgcctaagacatgtagccaagacgagtttcggtgtcacgacggaaagtgtatttcaagacaattcgtctgcgattccgacagggattgtctcgacggatctgatgaagccagttgtcctgtcctgacctgcggcccggctagcttccagtgtaatagttctacttgcattccgcagctgtgggcatgcgataatgatccagactgtgaggacggatctgacgaatggcctcaacggtgtagaggcctctacgtatttcaaggtgattcttcaccgtgtagtgcattcgagtttcactgtctgagcggagaatgtatccactcaagctggcgctgcgacggaggtcccgattgtaaggacaaaagtgatgaagaaaactgcgctgtggcgacttgcaggcccgatgagtttcagtgtagcgacgggaactgcatacacggtagccggcaatgcgacagggaatacgattgtaaggatatgtctgatgaagttgggtgtgttaatgtgaccctttgcgagggccccaacaagtttaaatgtcacagcggtgagtgcataaccctggataaagtgtgtaacatggctcgtgattgcagggattggagcgacgagccaattaaagaatgtggcacagcagcatgccttgacaacaacggggggtgcagccacgtgtgcaacgctctgaagattggggcagagtgcctttgtcctgacggcttccaactggttgctcagagaagatgcgaggacattgatgaatgtcaggatcccgacacttgcagtcaactctgcgtcaacctcgagggtggatacaaatgtcaatgcgaggaaggctttcagcttgacccacataccaaggcgtgcaaagctgtgggcagcattgcttacctgtttttcactaaccgccatgaggtgagaaaaatgactctcgatagaagtgagtatacttccttaattcccaatctgcgcaatgtagtagctcttgacactgaagttgctagcaaccgaatctattggtctgatcttagccagaggatgatatgctctactcagctcgaccgggcacatggcgtgagtagttacgataccgttattagtcgagacatccaagctccggacgggctcgctgtggactggattcactcaaacatttattggacagactctgtgctgggcaccgttagtgtagctgataccaaaggagtgaaacgaaaaaccctcttcagggagaacgggtcaaagccacgggctatcgtcgtggatccagttcacggtttcatgtattggaccgattggggaacaccagctaaaattaagaagggaggtctcaatggggtggacatctacagcctcgtcactgagaacattcagtggcccaatggaatcacattggatcttctgagcggtagactctactgggtcgattctaaactgcattccatcagttctatcgatgtgaacggcgggaacagaaaaaccatcttggaggacgaaaaaagacttgcacacccgtttagtcttgccgtttttgaagataaagttttttggaccgacatcataaacgaggcaatcttcagcgcaaataggctaactggatctgacgttaacctgctcgctgaaaaccttctgagcccagaagacatggtgctgttccataacctgacccagccaagaggagtgaattggtgtgaacgtactacactttccaacggcggctgtcagtacttgtgcctgccagcgccccagatcaacccccactcacctaagtttacatgcgcttgtccagacggcatgcttctcgctagagacatgcgcagctgtcttaccgaagccgaggctgccgtggcaacacaagagacctctaccgtaaggctcaaagtctcaagcaccgctgttaggacacagcataccaccacaagacctgttcctgatacttcaaggttgcctggcgccacccctggcctcacaaccgtagaaatcgttaccatgtcccatcaggccctgggcgacgtggccggccggggcaacgagaagaagccctcaagcgtaagggcactgtctatcgtgctgcccatcgtccttctggttttcttgtgtttgggggtcttcctgctttggaaaaactggaggctcaaaaatattaactctattaactttgacaatcccgtgtaccagaagaccacagaagatgaagtgcacatctgtcacaatcaagacggatactcttacccctcaagacaaatggtttctcttgaagacgatgtcgca

SEQ ID NO: 673 - DNA, 2580 bp, Artificial Sequence
  Description of Artificial Sequence: Synthetic Transcript Sequence
atgggtccctggggctggaaactgcgatggactgtggccctgttgctcgccgctgctgggaccgcagtcggggatcgctgcgagcgaaacgaattccagtgtcaggatggcaaatgtatcagctacaagtgggtgtgtgacggaagcgctgaatgccaggatggatccgacgaaagccaggaaacatgcctttccgtgacttgcaagtcgggtgatttttcttgcgggggcagagttaatcgctgtattccgcaattctggcgatgcgatggccaagtagactgtgataacggcagtgacgagcaggggtgcccccccaaaacctgttcgcaggatgagtttcgatgccatgacgggaagtgtatctcccgccagtttgtgtgtgactccgacagagactgtttggatgggtccgatgaggcctcttgccctgtgcttacgtgcggacccgcgagctttcagtgcaattcgtcaacatgcatcccacagctgtgggcgtgtgataacgaccctgactgcgaagatggctccgacgagtggccacagcggtgtagggggctttacgtgttccaaggcgattcgtccccttgctccgcatttgaattccactgtctgtccggcgaatgtatccactcttcatggaggtgtgacgggggaccagattgcaaggacaaatccgatgaggagaattgtgcggtcgccacctgtcggccagacgagttccagtgttccgacggcaactgcatacacggatctcgccagtgtgatcgcgaatatgattgcaaagatatgtccgacgaggtcggctgcgtaaatgttaccttatgtgaaggtcctaataagttcaagtgtcattctggcgagtgtataaccctggacaaggtctgtaatatggcgagagactgtcgcgattggagcgatgagccaattaaggaatgcggcacagcagcttgtctggacaataatggcggatgtagtcacgtctgcaacgctcttaagataggcgctgagtgtctgtgtcctgacggctttcagttggtggctcagaggcgctgcgaagacatcgatgaatgccaggatcctgacacttgctctcaactgtgcgtgaatctggaggggggttacaagtgtcagtgtgaagagggattccagctggatcctcatacaaaagcttgcaaggctgtgggcagtatcgcctacctcttcttcacaaacagacacgaagtcaggaagatgacactggacaggtctgagtacaccagcctgattcctaaccttcgcaacgtagttgctcttgatacagaggtggctagtaaccgtatctactggtcggatttgtctcagcggatgatctgtagtacccagctcgacagggctcacggagtatccagttacgacacggtgattagtagggacatccaggcacccgacggactcgcagtagactggatacactccaatatttattggaccgactctgtcttggggacagtttcagtggcagacacaaagggggtcaaacggaaaacacttttccgggaaaacggctcaaagccgcgggctattgttgtcgatcccgtccacggctttatgtactggaccgactggggcacccctgctaaaataaagaagggaggcttaaatggagtagatatatacagccttgtgaccgaaaatatacaatggcccaacggtatcaccctggatttgctgagcggtaggctctactgggtcgactcgaaactccatagtatctctagtattgacgtgaatggcgggaacaggaaaactatcctggaagacgagaagcgcctcgcccatcctttctccctagctgtgttcgaagacaaagtattctggacagacattataaatgaggcaatcttctcggccaatcgccttactggctctgacgtgaaccttctggccgagaacctactgagccctgaagacatggtcctgtttcacaacctcactcagccacggggcgtgaactggtgcgaacgtactaccctgtctaacggaggatgtcagtatctgtgtttgcctgcacctcagattaatccacacagcccaaaattcacatgcgcttgcccagatggcatgcttctggcacgggacatgcgttcttgtcttactgaggctgaagctgccgttgccactcaagagacttctactgtgaggctaaaagtttcctccaccgccgtccggacccaacacacaaccactcgtccagtacctgacactagtcgactcccaggggctacgccaggcctgacaaccgtagaaattgtgacaatgtctcatcaagctcttggcgatgtagctggtcgtggcaacgaaaaaaaaccctcctccgtgcgagctttgtccatcgtactccctattgtcctcctggtgtttctttgtctaggggtctttctgctgtggaagaattggcgtctgaagaacatcaattcaataaactttgacaaccccgtgtatcagaagaccacggaagacgaggtccacatctgtcacaaccaggacggctatagctatccttcccgacagatggtgtcacttgaggacgacgttgct

SEQ ID NO: 674 - DNA, 2580 bp, Artificial Sequence
  Description of Artificial Sequence: Synthetic Transcript Sequence
atggggccctggggatggaaacttcggtggacagtggctcttctactcgctgccgctgggacagcagtgggagatcgatgtgaacgaaacgaatttcagtgtcaggatgggaagtgtatttcctataaatgggtgtgtgatggatctgccgaatgtcaggacgggtccgacgaatcccaggaaacatgtcttagtgtgacttgtaaaagtggggatttttcctgtggggggagggtgaacaggtgtatccctcagttctggcggtgtgatggacaggttgattgtgataatggatcagacgagcaggggtgtccacccaagacatgcagtcaggatgaatttaggtgtcatgatgggaaatgcatatcccggcagttcgtatgcgactcagatcgggattgtttggacgggtcagatgaggcttcctgcccagtgctgacttgtggacccgcatcatttcagtgtaattcctctacttgtatccctcagctctgggcctgcgataacgaccccgactgcgaagacgggtctgatgaatggcctcagagatgtagggggctctatgtgttccagggggatagttcaccttgtagtgctttcgagttccattgtcttagtggggaatgtatccactccagttggcggtgtgatgggggacctgattgtaaagataaaagtgatgaagaaaattgcgccgttgccacttgccgcccggatgagttccagtgtagtgatggaaattgtattcatggatccaggcaatgcgatcgcgagtatgattgtaaagatatgtccgatgaagtgggatgcgttaacgtcacactgtgtgaagggcccaataagtttaaatgccatagtggggaatgcataactttagacaaagtatgtaacatggcacgggattgccgggactggtccgatgagccaattaaagaatgcggaacagccgcctgtctcgataacaatggggggtgctcccacgtgtgcaatgccctgaaaataggagcagaatgcctctgcccagatggatttcagctagtcgcacagcgaaggtgtgaagatatagatgaatgtcaagaccctgatacttgttctcagctctgcgttaatttggaagggggatataaatgccagtgcgaagaaggatttcaactagatccccacactaaagcatgcaaagctgtggggtctatcgcttacctcttttttacaaaccgacacgaagtgcgcaagatgactctagatagatccgaatatacaagtctcatcccaaatctccgaaacgtggtggccctggatactgaagtggcatcaaatcggatctattggtctgatctctctcagagaatgatttgttctacacaactagatcgagcacatggagtgtcatcttacgatacagtgatctctcgagatattcaggcacccgatgggctagccgtggattggatacatagtaacatatattggactgattcagtgcttgggactgtatctgttgcagatactaaaggagtgaaaaggaagactctgtttagggaaaacggaagtaagcctagagccatcgtagtggaccccgttcacggatttatgtattggacagactgggggactcctgctaaaatcaaaaagggagggctgaacggggtcgacatatacagtttagtaacagaaaatatccagtggccaaatggaataactctagatctactgagtgggcggctttattgggtcgattctaaattgcactccattagttctattgatgtcaatggagggaatcgaaagactatcctggaggacgagaaacgacttgcccatccattttctctggccgtatttgaagataaagtgttctggacagatatcattaacgaggctattttttctgctaacagattaactggatccgatgtcaatctcctggccgagaacctcctgtcccccgaagatatggtgttgtttcacaacctcacacaaccaagaggagtgaattggtgtgaacgaacaacactttccaatggggggtgtcagtatctgtgtttgcctgctccacaaatcaacccccactctccgaagttcacttgcgcctgccccgatgggatgctcttagcacgcgacatgagatcttgtctcactgaagcagaggcagccgtggcaactcaggaaactagtacagtacggttaaaagtgtcttcaacagccgttagaacacagcacactactacacgccctgtgccagatacttccagactgcctggggccactccaggactgactacagtggaaattgtgactatgtcccaccaggctcttggagatgtcgccggacgcgggaacgagaaaaaaccctcgtctgtaagggccctatccatagttctccctatcgtgctgctggtatttttatgcctaggggtttttctcctttggaaaaactggcggcttaaaaacataaactccatcaactttgacaatcctgtgtatcagaaaacaacggaagatgaggtgcacatatgtcataaccaggatgggtactcctatccctcgcggcagatggtgagtctggaagatgatgtcgct

SEQ ID NO: 675 - DNA, 2580 bp, Artificial Sequence
  Description of Artificial Sequence: Synthetic Transcript Sequence
atgggaccatggggctggaaactgaggtggactgtggcgctcctgctggccgctgcgggaactgcggtcggagacagatgcgaacgcaatgaattccagtgccaggacggaaagtgcattagctacaaatgggtgtgcgacggatcagccgaatgccaggacggcagcgacgagtcacaggaaacctgcctctccgtgacgtgtaaatccggggatttctcgtgcggcggccgcgtgaatagatgcatcccgcagttctggaggtgcgatggacaggtcgattgcgacaatggatcggatgagcaaggttgtccgccgaaaacctgctcgcaggacgagttccggtgtcatgatgggaagtgcatcagcaggcagtttgtctgcgatagcgaccgcgattgtctggatggaagcgacgaggcgtcatgtcctgtgctcacgtgtggcccggcctcgttccagtgtaactcctcgacctgcataccgcaactgtgggcgtgcgataacgacccggactgcgaagatggatcggacgaatggccccaacggtgccggggactctacgtctttcagggagactcgtcaccatgttcggctttcgaatttcattgcctgagcggtgaatgcatccactcttcgtggcggtgcgatggagggcctgattgtaaggacaagagcgacgaggagaactgtgccgtggctacctgtcggccggacgagtttcagtgctcggatggcaattgcattcacggaagccgccagtgcgatcgggagtacgattgcaaggatatgtcggacgaagtgggatgcgtgaacgtgactttgtgcgaaggccccaataagtttaagtgccatagtggtgagtgtatcacgctggacaaagtgtgtaatatggcaagggactgtcgtgattggagcgacgagccaatcaaggagtgcggaactgccgcgtgtctggataacaacggtgggtgcagtcacgtgtgcaatgctctcaagattggcgccgaatgcctgtgcccagatgggttccagctggtcgctcaacggagatgcgaagatattgatgagtgtcaagatcctgacacttgctcgcagctctgcgtgaaccttgagggagggtacaaatgccaatgcgaggagggatttcagctggatccgcacaccaaagcgtgcaaagctgtgggatcgatcgcatacttgtttttcactaataggcatgaagtccgcaagatgaccctcgaccgctccgaatacactagcctgatcccgaacctgcgcaacgtggtcgcgctcgacactgaggttgcctctaacagaatctattggagcgacctttcacagcgcatgatctgttccactcagttggaccgggcccacggagtcagctcttacgatactgtcatctcgcgggatatccaggccccggacggactcgcggtggattggatccactcgaacatctattggacggattcggtgctggggaccgtctcggtggccgacaccaagggagtgaagagaaagaccttgtttcgcgagaatggctcgaagcctcgcgccatcgttgtggacccggtgcacggatttatgtactggacggactggggaactccggcgaagatcaaaaagggcggactgaatggtgtggatatctacagcctggtgactgaaaacatccagtggccgaacggtatcactctggatctcttgtcgggacggctttactgggtcgattccaagttgcattcgatttcgtccatcgacgtcaacggaggtaaccggaaaaccatactcgaggacgaaaaaagacttgcccacccgttctcactggccgtgtttgaggataaggtgttctggaccgacatcatcaacgaagccatcttctccgccaatcgcctgactgggagcgacgtgaacctgctggcggagaacctcttgagtccggaagatatggtgctgttccataacctgacgcaaccgcgcggagtcaactggtgtgagcgcaccactctctccaatggaggctgccagtacctgtgcctcccagcaccgcaaatcaatcctcattcgccgaaattcacctgtgcatgcccggacggtatgctgctggcccgggacatgcgctcgtgcctcactgaggcagaggcagctgttgctacccaggagacttccaccgtccgactcaaggtgtcatccactgcagtgaggacccagcacaccaccacccggcctgtcccggacacgtcgaggctgcccggagcgaccccgggtctgaccaccgtggaaatcgtgactatgtcccaccaggcgctgggagatgtggcaggtcgcggcaacgaaaagaagccttcctcggtgcgtgccctgagcattgtgctgcccatcgtgctcctcgtgtttttgtgcttgggagtgttccttctgtggaagaattggcgcctgaagaacatcaattcgatcaattttgacaacccagtgtaccaaaagacgacggaagatgaagtgcacatctgccacaaccaggacggatacagctacccttcccggcagatggtgtcgctggaggacgatgtcgca

SEQ ID NO: 676 - DNA, 2580 bp, Artificial Sequence
  Description of Artificial Sequence: Synthetic Transcript Sequence
atgggcccgtggggctggaagctgagatggaccgtggctctgctcctggcagccgcgggtactgcggtgggggaccgctgcgagagaaatgaatttcaatgccaagatggcaagtgtatctcgtacaagtgggtgtgcgatggatcggcggaatgtcaggacgggtcggatgaatcacaggaaacctgcctgtctgtgacctgcaaatccggagatttttcatgcgggggacgcgtgaaccgctgcatcccgcaattctggagatgtgacgggcaggtggactgcgacaacggaagcgatgagcagggttgcccgccaaagacctgctcgcaggatgaattccggtgccatgacgggaaatgtatctcacgccagttcgtgtgcgacagcgatagagattgcctcgacggcagcgatgaggcaagctgtcctgtgctgacttgcggaccggcctcattccagtgcaacagctccacctgcatccctcaattgtgggcctgcgacaatgacccagactgtgaagatggatcagacgaatggccgcaacgctgtagagggctgtacgtgtttcaaggagacagctccccatgctcggcgttcgaattccattgcctgtcgggagaatgcattcactcgtcgtggcggtgcgacggaggaccggactgcaaagacaaatcagacgaggaaaattgcgccgtcgcaacttgtcgcccagacgaattccaatgcagcgatggcaactgcattcatggctctcggcagtgcgaccgcgaatatgactgcaaggacatgagcgatgaagtgggctgcgtcaacgtgactctctgcgaaggaccgaataagtttaagtgccatagcggcgagtgtataactttggacaaggtctgcaacatggcccgcgactgccgagactggtctgacgagccgatcaaggagtgcggaactgcggcttgcttggacaacaatggcggatgcagtcacgtctgcaatgcgctgaaaataggcgcggagtgcctgtgtccggacggctttcagctcgtggcacagcgccgctgcgaagatatcgacgaatgtcaggatccggacacctgcagccagctttgcgtcaatctggaaggaggatacaagtgccagtgcgaggagggcttccagctggacccgcacactaaggcttgcaaagcagtaggatccattgcatacctcttctttaccaataggcatgaagtgcgaaagatgactctggatcggagcgaatacacctcccttatcccaaatctgcggaatgtggtggccctggacaccgaagtggcgagcaacagaatctattggagcgacctgtcgcagaggatgatctgcagcacccaattggatcgcgcccatggagtgtcctcgtacgataccgtgatcagccgcgatatccaggctccagatggattggctgtggactggatccactcgaacatttactggaccgactctgtgcttggcactgtgagtgtcgcggacaccaagggggtcaagcgcaagacgctgtttcgggagaatggaagcaagcctcgtgcgatcgtcgtggacccggtccacggttttatgtactggacggactggggaactccggccaagatcaaaaagggcgggctcaacggagtcgacatttactctctggtcactgagaatatccaatggccaaatggaatcactctcgatctgctgtcaggacggttgtactgggtcgattccaagctgcactcgatctcgtcaatcgatgtgaacggaggaaacagaaaaaccatcttggaggacgaaaaacgactggcccacccattcagcttggccgtctttgaggataaagtcttttggaccgatatcatcaacgaggccattttcagcgcgaaccgactcactggtagcgacgtgaacctccttgcggagaatctcctctcgcctgaggatatggtcctgtttcataatctgactcagccgcggggcgtgaattggtgtgagagaaccaccctttccaacggaggatgccagtacctgtgtctgcctgctccgcaaatcaatccacactcgcccaagtttacctgcgcctgtccggatggaatgttgcttgcgagggatatgcgctcatgcctgaccgaagcagaagccgcagtcgctacccaggaaacctccacggtccggttgaaggtgtcctcaactgccgtgaggacccagcacaccaccacgaggcctgtgccagacacctcccgccttccgggagctactcccggactgactaccgtggagattgtcaccatgtcccaccaggccctcggggatgtggctggtcggggaaacgagaaaaaaccttcctcagtgagagccctgtcgattgtcctccctattgtgctgctggtgttcctctgcctgggcgtgttcctgttgtggaaaaactggcgcctgaagaacatcaactccattaacttcgataaccccgtgtaccagaaaacgactgaggacgaagtgcatatttgccataaccaggatggctactcatacccgtcaagacaaatggtgagcctcgaggacgacgtggcc

SEQ ID NO: 677 - DNA, 2580 bp, Artificial Sequence
  Description of Artificial Sequence: Synthetic Transcript Sequence
atgggcccttggggatggaagctcagatggacagttgccttacttctggccgctgccggaactgccgtcggagacagatgcgaacggaacgaatttcagtgccaagatggcaaatgtatttcttacaagtgggtgtgtgatgggagcgcggaatgccaagatggctctgatgagtctcaggaaacctgcctgtcagttacctgcaaaagtggtgatttcagctgtggcgggagagttaataggtgtattccccaattttggaggtgcgatgggcaggttgattgcgacaacgggtctgacgagcaaggttgccctccgaagacctgtagtcaagacgaatttagatgccatgatgggaaatgcatatcccgacaatttgtttgcgatagcgaccgagactgcctggatggtagtgatgaagcttcttgccccgtcctcacctgcgggccagcatcctttcagtgtaatagtagtacctgtatccctcaactgtgggcatgcgataacgacccggactgcgaggacggtagtgacgagtggccccagagatgcagaggactctatgtgtttcagggagattcatccccctgcagtgcatttgaatttcactgcctgtcaggtgaatgcatccacagctcatggcggtgcgatggcggcccagattgtaaggacaagtccgacgaagaaaactgtgctgttgccacctgcagaccagacgaattccagtgctcggatgggaattgtatacacgggtccaggcaatgcgacagggagtatgactgcaaggatatgtctgacgaggtcggttgtgtgaatgtgacactgtgtgaggggccaaacaaattcaagtgccatagtggggagtgcatcacgttggacaaggtttgcaacatggccagggactgtagagactggtccgacgaaccaattaaagaatgtggaacggccgcttgtttggataacaatggagggtgctcacatgtgtgcaatgcacttaaaattggggccgagtgtctgtgccccgacgggttccaactagttgctcagcgcagatgcgaggacatagatgaatgccaggaccccgacacctgttcacagctgtgtgtaaacctggaaggaggctataagtgccagtgcgaggagggctttcagctggatccccacacgaaagcctgtaaggcagttggcagcatcgcttatctgttttttactaacagacacgaggtgagaaagatgactctcgacaggagcgaatacacttcattgatcccaaatttgcggaacgtagtggcactggatacggaggtagccagtaaccgaatctattggagcgacctctcccagcgaatgatttgtagtacccagcttgatagggctcacggcgtgtctagctacgataccgttattagcagagatattcaggcccccgatggcctagcagtagattggatccactccaatatttactggacagacagcgtcttgggaactgtatccgtggccgacacaaaaggagttaagcgaaaaacgttgtttagagagaacggatccaaacccagagccatcgtcgtggatcctgttcatggcttcatgtactggaccgactggggcacacccgccaagataaaaaagggaggtctgaatggcgtggacatttattctttagtcaccgagaacatccagtggcctaacggtatcactctggatttgctgtctggacgactctattgggtggattcaaagctgcatagtatctccagtatagatgtcaatggaggaaacagaaagacaatacttgaagatgagaagaggctggcgcacccattttccctggcagtcttcgaggacaaggtcttctggacagacattattaatgaggcgatattctcagcgaaccgactgacgggtagcgacgtgaaccttctcgcggagaacctcctgagcccggaagatatggtgctgttccataatttaacacaaccaaggggagtgaattggtgcgaacgtacaacactcagcaacggcggatgtcagtacctgtgtttacccgccccacagataaaccctcactcccccaaatttacgtgtgcctgccctgatggcatgctgctcgcccgtgacatgcgtagctgtctaaccgaagccgaggctgcagtggcgacccaagagaccagtaccgtcagactcaaagtctcctcgactgctgtccgaacacagcacacaactacccgaccagtgcctgatactagcagacttcccggcgccaccccaggcctcactacagttgaaatagtgacaatgagccatcaggcattgggggacgtagcaggacggggcaacgagaaaaaaccttcatcggtcagagctctatctattgtcttaccgatagtgcttctggtgttcctgtgccttggcgtatttctgctttggaaaaattggagactgaagaatataaactctatcaacttcgacaatccagtctatcagaaaaccaccgaagatgaggtgcacatttgccacaatcaggatggatacagttacccctccaggcaaatggtgtctcttgaggacgatgtcgcc

SEQ ID NO: 678 - DNA, 2580 bp, Artificial Sequence
  Description of Artificial Sequence: Synthetic Transcript Sequence
atggggccttggggatggaagctgcgatggaccgtcgccttgctgcttgccgccgccggcactgctgtaggagataggtgtgagcgaaatgaatttcaatgtcaggacggcaagtgcattagttataagtgggtctgcgatggaagcgcagagtgtcaagacgggtccgatgagtcccaggaaacttgtctctcagttacctgtaaatctggggactttagctgtggaggcagagtaaaccgctgtattcctcagttctggcgctgtgacggccaggttgattgcgataacggatccgacgagcaggggtgcccaccaaaaacctgctctcaggatgagttccgctgtcacgacggtaagtgcatatctaggcagtttgtatgtgattctgatagggactgtctggatggatcagatgaggcaagttgcccagttctcacctgcggaccagcttctttccagtgcaactcctcgacctgtataccccagttgtgggcctgcgacaatgatccagactgcgaggacggtagtgatgaatggccgcagcgatgtcgcggtctctacgtgttccaaggggactctagcccttgtagcgccttcgagttccattgccttagtggagaatgcatccactccagttggaggtgcgacggcgggccagattgcaaggataaatctgatgaagaaaattgtgccgtggccacctgcagacctgacgagtttcaatgctctgatggaaattgtatccatggcagcaggcagtgcgaccgtgaatatgattgcaaggacatgagtgatgaagtggggtgtgtgaacgtgaccttgtgtgaaggacccaacaagtttaaatgccattcaggagagtgtatcacgcttgataaggtgtgcaacatggcgcgggactgcagagactggtccgatgaaccaatcaaggagtgtgggacagcggcctgcctggacaataacggcgggtgctcacacgtgtgtaacgccttaaagataggtgctgaatgcctgtgtccggatggtttccaactggtggcccagcggaggtgcgaggatattgacgagtgccaggatcccgacacctgcagtcagttgtgcgtcaacctggaaggcggctataagtgccagtgcgaggaggggttccagttggacccacacacaaaagcttgcaaagctgttgggagtattgcctatctctttttcaccaatcgccatgaggtacggaagatgacactggacaggagcgaatacacgagtctgatcccaaatctgaggaatgtggtggcattggataccgaggtggccagcaatcggatctactggtctgatctgagccagcgcatgatttgttcgacacaactagatcgagcccacggtgtgagctcctacgacacagtgatcagcagggacatccaggcacccgatggacttgccgttgattggatccattctaatatttattggaccgattccgtgctaggcaccgtgagcgtcgcggacaccaaaggcgtgaaaaggaaaaccctgtttcgcgagaatggaagcaaaccacgggccatagtcgtggatcccgtacacggctttatgtattggactgactggggtacccccgccaaaatcaaaaagggaggcctgaatggtgtggacatttactctttggtgaccgagaatatccagtggccaaacggtattacactggatctgctgagcgggaggctgtattgggtagacagtaagctgcacagtatcagcagtattgatgtgaatggggggaacagaaagaccattctggaagacgaaaagaggcttgctcatccgtttagtctggctgtgtttgaagacaaggtgttttggactgatatcatcaacgaagccatcttttcagccaacagacttaccggcagcgacgtgaacctcttggccgagaacttactgagccctgaggatatggtgctattccataacctgacccaaccacgtggggtgaattggtgtgaacggacaactctgagcaatggagggtgccagtacctgtgcctccccgctccccaaattaatccccatagtcctaagttcacttgtgcctgccctgatggaatgcttctggctagagatatgcgctcctgtttgacggaagctgaggcagccgtagctacccaggaaacctctacagtgagacttaaggtgtcatccactgcagtgcgtacccagcacacaactactcgtcccgtgccagatactagcagactgcccggcgccacacctggtctcacaactgtagagattgtgactatgtcccatcaagccctcggtgacgtggcaggccgcggaaatgagaagaaaccctcttctgtgcgggcactctccattgttctgcccatcgtgctcctggtcttcctgtgcttgggcgtgttcctgttatggaagaactggcggctcaaaaacatcaactccataaattttgacaatcctgtgtatcaaaagactaccgaagatgaagttcacatctgccacaaccaggatggatactcatacccaagcagacaaatggtatctcttgaagatgatgtggcg

SEQ ID NO: 679 - DNA, 2580 bp, Artificial Sequence
  Description of Artificial Sequence: Synthetic Transcript Sequence
atgggtccctggggttggaagctgcggtggacggtggcccttctgcttgccgcagcaggaactgcagtgggtgataggtgtgagaggaatgagttccaatgccaggacggaaagtgtatctcgtacaagtgggtgtgcgacggttctgcagagtgtcaggatggctcggatgaatcgcaagagacttgtttgtccgtgacctgtaagtccggagatttcagctgtggtggtcgtgtgaaccgatgtattccacaattttggcgatgcgacggacaggtcgattgtgacaatggaagtgatgaacagggatgtccaccaaaaacctgctctcaagacgagttcagatgtcacgatgggaaatgcatatcaagacaatttgtgtgtgattcggatcgtgactgtctcgatggatcagacgaggcttcctgtcctgtcctcacttgtgggccagcctcgtttcaatgtaactcctcgacctgtattccacagctctgggcctgcgataacgaccccgattgcgaggacggcagcgacgagtggcctcaacggtgtaggggtctttacgtgtttcaaggtgactcctcaccatgctccgcctttgagtttcattgcctttcaggagaatgcattcactcaagctggcgctgtgacggaggacccgattgcaaggacaaatccgacgaagaaaactgtgccgtggcaacttgtcgccccgacgagtttcagtgtagcgacggtaattgtattcatggttcgcggcagtgtgatcgtgaatatgactgcaaggatatgtctgatgaagtgggatgtgtcaatgtgactctgtgcgaagggccaaacaagttcaaatgtcattccggggaatgtataactctggataaggtgtgcaacatggctcgggactgccgggattggtcggatgaacctatcaaggagtgcggtactgcggcatgtctcgacaacaacggaggctgtagtcacgtctgtaatgctcttaagataggagccgaatgcctttgtcctgatggattccaactggtcgcccaacgtaggtgtgaagatatcgatgagtgccaggaccccgatacttgttcccaactttgcgttaaccttgaaggaggatacaagtgtcagtgtgaagagggatttcaattggatcctcacaccaaggcttgtaaagcggtgggttccattgcgtaccttttctttaccaaccgccatgaggtgcgcaagatgacccttgaccgttccgaatacacttccctcatccctaacttgaggaatgtagtggccctggacacggaggtggcgtccaatcgcatttactggagcgatctttcacagagaatgatttgctccacccaactcgacagagcacatggagtctcctcgtacgatactgtgatttcgagagacattcaggcacctgacggcctggccgtggactggattcattccaacatctactggacggactctgtcctggggactgtctccgtggccgatacgaagggagtgaagcggaaaaccctctttcgtgaaaatggctcaaagccacgcgccattgttgtcgaccctgtccacggctttatgtactggaccgactggggtaccccggcaaagataaagaaaggcgggctgaatggcgtggatatctactcgctggtcactgaaaacatccagtggcctaacggaattaccttggatctgcttagcggacggctttactgggtggatagcaagctccattccattagtagcatcgatgtgaacgggggcaatcgtaagaccattttggaagatgagaagcgtcttgcgcatcctttcagccttgcagtgttcgaagataaagtgttttggaccgatatcataaatgaggcgatcttttcagcaaatagattgactggatcggatgtgaacctgctcgcagagaacctgctctcgccagaagatatggtgctgttccacaaccttacccagccgaggggcgtcaactggtgtgagcgtactaccctgtcgaacggaggctgccagtacttgtgtctgccagcaccccagattaaccctcattcaccaaaattcacttgtgcgtgccccgatggtatgctcttggctagagatatgaggtcatgtcttaccgaagcagaagcagcggtggccacccaagaaacctcaaccgtcagactgaaagtgtcctccaccgccgtgcgcacccagcatactactactagacctgtccccgatacctcacgccttcccggtgcgaccccaggattgaccactgtggaaatcgtgaccatgtcgcaccaagcgctgggtgatgtggcaggacggggaaatgaaaagaagccgtcctccgtgcgcgccttgagcatagtgcttccaattgtgctcctggtgtttctgtgccttggagtgtttctgctgtggaagaactggcgccttaagaatatcaatagcataaacttcgataacccagtctaccagaaaactacggaggacgaggttcacatctgtcataaccaggacggatactcatatccttcgcgacaaatggtgtccctggaggacgatgtcgct

SEQ ID NO: 680 - DNA, 2580 bp, Artificial Sequence
  Description of Artificial Sequence: Synthetic Transcript Sequence
atgggaccttggggttggaagctgaggtggactgttgctctcctgttggccgctgccggaaccgcggtgggcgaccgctgcgaaaggaacgagttccagtgccaggacggaaagtgtatcagctacaagtgggtctgcgacggatccgctgaatgccaggatggcagcgatgaatcgcaggagacttgtctctccgttacttgcaagtcgggagatttctcatgcggaggtcgggtgaatcggtgcataccgcaattttggcgctgcgacggacaggtggattgcgacaacggatctgatgaacaggggtgcccgccgaaaacttgcagccaggacgaattcagatgccatgacgggaagtgtatatcccgccaatttgtttgcgactcggaccgagactgcctcgatggctccgacgaggcctcctgtcccgtgttgacttgcggcccggcctcgttccagtgcaatagcagcacttgcattccacaactgtgggcgtgcgacaacgatcccgattgcgaggatggctcagatgaatggccgcaacggtgccgcggactctacgtttttcaaggggattccagcccttgctcagccttcgaattccactgcctgtccggggaatgcatccactcatcctggcggtgtgatgggggacctgactgcaaagataagtccgacgaggaaaattgtgcggtggcgacttgccggccggatgaattccagtgctcagacggtaactgcatccatggttcgcggcagtgcgaccgcgaatatgattgcaaggacatgtcagacgaggtcggttgtgtgaacgtgactctctgtgagggccctaacaaattcaagtgtcactcaggagagtgcattactcttgataaagtgtgcaacatggcacgcgattgtagagactggtccgacgagccgatcaaagagtgcggaaccgctgcttgccttgacaacaacggcggatgttcacatgtgtgtaatgctctgaaaattggggccgagtgcctctgtccagacggattccaattggtggctcagcggcgctgcgaagatatcgacgaatgccaggaccctgacacgtgctcgcaactgtgcgtgaacctggagggaggttacaaatgccagtgcgaagagggattccagctggatccgcatactaaagcctgcaaggccgtcggctcgatcgcctacctgttcttcaccaaccggcatgaggtccggaagatgactctggatcgctcagaatacacctctctcatcccgaatctgcgcaatgtcgttgcactcgacactgaggtggcaagcaatcgcatctactggtcagatttgtcacagcgcatgatctgctcaactcagctcgaccgggcgcacggagtgtccagctacgatacggtcatcagcagggatattcaggcacctgacggactcgccgtggactggatccactcaaatatctactggacggactcggtgctggggactgtgtcagtggcggataccaaaggcgtcaagcgcaagaccttgttccgcgaaaacggatccaagccgcgggctatcgtggtggacccggtgcacggctttatgtactggactgactgggggactccagcgaagatcaaaaagggcggactgaatggcgtggacatctactcgctggtgaccgagaacatccaatggcctaacggaataacgcttgatttgttgtcaggtcgcttgtactgggtcgactcgaagctccattccatctccagcatcgacgtcaatgggggcaatcggaaaaccattctcgaagatgaaaaacgcctggcccacccgttctcgctcgccgtgttcgaggacaaggtgttctggaccgatatcataaacgaggcaattttctccgccaacagactgaccggatctgatgtcaatctcctggcggaaaacctgttgtctccggaagatatggtcctcttccacaacctgacccaaccgcggggggtgaactggtgtgagcggacgactctgagcaacggtggctgccaatacctgtgccttccagccccacagatcaacccccattccccgaagtttacctgtgcctgcccagacggcatgctgctcgcgcgtgatatgcggagctgtctcactgaagccgaggcggcagtcgccactcaagagacttccactgtgcgcttgaaggtgtcgtccactgcggtgagaacgcagcacaccacgacccggcctgtccccgatacctcacgcctgccgggtgccactccaggcctgaccaccgtggaaatcgtcactatgtcccatcaggcactgggggacgtggcgggtcgaggaaacgagaaaaagccatcttcagtgcgcgctctgagtatcgtcctgccgatcgtgctgctggtctttttgtgcctgggagtgttcctgctgtggaagaactggcggctgaaaaacatcaattccatcaatttcgacaatccagtgtatcaaaagaccaccgaggacgaagtgcatatctgtcataaccaggacggatactcgtacccctcgcggcagatggtgtcactcgaagatgacgtggca

SEQ ID NO: 681 - DNA, 2580 bp, Artificial Sequence
  Description of Artificial Sequence: Synthetic Transcript Sequence
atgggtccttggggttggaaacttcgctggactgttgcactgctcttggcagcagccggcaccgccgtcggggatcggtgtgagagaaacgaattccagtgccaggacggcaagtgcatctcttacaaatgggtctgtgatggatcagccgaatgtcaagacggctccgatgagtcccaagagacttgcctttcggtcacttgtaaatccggtgatttttcatgcgggggtagagtgaatcgttgtataccgcaattttggcgctgtgatggacaggtggattgcgataacggatcggatgaacaagggtgtcctcctaagacctgtagtcaagatgaatttagatgtcatgacggcaagtgtatttcaaggcaatttgtgtgcgattccgaccgagattgtctggacggaagtgatgaagcctcatgtcccgtgctgacgtgcggcccggcatctttccaatgcaattcgtcgacttgcatcccccaattgtgggcatgtgataacgaccctgattgcgaggatggtagcgacgaatggcctcaacggtgtagaggcctgtatgtctttcagggcgactcatcgccctgttcggcctttgaatttcattgtctctcaggagagtgtatccactcctcatggcggtgcgatgggggacctgattgtaaggacaagtccgatgaggagaactgtgcagtggcaacctgtagacctgatgaatttcaatgctcggacgggaattgtatccacggctcaagacaatgtgacagagagtacgactgtaaggatatgtctgatgaagtgggatgcgtcaatgtcactctttgtgaaggaccaaacaagttcaaatgtcactccggagagtgtattaccctggataaggtctgtaacatggcaagggattgtcgagactggtccgatgaaccaataaaggaatgtgggactgccgcgtgtctggataacaacggcggttgttcacacgtgtgtaacgctctgaaaataggtgccgaatgtctctgtcctgatggttttcagcttgtggcccagagaagatgtgaggatatagatgaatgccaagatccggacacctgtagccagctttgtgtgaacctggaaggaggctacaagtgtcaatgtgaggaaggatttcagctcgatccacataccaaggcatgtaaggccgtgggaagcatcgcatacctgtttttcacgaatcgacacgaagtccgaaaaatgactcttgaccgctccgaatacaccagccttattcctaacctgagaaacgtggtggcactggacactgaggtggcatccaaccggatttactggtccgatctgagccagcggatgatctgttcaacccaacttgacagagcacatggtgtgtcatcgtacgatacggtgatttcgagggatatacaggcacctgacggattggccgtcgactggattcatagcaacatttactggactgattctgtgttgggaacggtgtcggtggcggataccaaaggcgtgaagagaaagaccttgtttagagagaatggtagcaagccacgagccatagtcgtcgaccccgtgcatggttttatgtactggaccgattggggcactcccgccaagattaagaagggcggccttaacggggtggatatctatagcctggtgactgaaaacattcaatggccaaacggcatcacccttgatctgctgtcaggacgcctgtactgggtcgatagcaaactgcacagcatttccagcattgacgtcaacggaggtaacagaaaaactatcctggaggacgagaagcgtttggcccatccattctcgctggccgtgtttgaagataaggtgttttggactgatatcatcaatgaggcaatcttctcggctaatagactgacgggaagcgatgtgaacctgcttgcggagaatcttttgtcaccagaagatatggtcctgtttcacaacctcactcaacctagaggagtcaattggtgtgaacgaaccaccctgtccaacggtggttgtcaatacctttgtctcccagctccacagattaacccacattcccccaagtttacttgtgcatgccccgatgggatgctgctggcgcgcgacatgcggtcatgccttactgaagcagaagcagctgtcgcaacccaggaaacttcgaccgtcaggcttaaggtgagctcaactgccgtgagaacccaacataccaccactcggcctgtgcccgatacgtcccggctgcccggtgcaacccctggactgactaccgtggaaatagtcactatgtcgcaccaagcactcggtgacgtcgcaggaaggggtaatgaaaagaagccttccagcgtgagagcactgagcatagtcttgccaatagtgctgctggtgtttctttgtctgggagtctttctcctctggaagaattggaggcttaagaacattaactcgattaacttcgacaatcctgtgtaccaaaaaaccaccgaggatgaggtccacatctgccacaaccaagacggctactcgtacccctcgagacagatggtgtccctggaagatgacgtggca

SEQ ID NO: 682 - DNA, 2580 bp, Artificial Sequence
  Description of Artificial Sequence: Synthetic Transcript Sequence
atggggccatgggggtggaagctcaggtggaccgtcgccctgctgctagctgcagctgggaccgccgtgggtgatagatgcgaaaggaatgagtttcagtgccaggatggcaaatgcatctcctacaagtgggtgtgtgacggctctgctgagtgccaagacggaagcgacgaatctcaggaaacctgcctatccgttacttgcaagtctggtgatttctcctgcggcgggcgcgttaaccgctgtatcccacaattctggcggtgtgatggccaggttgattgtgataacggcagcgacgaacaggggtgccctcctaagacctgctcccaggatgagttcagatgtcacgatggcaagtgtataagcaggcaattcgtgtgtgactctgatcgtgactgtttggatggatctgatgaggcctcttgcccagtgctaacctgtggacccgcttctttccagtgcaattcctctacctgcatcccccagctgtgggcttgcgataatgatccagattgcgaggacgggagcgacgaatggcctcagcgatgtaggggcctgtacgtgttccagggagattcctccccttgctctgctttcgagtttcattgtctgtctggggagtgcatacatagttcctggcgctgcgatggcggaccagattgcaaggacaagtccgacgaggagaattgcgctgttgctacctgccggcctgatgaattccaatgtagcgatggcaattgtatccatggaagtcgccagtgtgacagggagtacgactgcaaggatatgtctgatgaggtggggtgcgtgaacgtgacactgtgcgaaggccccaataagttcaaatgccattcaggcgagtgcattaccctggacaaagtgtgcaatatggcaagggactgccgtgactggagtgacgaacccatcaaggagtgcggcaccgctgcctgtctggacaacaacggcggatgtagtcacgtctgcaatgccctgaaaatcggcgccgagtgtctatgccccgatggatttcagttggtcgcacaaagacgatgcgaagacattgatgagtgtcaagatcctgatacctgcagccagctctgcgttaatctggaaggcggatacaagtgtcagtgcgaagagggcttccagctggatccccatacaaaggcctgcaaagccgtgggctccatcgcctacctgttctttacaaatcgacatgaagtgcgtaaaatgaccctggatcgcagtgagtatacctctttgatacctaacttacgtaatgtagtggctctggataccgaggtggccagtaatcgcatctactggagcgatctcagccaacggatgatttgttcaacccaactggatagagctcacggcgtctcatcttacgatactgtgatatcccgggacatccaggcacccgacggcctcgcagttgactggatccacagtaatatatactggaccgactcagtactgggtaccgtgtctgtggccgacacaaagggtgtgaaaaggaagactttattcagagaaaacggttctaaaccacgcgctattgtggtagatccagtgcatggcttcatgtactggaccgattggggcacccccgccaagatcaagaaaggcggcttaaatggcgtggacatttatagtctcgtgaccgagaacatacagtggcctaatgggattaccctagatttactaagcgggaggctgtactgggtggacagtaaactgcattccatctcttctattgacgtcaatggtgggaatcggaaaacaatacttgaagatgaaaagcggctggctcacccctttagcctggcagtttttgaagacaaggtcttttggaccgatatcatcaacgaagctatcttttctgcaaatcggctgaccggctctgacgtgaatttactggccgagaatctgttgtcccccgaagacatggtgctgtttcacaatcttactcagccccgtggtgttaactggtgtgagaggaccaccctcagcaatggcgggtgtcagtacctctgcctgcccgcacctcaaatcaaccctcattcaccaaagtttacctgcgcatgtcccgacggaatgctactggcaagagatatgcggagttgcctgactgaagccgaggctgctgtggccacccaggaaacctcaaccgtgcgcctgaaggtctcctccactgctgtgagaacacagcacactaccacccgtcccgtgccagataccagccgtctgcctggagccacccctgggttgactaccgtagaaatcgtgaccatgtcccatcaggccctgggcgacgttgccggccgcggcaatgagaagaaaccaagcagtgtgagagcactgtccattgttttacccattgtgctactagtgtttctgtgccttggcgtgtttttactttggaagaactggcgccttaagaacataaactctatcaatttcgataacccagtataccaaaaaaccaccgaagacgaggttcatatttgtcacaatcaggacgggtactcctaccccagccgacaaatggtttcactggaggacgatgtggct

SEQ ID NO: 683 - DNA, 2580 bp, Artificial Sequence
  Description of Artificial Sequence: Synthetic Transcript Sequence
atgggaccatggggatggaagctgaggtggaccgtggcattgctgctggccgccgccgggacggccgtgggtgacagatgcgagagaaacgaattccaatgccaggacggcaagtgcatcagctacaagtgggtgtgcgacggatccgcggaatgccaagatggatcggacgaatcccaagaaacttgtctgtccgtcacctgcaaatcgggagatttttcgtgcggcgggagggttaacagatgcatccctcagttttggcgttgcgacggacaggtcgattgcgacaatgggagcgacgaacaaggctgcccaccgaaaacctgcagtcaggacgagttcagatgccacgacggaaagtgcatctcgcgccagttcgtgtgtgacagcgaccgcgactgcctcgacgggtccgatgaggcgagctgtccagtccttacctgcggaccggcctcgttccagtgcaactccagtacgtgcattccccagctttgggcgtgtgacaacgaccctgactgtgaggacggctcggatgagtggccccagaggtgccggggcctctatgtctttcagggagattcgtcaccgtgttcggccttcgaattccattgtctgtcgggcgagtgcatccactcgtcgtggcggtgtgatggaggaccagactgcaaggataaatccgatgaagaaaactgcgccgtggcaacgtgtagacctgatgaatttcaatgtagcgatggaaactgtatccacggtagccgccaatgcgacagggagtacgattgtaaggacatgagcgatgaagtggggtgcgtgaatgtaaccctctgcgagggcccgaataagttcaagtgccatagcggggagtgtatcacgcttgacaaggtgtgcaacatggctcgcgactgccgtgactggtccgacgaaccaatcaaggaatgcggcaccgcagcatgcttggacaataacggaggttgcagccatgtgtgtaacgctctgaaaattggcgccgaatgcctttgtccggatggattccaactcgtcgcacagaggaggtgcgaagatatcgacgagtgccaagatcccgatacttgcagccagctctgcgtgaacctcgagggagggtataagtgccagtgtgaggagggttttcaactcgacccgcacactaaagcctgcaaggcagtgggatcgattgcgtacctgttcttcaccaatcgccatgaagtgagaaagatgactctggaccgctcagaatacacctcgctcattccgaatctgagaaatgtggtcgcgttggatacggaagtggccagcaataggatctactggtcagatttgtcgcaacgcatgatctgctccacccagctcgaccgggctcacggagtctcgtcatacgacaccgtgatcagccgcgatatccaggccccggatggcctcgccgtggactggatacactcgaatatctactggactgatagcgttctggggactgtctccgtggccgacactaaaggcgtgaagagaaagaccctgttccgcgagaatggctcgaagccacgcgccatcgtggtcgaccccgttcatggcttcatgtactggactgactgggggactcccgcgaagatcaagaaaggaggtctgaacggggtggacatttactctctggtgacggagaatatccaatggccgaacggcatcaccctcgatttgctgtcgggacggctgtactgggtcgactcgaaacttcactccatcagctcaatcgacgtgaacggaggcaacaggaaaacgatcctggaggacgaaaagcgcttggcacatcctttctcgctggccgtgtttgaagataaggtgttttggaccgacatcattaacgaggccatcttttccgcaaaccgcctgactggatcggacgtgaatctgctggccgaaaatctgctctccccggaagatatggtgctgttccacaatctgacgcaaccccgtggagtgaactggtgtgagcggactaccctgtcaaatggcggatgccagtacctgtgccttccagccccgcagatcaatcctcactcgccgaaattcacctgcgcttgtcctgacggaatgctgctggctcgcgacatgcggtcctgcctcaccgaagcagaagccgctgtggccacccaggagacttccaccgttcgactcaaggtatcgagcaccgcggtccgcacccaacacactactacgcggccagtgccggatactagcagactccctggggcgacgccaggattgactacggtggagattgtcaccatgtcccatcaagcactcggggacgtggctgggaggggtaacgaaaagaaaccatcaagcgtacgggcgctctcgatcgtgttgccgattgtgctcctggttttcctgtgccttggcgtctttctcctttggaaaaactggcggctcaagaacatcaactcaattaacttcgataacccggtgtaccagaaaaccactgaagatgaagttcatatctgccacaaccaggacggatactcttacccctcacggcaaatggtttcgttggaagatgacgtcgcg

SEQ ID NO: 684 - DNA, 2580 bp, Artificial Sequence
  Description of Artificial Sequence: Synthetic Transcript Sequence
atgggaccttggggttggaagctgaggtggaccgtcgccctgttgctggcagcagcaggcaccgcagtgggcgaccgatgtgaacggaacgagtttcaatgtcaagatgggaagtgcatttcctataagtgggtttgcgatggatcagcggagtgtcaggatggctccgacgaaagccaggaaacctgtctctccgtgacgtgtaaatccggtgactttagttgtggcggaagagtgaacaggtgtataccgcagttctggagatgcgatggacaggtggattgtgataacggaagtgatgaacagggatgcccacctaaaacctgttcccaagatgagtttagatgtcacgacgggaagtgtatttcccgtcagttcgtgtgtgactccgacagagattgtctcgatggaagcgacgaggcatcctgccctgttctcacttgcggcccggccagctttcagtgtaattcaagcacctgcattccccaactgtgggcgtgcgacaacgacccggattgtgaagatggaagcgatgaatggccgcaaagatgtcggggactctacgtctttcaaggcgattcaagcccatgctccgcatttgaattccactgtctgagcggcgaatgtattcattcctcatggcgctgcgacgggggacctgattgcaaggataagtcggacgaagaaaactgtgcagtcgcaacgtgtagaccagatgagtttcaatgctccgacggtaactgtatccatggttcccgtcaatgtgatcgcgaatacgattgtaaggacatgagcgatgaagtagggtgcgtgaatgtgaccctgtgtgaaggtccaaacaagtttaagtgccattcgggtgaatgtattacccttgataaagtgtgcaacatggctcgtgactgccgcgattggtcagatgaacctattaaggaatgtggaaccgcggcttgcctcgacaacaatggcggatgtagccacgtctgcaatgcgctgaaaatcggagcagaatgtctctgtcccgatggcttccagcttgtggcccaacgacggtgcgaggacatagatgagtgtcaagaccccgacacttgttcacagctgtgcgtgaacctcgaaggggggtacaagtgccagtgtgaagaagggtttcaactcgatcctcacaccaaggcgtgtaaggccgtcggttcaatcgcctacttgttctttactaaccgccatgaggtcagaaaaatgacccttgatagatccgaatacacttcacttatacccaaccttcgcaacgtggttgcactggatactgaagtggcatcgaaccggatctactggtccgacctgagtcaacgcatgatttgttcgacgcaactcgatcgagcacatggcgtttctagctacgacaccgtcattagccgcgatattcaggctcctgacggcctggcagtggattggattcattcgaacatttactggactgactcggtgcttggaactgtgtcggtggcagatactaagggtgtcaagcgaaagactttgtttcgggaaaacggatcaaagccgagggcaattgtcgttgacccagtccacggatttatgtactggacggattggggaactccagcaaagattaagaaaggtgggcttaatggagtggatatctactcactggtgaccgagaacatccagtggccgaacggtatcactcttgacctgctgtcgggccgtttgtattgggtggactccaaacttcactccatatcgtcaatcgacgtgaatggaggaaaccgtaaaactattttggaggatgagaagaggctggcacatccattttccctcgcagtatttgaagataaggtgttttggacggacatcattaacgaagctattttctctgcaaatcgacttaccggttccgatgtgaatctcttggccgaaaatcttctttcgccagaggatatggtgctgtttcataaccttacccagccccgcggggtcaattggtgtgagcgaaccaccctgtcaaacggcggctgccagtacctgtgccttcctgctcctcagatcaatccgcactctcctaaattcacctgtgcctgtcctgacggaatgttgctcgcccgagacatgagaagttgtctgaccgaggcggaggcagccgttgccactcaagagacttcaacggtccggctgaaagtctcgtcgactgcagtcagaacccaacatactactactcggcccgtgccagacactagccgcctccccggagcgacccctggacttactactgtggaaatcgtgactatgtcgcatcaggcgcttggagacgtggcggggagaggtaacgagaagaagccatcgtcagtccgcgcactcagcatcgtccttccaattgtgcttctggtgtttctttgtctcggcgtgtttctcctgtggaagaattggcgactgaagaatatcaactcgattaacttcgataacccagtgtaccagaaaaccaccgaagatgaagtccatatctgccataatcaagatggttacagctacccttcgagacaaatggtatctctcgaggatgacgtagcc

SEQ ID NO: 685 - DNA, 2580 bp, Artificial Sequence
  Description of Artificial Sequence: Synthetic Transcript Sequence
atgggaccgtggggatggaaacttagatggactgtggcactgctgcttgcagcggccggaaccgcagtgggtgaccgctgcgaaagaaacgagtttcaatgtcaagacgggaaatgtatttcgtacaaatgggtgtgcgacggctcggcagaatgtcaagatggtagcgacgagagccaagaaacctgtctttcagtgacttgtaagtccggtgacttttcgtgcggcggtagagtgaataggtgtatccctcagttttggcgttgtgatggacaagtcgattgtgataacggtagcgatgaacaaggctgccctccgaaaacttgtagccaggatgaatttcggtgtcatgatggcaaatgcatctcgaggcagttcgtctgtgattccgatcgagattgtcttgacggcagcgacgaggcctcctgtcccgtgcttacttgtgggccagcatcctttcagtgtaactcatccacttgcattccgcagctctgggcttgcgataacgacccagattgcgaggatggatccgatgaatggccacaaagatgtcgcggactttacgtgtttcagggggatagctcgccatgttccgcgtttgagttccattgtctgtcaggggaatgcatacactcgtcttggcggtgcgacggagggccagattgcaaggataagtctgatgaggaaaactgtgccgtcgcaacttgtcgtccagacgaattccagtgctccgacggaaattgtatccacggaagccgccaatgcgacagagagtacgactgtaaggatatgagcgacgaagtgggatgtgtcaatgtgaccctttgtgagggtccaaacaaattcaaatgtcactccggtgaatgtatcactctcgataaggtctgcaacatggcgagggattgccgggattggagcgacgaacccattaaggagtgcggtaccgcggcctgtcttgacaataatggtgggtgctcccatgtgtgcaacgctcttaagatcggtgctgaatgcttgtgtcctgatggcttccagcttgtcgcacaaagaaggtgtgaagatatcgatgaatgtcaggacccggacacctgtagccagctttgtgtgaaccttgagggcgggtacaagtgccaatgtgaagaaggattccagctcgacccgcacaccaaggcatgcaaggcagtgggttcaatcgcgtacctgttctttactaacagacacgaggtccggaagatgaccctcgaccgctcagagtacacctcactgatacctaacctgcgcaacgtggttgcactggatactgaagttgcatcgaaccggatctactggtcggatctgtcgcaacgcatgatttgctcgacccagctcgatcgcgcccacggtgtgagcagctacgataccgtgatttccagagacattcaggcacctgatggactcgccgtggattggatacattccaatatctactggaccgattcagtgcttggcactgtgagcgttgccgataccaagggtgtcaaaagaaagactctgtttcgggagaacggcagcaagcctagggcaattgtggtcgatccagtgcatggattcatgtactggactgattggggcactccagcgaagattaagaaaggagggctgaacggtgtcgatatctatagcctggtgactgagaacattcaatggcctaacggaattacccttgacttgctgtcaggtcgcctgtactgggtggattcgaagctgcattcaatttcgtccattgatgtcaatgggggcaacagaaagaccattctggaggatgaaaagcggcttgcccatccattctcgctggcagtgtttgaagataaggtgttctggactgacattatcaacgaagccatctttagcgccaaccgccttactggctcagatgtgaatttgcttgccgaaaacctcctgtccccagaagatatggtgctgtttcataacctgacccaacctcggggagtgaattggtgtgaaagaactacgctctcaaacggaggctgccaatacctttgtctccctgcgccacagattaatccacattcgcctaaattcacctgtgcctgtcctgacggaatgctcctcgcacgagatatgcggtcctgtcttacggaagcggaagcagcagtggcaacccaagaaacttcgactgtgcggcttaaggtgtcaagcaccgcagtccgaacccaacacactactacccgccccgtgccagacacctctaggctcccgggggctacccctgggcttaccaccgtcgaaatcgtcaccatgagccatcaggcccttggcgatgtcgcgggacgaggtaatgagaagaagccgtcctcggtgagagcgctttccattgtgcttcccatagtcctgttggtctttctttgtctgggcgtgtttctcttgtggaaaaactggcgcctcaaaaacattaactccattaactttgataatccagtgtaccaaaagactacggaagatgaagtgcatatttgccataatcaggacggttacagctacccgtcccggcagatggtcagccttgaggatgacgtcgcg

SEQ ID NO: 686 - DNA, 2580 bp, Artificial Sequence
  Description of Artificial Sequence: Synthetic Transcript Sequence
atgggtccctggggatggaaacttagatggaccgtggcacttctgctcgcagcagcgggtactgccgtgggagatcgctgtgaacgaaacgaattccagtgtcaagatggtaaatgtatttcttacaagtgggtgtgtgatggctccgccgaatgccaagacggatctgacgagtcgcaagaaacttgtctctccgtcacctgcaagagcggggactttagctgcggaggccgggtgaatcgatgcattcctcaattttggcggtgtgatggacaggtcgactgtgataatggttcggacgaacagggttgcccgcctaaaacgtgtagccaagatgagttcagatgtcatgatgggaaatgtatctcaagacaatttgtgtgtgactcagaccgggactgcctggacggatcggacgaggcatcgtgtcctgtgcttacgtgtggcccagcatccttccaatgtaattcctcgacctgtattccacaactgtgggcatgcgataacgatcctgactgtgaagatggaagcgatgaatggccgcagcggtgccgcggcctttacgtgttccaaggggattcatccccatgtagcgccttcgaatttcattgtctttcaggcgagtgtattcattcaagctggcggtgtgacggaggtcctgactgcaaggacaagtcggatgaggagaactgtgcggtggcaacctgccgaccagacgaattccaatgttccgacggaaactgtatccacggttcccgccagtgtgatagggaatacgattgtaaagatatgagcgacgaagttggatgcgttaacgtgactctttgtgaaggccctaataagtttaagtgccatagcggagaatgtattactctggataaggtgtgtaatatggccagagattgtcgcgactggagcgatgaacctataaaggaatgcggtacggcggcctgtctggacaacaatggtgggtgttctcatgtgtgtaacgccctcaagatcggagcagagtgtctctgccctgatggttttcagctggtggcacaaagacggtgcgaggatatcgacgaatgtcaagaccctgatacctgttcacaactttgcgtgaaccttgaggggggatacaaatgtcaatgtgaagaagggttccagcttgatccccatactaaagcatgtaaggcagtgggttcaatcgcatacctgtttttcaccaataggcatgaggtgcggaagatgacccttgaccgcagcgagtatacttcccttatccctaaccttcggaatgtggtggctctcgatacggaagtggcatctaaccggatttactggtcagatctgtcgcagcggatgatttgttcgactcaactggatagggcacacggggtgagctcctacgatactgttatttcccgcgatatccaggcccctgatggtcttgccgtcgattggattcatagcaatatctactggactgattccgtgcttggtaccgtctccgtggccgatactaagggggtgaagcggaaaaccctttttcgggaaaacggctcgaaaccacgcgctatcgtggtggatccagtccacggttttatgtactggactgactgggggaccccagccaagattaagaaaggaggattgaacggggtcgatatctactcgctggtcaccgaaaacattcaatggccaaatggaattaccttggatcttctgtccggacggctctactgggtggattctaaactgcattcgatatcatcgatagatgtgaatggcggtaatcgaaagactatcctggaagatgaaaagcgactggcacatcccttttcgctcgctgtgttcgaagataaggtgttttggactgatatcattaacgaggccattttcagcgccaacaggctcactggttcagacgttaaccttcttgccgagaatctcttgtcgcctgaggatatggtgctgtttcacaaccttacccagccacgcggtgtcaactggtgcgaaagaaccaccctgtcaaatggaggctgccagtatctttgcctgcctgcccctcagataaaccctcattcccctaagtttacgtgtgcctgcccagatgggatgttgctggcaagagatatgagatcgtgtctgactgaagcagaagctgcggtcgcgacccaggagacttcaactgtgcgactcaaggtgtccagcaccgcggtaaggactcaacataccaccacgcgacccgtcccggatacttcacgactgcccggcgcaactcctgggctgactaccgtggaaattgtgactatgtcccatcaggcgctgggggatgtcgcaggacggggcaacgaaaagaagccttcttcggtgagggcattgtccattgtgcttcctattgtccttcttgtctttctttgtctgggcgtgtttcttctttggaagaactggaggctgaaaaacattaactcgatcaatttcgataaccccgtgtaccaaaagaccactgaggatgaagtgcatatctgccataaccaggatggttactcgtacccaagccgacagatggtcagcctggaggatgacgtggcc

SEQ ID NO: 687 - DNA, 2580 bp, Artificial Sequence
  Description of Artificial Sequence: Synthetic Transcript Sequence
atgggaccttggggatggaaattaagatggacagttgctttattattagctgcagcaggtactgccgttggtgatagatgtgaacgtaacgaatttcagtgccaagatggtaaatgtatttcatataagtgggtttgtgatggatcagcagaatgtcaagatggatcagatgagtcacaagaaacttgtcttagtgtaacatgtaaatcaggagatttttcttgtggaggtcgtgttaatagatgtattccacaattttggagatgtgatggacaagttgattgtgataatggatctgatgaacaaggttgtccaccaaaaacatgtagccaagacgaattcagatgtcatgatggtaaatgtattagtagacaatttgtttgtgattctgatagagattgtcttgatggaagtgatgaagcaagttgtcctgttcttacttgtggacctgcaagttttcaatgtaattcttcaacatgtattccacaactttgggcatgtgacaatgatcctgattgtgaagacggatcagatgaatggccacaaagatgtagagggttatacgtctttcagggtgatagttcaccatgctcagcttttgaattccattgcttatcaggtgaatgtattcattcttcatggcgatgtgatggaggtccagattgtaaagataaatcagatgaagaaaactgtgctgtagctacatgtcgtccagatgaattccaatgtagtgatggaaattgtatccatggatcaagacaatgtgatagagaatatgattgtaaagacatgtcagatgaagtaggatgtgttaatgttacactttgtgaaggaccaaacaaatttaagtgtcatagtggagaatgtattactcttgataaagtatgtaatatggctagagattgtcgtgattggtccgatgaaccaattaaggaatgtgggacagcagcatgtttagataacaatggtgggtgttcacatgtctgtaatgctcttaaaattggtgccgaatgtctttgtccagatggattccaacttgtagctcagagaagatgtgaagatattgatgaatgtcaagatccagatacttgtagtcaactttgtgttaatcttgaaggaggatataaatgtcaatgtgaagaaggattccaattggatccacatactaaagcttgtaaggcagttggaagtattgcttatcttttttttactaatagacatgaagtaagaaaaatgacattagatcgttcagaatatacaagtttaattccaaatttaagaaatgtagtagcattagatactgaagttgcatcaaatagaatttattggtcagatctttcacaaagaatgatttgttcgacacaattagacagagcacatggagtttctagttatgatactgtaattagtagagatatacaagctccagatggattagcagttgattggattcattctaatatttattggactgactctgtattaggtactgtgagtgttgcagatactaaaggtgttaagagaaaaacattatttagagaaaatggaagtaaaccaagagcaattgtagtagatccagttcatggatttatgtattggacagattggggaactccagctaaaattaaaaaaggaggacttaatggagttgatatttattctttagttactgaaaatatacaatggccaaatggaattactttagatttactttcaggacgtttgtattgggttgattcaaagttgcattctattagttcaatagacgttaatggaggaaaccgtaaaacaattttagaggatgaaaaaagattagcacatccattttctttagcagtatttgaagataaagttttttggacagatattattaatgaagctattttctctgctaatcgattaactggatcagatgttaatcttttagcagaaaatcttttaagcccagaagatatggttttattccacaatcttacacaaccacgtggtgttaattggtgtgaacgaacaacattaagtaatggtggatgtcaatatttatgtttacctgcaccacaaattaacccacatagtcctaaatttacatgtgcatgtcctgatggtatgttacttgctagagatatgagatcatgtttgactgaagcagaagctgcagttgctactcaagaaacatccacagtcagacttaaagtctcaagtacagcagtgagaacacaacatacgactaccagaccagtaccagatacatcaagattgccaggtgcaacaccaggacttacaacagtagaaattgtaacaatgagtcatcaagctcttggagatgttgcagggagaggaaacgagaaaaagccttcaagtgtaagagcattaagcattgttcttcctatagttttacttgtttttctatgtttaggagtatttcttttatggaaaaattggagattaaagaatattaattcaattaattttgataacccagtatatcaaaaaactactgaagatgaagtccacatctgtcacaaccaagatggttattcatatccaagtagacaaatggtttcattagaagatgacgttgca

SEQ ID NO: 688 - DNA, 2580 bp, Artificial Sequence
  Description of Artificial Sequence: Synthetic Transcript Sequence
atggggccttggggatggaagctgcgctggacagtcgctctgctacttgctgctgctgggacagcagtcggagaccgatgtgaaaggaatgaatttcaatgccaggatggcaagtgcatatcgtataaatgggtgtgtgacggaagcgccgaatgtcaagacggcagtgatgagtcccaagagacctgcctgtcggtgacatgtaagagcggagattttagttgtggcggtcgtgtgaaccgctgcatcccccaattttggcgctgcgacggccaggtcgactgcgataacggatctgatgagcagggttgtccaccaaagacctgctcccaggatgaatttcgctgccacgatgggaagtgcatttcccggcagttcgtttgcgactctgatagagactgtctcgacggctcggacgaggcaagctgtcccgtgttaacatgcggaccagcctcctttcagtgtaactcaagcacatgtattccacaactctgggcctgcgacaatgatcccgactgcgaggatgggtccgatgaatggccacagcggtgccgaggactttatgtgttccagggagactctagcccctgcagcgctttcgagttccattgtctcagtggcgaatgcatacatagtagctggaggtgcgacgggggtcccgattgcaaagataagagcgatgaagagaattgtgccgttgccacttgtcgtcccgacgaatttcaatgctctgatgggaactgtatccacggtagccggcagtgtgacagagagtacgattgtaaggacatgagcgatgaggtcggttgcgtaaacgtgactctatgcgaaggacctaataaattcaaatgccattcaggggaatgtatcacactggataaagtgtgtaacatggcacgtgattgtagagattggtccgatgagcccattaaggagtgcgggaccgcagcctgcttggataataatggggggtgttctcacgtctgtaatgccctaaaaattggtgccgaatgcctctgccctgatggctttcagctggttgctcagcggaggtgtgaagatatcgacgagtgtcaggaccccgatacttgcagtcagttgtgcgtgaaccttgagggagggtacaaatgccagtgcgaggagggatttcagctcgacccccataccaaggcatgtaaggcagtgggcagcattgcttatctctttttcaccaacagacatgaagttcgcaagatgacactcgatcggtcggaatacacatctctgatccctaacctaaggaatgtcgtcgccttagacacagaggtggcaagtaaccggatttattggtcagacctttcgcaaagaatgatttgtagcacccagctggatcgggcccacggagtctcatcatacgacactgtcatctcacgagatattcaagcccccgatgggctggccgtggattggattcactccaatatttactggacagactccgttctgggtaccgtatccgtggcagacaccaaaggggtgaaacgcaagacgctgtttcgcgaaaacggatcaaagccgcgcgcaatagtggtagaccccgtgcacggatttatgtactggaccgactggggtaccccagcaaaaattaagaaaggcggactgaacggtgttgacatctatagtctcgtgaccgaaaacattcagtggcccaacgggattactctcgacctgcttagcggtcgcctctattgggtggacagtaaactgcactccatctcaagcatcgatgttaacggcgggaaccggaagactattctcgaggacgagaagcgtctggcccatcctttttccctggctgtgttcgaggataaggtgttctggacagatatcataaatgaagccatcttctctgccaatcggttgacaggatccgacgttaatctgttagccgaaaatttgctgtcacccgaggacatggtgctattccataatctcacgcagcctcgaggtgtaaactggtgtgagcggactacactgtcgaacgggggctgccaatatttgtgtctgccagctccacaaataaatcctcacagtcctaaattcacttgtgcatgtcccgacggaatgctcctcgcacgcgatatgaggtcgtgcttgacagaggccgaggctgctgtggccacacaggaaacttctacagtgcgcctcaaggtctcttccacggctgtgaggacgcaacacacgaccactcggccggtcccagatacctccaggctgcccggtgctacacctggcctgactaccgttgagattgttacgatgtcccaccaagccttgggcgacgtcgccggccggggaaatgagaagaagccctcttccgtccgcgcactgtctatcgtactccccatcgtgctcctggtgtttttgtgtcttggggtgtttctcctatggaaaaactggcgactcaagaatatcaattcgattaatttcgacaatccagtgtaccagaagacaacggaggacgaagttcatatatgtcacaatcaagatggatactcgtatccaagtcgccagatggtttctctggaggatgatgtggca

SEQ ID NO: 689 - DNA, 2580 bp, Artificial Sequence
  Description of Artificial Sequence: Synthetic Transcript Sequence
atgggcccatgggggtggaagctaaggtggacagttgcgctgttgctcgccgctgcaggaaccgctgtaggtgacaggtgtgaacgcaacgaattccagtgtcaggacggcaagtgcataagttataaatgggtgtgcgacggttctgccgagtgccaggacggctctgatgagtcccaagaaacatgcctgtccgtcacttgtaagagtggtgacttctcatgcggcggtagagtcaatcggtgtatcccccagttctggcgttgcgacgggcaggtggactgtgacaacgggagcgacgaacagggctgcccacctaagacctgttcccaggacgaatttagatgtcatgatggaaagtgtatctcccgccagtttgtttgcgatagtgaccgcgattgtcttgatggctctgacgaagcatcttgtccagtgctgacctgcggtccagcctccttccaatgcaattcatcaacatgcataccacaactgtgggcctgtgataacgacccagattgcgaagacggatccgatgaatggccccagcgctgtagaggtctgtatgttttccaaggagacagcagtccatgctccgcattcgagtttcattgcctttctggagaatgtattcacagcagttggaggtgcgacggcggacccgactgtaaggataagtctgacgaggagaattgtgcagtggccacctgccggcccgacgagtttcaatgttctgatggtaattgcattcacggctctaggcaatgtgaccgagaatatgactgtaaggacatgagtgacgaggtgggctgcgtgaatgtaacattatgtgagggacccaacaagttcaaatgccactccggtgaatgcattactttagacaaggtctgtaatatggcacgagattgcagagactggtccgatgaacctatcaaggagtgtggaaccgctgcatgccttgacaacaatggcggctgttcgcacgtgtgcaacgcactcaagatcggcgcagaatgtttgtgccccgatgggttccagctggttgcccagcgccggtgcgaggacatcgatgagtgccaggacccagacacatgcagccaactgtgcgtgaacctggaggggggatacaagtgtcaatgcgaggaaggtttccaactggacccgcacacaaaggcttgtaaagccgtgggatccattgcctacttgttctttacaaaccgtcatgaagtccggaaaatgacactcgatcgcagcgaatatacttctctaattcccaatttacgtaatgtcgtggcgctggacactgaggtcgccagcaatagaatatattggtctgatcttagtcagcggatgatctgcagcacccagttggaccgtgcccacggagtgtccagctatgatacagtcatctcacgcgacatccaggcacctgatggactggcagtagactggatacattccaacatttactggaccgacagcgtactgggcaccgtgtccgtggcagacacaaagggagtgaaaagaaagacactcttccgagaaaatgggagtaagcctcgggcgatcgtggtcgatccagttcacggattcatgtactggaccgactggggaacacccgctaaaataaagaaaggagggctgaacggtgttgacatatactctcttgtgaccgaaaacattcagtggcccaacgggattacactcgatctcctgagcgggcgactttactgggtggactccaaactgcatagcatttcttccattgatgtaaacggcggcaatagaaagacaatcctagaggatgagaaaaggcttgcccatccgttctctcttgcggtgtttgaggataaggtcttctggaccgacatcatcaatgaggccattttttcagcaaatcgcctgactggctcagacgtgaacctattagccgagaatctgctatcacctgaggatatggtgctcttccataatctgacgcaaccgcgcggagtgaattggtgtgaacgaaccactctgagcaatgggggttgtcaatacctgtgcctgcctgctcctcagattaaccctcattcccccaaattcacttgcgcctgtccagacggtatgctgctggcgagggatatgaggtcatgcttgacggaagctgaggcagcggtggcaactcaggagacgtccaccgtcaggctgaaggtgtctagcaccgcggtgagaactcagcatactactactagaccggtgcccgatacatcccgtctcccaggggctacgcctgggctaactacagtggagattgtcacaatgagccaccaggctctgggggacgttgccggcagggggaatgaaaagaaaccctcaagcgttagagcactttcaatcgtcttgcccatcgtattactggtctttctctgcctcggggtctttcttttgtggaaaaactggcggctgaagaatatcaactctataaacttcgacaatccagtatatcaaaaaactactgaggacgaggtacacatctgccacaaccaggacgggtattcctatccatccaggcagatggtgtctctcgaggacgatgtggcc

SEQ ID NO: 690 - DNA, 2580 bp, Artificial Sequence
  Description of Artificial Sequence: Synthetic Transcript Sequence
atggggccatggggatggaagctcagatggacagtagcgctcctgttggctgctgccggcacagccgtcggagatagatgcgagcggaatgagttccagtgccaggacggaaaatgcatttcctacaagtgggtctgtgacggttccgctgagtgtcaggacggaagtgacgagtcccaggagacttgccttagtgttacgtgcaaatctggggatttttcatgtggagggcgcgtgaaccgctgtatcccacaattctggagatgcgacgggcaagtggactgcgataacggttcagacgagcaggggtgccccccaaaaacctgttcccaggacgagttccggtgccacgacggtaagtgcatctccaggcagtttgtgtgtgatagcgatcgtgactgcctagacggatccgacgaagccagctgccccgtgctcacttgcggcccggcttctttccagtgcaatagcagcacctgcatcccccagttatgggcctgtgataacgatccagattgtgaggatggtagcgatgagtggcctcaacggtgtcgagggctttacgtttttcagggggacagtagcccttgctctgctttcgagtttcactgcttatcgggtgagtgcatccactccagttggagatgtgacgggggccctgactgcaaggataaaagcgacgaagagaattgcgccgtggctacctgtagaccagacgaatttcaatgtagcgatgggaattgcattcacgggagcaggcaatgtgatcgggaatacgactgcaaagatatgtccgatgaagttggctgcgtcaatgttacactgtgcgaggggccaaacaaattcaagtgtcattcaggagagtgcatcaccttggataaggtttgtaacatggcgagagattgtcgagattggagcgacgagcccattaaagaatgtggaaccgctgcctgcctggacaacaacggtgggtgctcgcatgtgtgcaacgctctgaaaataggcgctgaatgcctgtgcccagatggatttcagctggtggcccagcgcagatgcgaagacattgacgagtgccaagacccagatacatgttcccagctgtgtgtgaacttggaaggtggatacaagtgccagtgcgaggagggcttccagctggacccccatactaaagcctgcaaggccgtagggagtatcgcatatctcttcttcaccaacagacatgaggtaagaaagatgacactggacaggtcagagtacacctccctcataccaaatctgagaaacgtagtcgctctggataccgaggttgcctctaaccggatttattggagcgatctgtcccaaaggatgatctgcagtactcaattggaccgagcccacggagtttcttcttacgatacggtgatcagcagggacatccaagcccctgatggtctcgctgtggattggattcacagcaacatctactggacagattcagttttggggactgtgtctgtcgcagatactaagggggttaagcgcaaaacactgttccgcgagaacggatccaaaccacgcgctatagtggtggatcctgtccacggcttcatgtactggactgactggggaacacctgcgaagatcaagaagggaggccttaacggggtagacatttattctctggtgaccgagaatattcagtggcctaacggaattacattagacctcctgtcaggaagactgtactgggttgatagtaagctacacagcatctccagcattgatgtcaacggcggcaaccgtaagacaatcttggaagatgagaagaggctggcgcatcccttcagcctcgccgtgttcgaggacaaagtgttctggactgatattattaatgaggccatcttctccgccaatcggcttaccgggtcagacgtgaacttattggccgaaaacctgttgagccccgaagatatggttttgttccacaatctgactcaaccacgcggcgtcaactggtgcgagaggacgacactttccaatggcggatgccaatacctgtgcctgccggctccccagattaatccacatagcccaaagttcacttgcgcttgcccagacggcatgctattagcccgggacatgagaagttgcctgaccgaggccgaggccgccgtggccacacaggaaacatctaccgtacggctgaaagtatccagcacagccgtaaggactcagcatactactacacgacccgtccccgataccagcagactgccgggggctactcccggactgacgaccgtcgagatcgtgacgatgtcacaccaggctttgggtgacgtcgctggaagggggaacgagaagaaaccaagttctgtacgggctctttcaattgtactgcccatagtgctcctggtgttcctctgtttgggcgttttccttctgtggaagaattggcggctcaaaaacatcaacagcataaactttgacaatcctgtgtaccaaaagaccacagaggacgaggtgcacatctgccataaccaggacggctatagttatccctcgagacagatggtaagcttagaagatgacgtggcc

SEQ ID NO: 691 - DNA, 2580 bp, Artificial Sequence
  Description of Artificial Sequence: Synthetic Transcript Sequence
atgggcccttggggctggaagttacgttggaccgtggcactcctactcgccgcggccggcacagcagtgggagacaggtgcgaaaggaacgagttccagtgccaagatggaaaatgtataagctataaatgggtctgcgacgggtccgctgagtgccaggacggtagcgatgagagtcaggaaacttgtctgagcgtcacctgtaaatcgggtgacttttcatgcgggggccgagttaaccggtgcatacctcagttctggcggtgtgacgggcaggtcgactgtgataacggaagcgatgagcaaggatgccctcccaaaacctgctcacaggacgaatttcgttgccacgatggtaaatgcatatcacggcagttcgtctgcgactcggacagggactgtcttgacggcagcgacgaggcctcctgtccagtgctaacatgtgggccggcaagcttccagtgcaatagtagtacatgtattccccaactctgggcctgcgataatgaccctgactgtgaagatggatccgatgagtggccacagcggtgccggggactgtacgttttccagggagacagctctccatgttctgcttttgagtttcactgcctatcgggagaatgcattcatagctcctggcgatgtgacgggggaccagattgcaaagacaagtctgatgaagaaaactgtgccgtggctacgtgcagaccagatgagtttcaatgctccgatggcaactgcattcatgggagccggcagtgcgaccgcgaatacgattgcaaggatatgtctgacgaagtaggttgcgtgaacgttactttgtgtgaaggcccaaataaatttaaatgtcatagtggagaatgtataacactcgataaggtgtgcaacatggccagggactgcagagactggtccgacgagcccattaaagaatgtggaacagctgcctgcctagataataacggcggatgtagccatgtgtgcaacgctttgaaaataggcgccgaatgtctgtgcccggacggcttccagcttgtggcacagcggcgatgcgaggatattgatgagtgtcaggatcccgacacgtgttcacagctttgtgtcaacctggaaggaggttataagtgccagtgcgaggagggctttcaactcgaccctcacacaaaagcctgtaaggccgttgggtccatagcatatctgttcttcaccaaccgccacgaggtaagaaagatgacactggaccgcagtgaatacacttcgcttatcccaaatctgaggaatgtcgtggccctggacaccgaggtggcttctaaccgcatttactggtctgatttgagccagagaatgatctgcagtacccagcttgaccgggcgcacggagtgagcagctacgacaccgtaatttctcgagatatccaagcccctgatggccttgcggtggactggatccatagtaacatctattggacggattcggttttgggtacggtgtccgtggcggacaccaaaggcgtaaagcggaagaccttattcagggagaacgggagcaagcccagggctatcgtcgttgatccagtgcacgggttcatgtattggactgattggggaactcctgcaaaaatcaaaaaaggcggcctgaatggagtggacatctatagtctggtgacagagaatatccagtggcccaatggaattacgctcgacctgctgtctggacggctctactgggtggattccaagctgcactccatcagcagcattgacgtgaacggagggaatagaaagactatcttagaagatgaaaagcgcctcgctcaccccttctctcttgcggtcttcgaagataaggtattttggaccgacatcataaacgaggccattttctcagccaacagattaacgggcagcgatgtgaatctgctggccgagaacctcttaagccccgaggacatggtgctctttcataacctaacacagccccgcggggtcaactggtgcgaacgtactaccttaagcaacggcggatgtcagtacctatgcctgccggccccccaaatcaacccccattctcccaaattcacatgcgcatgcccagatggaatgctgctggccagggacatgcgttcatgcctgacagaagccgaggctgccgtggccacacaggagacttctacagtccgtttgaaggtttcctctaccgccgtgcgaactcaacatacaaccacacgacctgtgcctgacacctctcgcctgcctggggctaccccagggctgactactgtggagatcgtgaccatgtcacaccaggcattaggggatgtcgccggacgggggaacgaaaaaaagccaagctccgtgcgtgcactttcaatagtcctcccaatcgtcctgcttgttttcctttgtcttggcgtttttctgctttggaaaaactggcgtctgaaaaatatcaatagcataaatttcgataaccctgtgtaccagaagactacagaggatgaagttcacatctgtcacaaccaggacgggtatagctatcccagcaggcagatggtttctctcgaggatgatgtagcg

SEQ ID NO: 692 - DNA, 2580 bp, Artificial Sequence
  Description of Artificial Sequence: Synthetic Transcript Sequence
atgggaccatggggatggaagctgaggtggaccgtggcgcttctgctcgcggctgccggaactgcggtcggagatcgctgcgagcgcaatgaatttcagtgccaagacggtaagtgcatcagctataagtgggtttgtgacggaagtgctgaatgccaggatggttctgacgaatcgcaggaaacgtgcctttcagtcacctgcaagtccggtgacttcagctgcggtggccgagtgaatagatgtataccgcagttttggcgctgcgatggacaggtcgactgtgacaatggatccgacgaacaggggtgcccgccaaagacctgctcccaagacgaattccggtgccatgacggcaagtgtatctctcgacagttcgtgtgtgactcagatcgcgactgcctggatgggagtgatgaggcgtcctgcccggtcctcacctgcggaccagcctcattccaatgcaattcttccacctgcattccacaactgtgggcctgtgacaatgacccagattgcgaggacggaagcgacgagtggccgcaacgctgcaggggcctgtacgtctttcagggagacagcagcccgtgctcggctttcgaattccactgcctgtccggcgaatgcatccactcctcctggcggtgcgacggcggccccgactgcaaggacaagagcgatgaggagaattgcgctgttgccacttgtcgcccggacgagttccagtgctcggatgggaattgtatccacggttcgcgccaatgcgatcgcgaatacgattgcaaggatatgtcagacgaggtcggttgcgtcaacgtcaccctttgcgagggcccgaacaagttcaagtgccactcaggagaatgtataaccctggacaaggtctgtaacatggcccgtgattgtcgggactggtcggacgaacctatcaaggagtgtgggactgcagcgtgcttggacaacaacggagggtgctcccacgtgtgcaacgcattgaaaatcggcgctgaatgcctctgcccagacggattccaactggtggcccaacggcgctgcgaagatatcgatgaatgccaagacccggatacctgctcacagctctgtgtgaacctggaagggggctacaaatgccagtgtgaggagggctttcaactggacccccatactaaagcctgcaaagcagtgggatccatcgcgtacctcttctttaccaatcgccatgaagtcagaaagatgaccctcgacagatccgaatacacttctcttatcccgaacctcaggaacgtcgtggcccttgataccgaagtcgcttccaacagaatctactggtctgacctgtcacagcgcatgatctgtagcactcagctcgatcgcgcacatggtgtgagctcatacgacaccgtgatcagccgcgatattcaggccccggacgggttggcggtggattggatccattcgaatatctattggacggacagcgtgctgggaaccgtctcggtcgccgatacgaaaggtgtgaagcgcaagaccctcttcagagagaatggatcgaaaccgagagccatcgtcgtagatcccgtccatggatttatgtactggacggattggggaactcccgcaaagatcaaaaagggcggactgaacggagtggacatctactcccttgtcacggagaacatccagtggcctaacggaatcaccttggacctgctgagcggacgcctgtactgggtcgattcaaagctgcactcaatttcgtccatcgatgtcaacggagggaataggaaaaccatcctggaggacgagaagaggctggcgcacccattctcacttgccgtgttcgaggacaaggtgttctggactgacatcatcaacgaagccatcttctccgccaaccggttgacgggatcggatgtgaatctgctggccgagaacctgctgtcgcccgaggatatggtgttgttccataacctgacccagcctcggggcgtgaattggtgcgagcgcactaccctgtcaaacgggggatgccaatacctgtgcctccctgccccacagatcaatccacactcgccgaagtttacctgtgcgtgtccggatggcatgctgctggcccgggacatgagatcgtgcctgaccgaagcagaggccgcggttgccacccaggagacttcaactgtccgcttgaaggtgagctcgactgccgtgcggacgcagcacaccactactaggccggtgccggatacttcgcgcctgccaggggccacgcccgggctgaccaccgtggagattgtgactatgtcccatcaggcactcggagacgtggccggtagagggaatgagaaaaagcccagctccgttcgcgccctgtcgatcgtcctccctatcgtgcttcttgtctttctgtgccttggagttttcctcttgtggaagaactggagactcaaaaacataaactcgatcaactttgataacccggtttaccagaaaacgactgaggatgaggtgcacatctgccacaaccaggacgggtacagctacccatcgaggcaaatggtgagcttggaagatgacgtcgcc

SEQ ID NO: 693 - DNA, 2580 bp, Artificial Sequence
  Description of Artificial Sequence: Synthetic Transcript Sequence
atgggcccatgggggtggaagctccgatggacggtcgctctcctgcttgccgcagccggtacggcagtgggagatcggtgtgaacggaacgagtttcagtgtcaggatggaaaatgcatttcatataaatgggtttgcgacggtagcgccgagtgtcaggacggatcagatgagtcgcaggaaacatgcctttcggtaacatgcaagagcggagatttcagttgcggcggaagggtgaataggtgcataccgcagttctggaggtgtgatggccaggtggattgcgataacggcagtgatgagcaagggtgccctccgaagacatgctcccaggacgaatttcgatgtcacgatgggaaatgcatcagccggcagtttgtgtgcgacagtgacagggactgcctggacgggtctgacgaagccagctgccccgtattgacctgtggccccgcaagcttccaatgtaactcatccacatgcatcccacagttgtgggcctgcgacaatgatcctgactgtgaggacgggagcgacgaatggcctcagaggtgcaggggattatacgtctttcagggggattcatctccctgtagcgcctttgagtttcactgtctgagcggagagtgcatccattccagttggaggtgcgacgggggtcctgattgtaaagacaagagtgacgaggagaactgtgccgttgctacctgcaggcccgacgaatttcagtgctcagatggtaattgcatacacggttcaaggcaatgtgacagggaatacgactgcaaggatatgtccgatgaagtaggctgcgttaacgtgaccttatgtgagggacctaataaatttaagtgtcacagcggcgaatgtattaccctagataaggtctgtaatatggctcgagattgtcgggactggagcgatgagcccattaaagaatgcggcactgccgcgtgcctcgataataatggagggtgtagtcatgtatgtaacgcgctcaagatcggtgcagaatgtctctgccctgacggattccagcttgtggctcaacgtcggtgtgaggacatcgacgagtgtcaggatccggacacgtgtagccaactctgtgtgaacctcgaaggcggttataagtgtcagtgtgaagagggttttcagcttgacccccacactaaggcctgtaaagccgtcggtagcatcgcctacctgttctttacaaaccgccacgaggtgagaaaaatgacattggataggagcgagtacacttcactgatccccaacctgagaaacgttgtggcgctcgacactgaggtggccagcaaccgcatttattggagcgatctgtctcagcgtatgatatgctccactcagctggaccgagcacatggcgttagtagctatgacacggtgatatccagggatattcaggcccccgacggcctggccgtggattggattcactctaatatttattggactgattccgtcttggggaccgtctccgtggcagataccaaaggagtaaagaggaaaacgctgtttcgcgagaacggatcgaaaccgcgggctatcgtggtcgatcctgtgcatgggttcatgtactggacagactggggaacacccgcaaaaattaagaaaggcggtctgaacggtgtcgacatctacagcctagtgaccgagaacatccagtggccaaacggaataacattagatttgttgagtggccgattgtactgggtggactccaaattgcactccatctcatccatagacgttaatgggggcaacaggaaaacaatattagaggatgaaaagaggctcgcacaccccttcagcttagccgttttcgaagacaaggtattttggaccgatataataaacgaagccatctttagtgctaatcgccttaccggctccgatgttaacctcttggcagaaaacctgctgagccctgaggacatggtactgttccataacctgactcagcccagaggagtaaactggtgtgagcggacaaccttgtccaacggagggtgccagtatctgtgcttgccagctccccagattaatccacatagtcctaagttcacctgtgcctgtcctgatggcatgctcttggccagagatatgcggagctgtctcacagaagcagaggcagcggtcgccactcaggagacctccaccgtgcgcctgaaggtctccagcaccgcagtcaggactcagcacactacaactaggcctgttcctgatacttcccggctgccaggtgcgacgcctggccttacaaccgtcgagattgttacaatgtctcatcaggccttgggcgacgtggctggtagaggcaacgagaagaagcctagttcagtccgtgccctatcaatcgtgctacctatagtgctgctggtgttcctgtgcctaggtgttttccttctctggaagaactggcggctcaagaatatcaactctatcaattttgacaacccagtgtaccagaaaaccactgaggatgaagtgcacatttgccacaatcaggatgggtacagttatcccagtagacaaatggtgtcactcgaggatgatgtggca

SEQ ID NO: 694 - DNA, 2580 bp, Artificial Sequence
  Description of Artificial Sequence: Synthetic Transcript Sequence
atgggcccttgggggtggaagctgcgatggaccgtagccctgctactggcggcggccggcaccgccgttggcgaccggtgtgagcggaacgaattccagtgtcaggatggtaaatgcatttcatacaagtgggtgtgcgatggttccgctgaatgtcaagacggcagtgatgagagccaggagacctgcctctctgtgacttgcaaatctggcgacttcagctgcggcggaagagtgaatcgctgcatcccccagttttggagatgtgatgggcaggtggactgtgacaacggaagcgatgagcagggttgcccgccaaaaacttgttcccaagatgaattccgatgtcatgacggcaaatgcatttcacgacagtttgtctgcgacagtgacagagattgtctcgatggttctgacgaggctagttgtccagtcctcacctgcgggcctgcatctttccagtgtaattctagcacctgcatcccccaactgtgggcctgcgataatgaccccgactgcgaggatgggtcggacgagtggccgcagcggtgcagagggctgtatgtgttccagggggacagtagtccttgttccgctttcgagttccactgtctgtctggcgagtgcatccacagttcttggagatgcgacggagggcctgattgtaaggataagagtgatgaggagaactgtgccgtcgcaacgtgtcggcccgacgaattccagtgtagcgatggtaattgtattcacggaagtcgccagtgtgatcgcgagtacgattgtaaggatatgtccgatgaggtcggctgcgtgaacgtcactctttgtgaaggtccgaataagtttaagtgtcactcgggagagtgcatcacccttgacaaagtttgtaacatggccagagactgtagagactggtcagacgagccgataaaggaatgtggcactgccgcctgtctcgataacaacggcggatgctcgcacgtgtgcaatgcactgaagattggagccgagtgtctgtgtccagacggcttccagctggtggcacagaggaggtgtgaggacatcgatgagtgccaggatcctgacacgtgttcacagctttgcgtgaacctggagggagggtataagtgtcagtgcgaagagggctttcagctagatccacatacaaaggcatgtaaagctgtcggtagtatcgcgtaccttttttttacaaataggcacgaggtgaggaaaatgactttggacaggtccgaatatacatcacttatccccaatctgcgcaacgtggtggccctggacacagaggtggcatctaacagaatctattggtcagacctatcacaacggatgatttgttctacccagttggatcgagcccatggagtttcatcatatgataccgtgatttcccgggatatacaggctcccgatggcctggccgtggattggatacactcaaatatctactggacagatagcgtccttgggacagttagtgtagccgatacaaaaggcgtgaaacgaaagacactttttagagaaaacggatctaaacctcgcgccattgtcgtggaccctgtgcacggctttatgtattggacggattggggcacccccgcaaagattaaaaaaggaggtctgaatggcgtcgacatttacagtctggtgacggaaaacattcagtggcccaacgggatcactctggacctgttgagcggccggttatactgggtagatagcaagctccactcaatttcatctatcgacgttaatggtgggaataggaagaccattttggaggatgagaaacgattggcacaccccttcagccttgctgtgttcgaggataaagtcttctggacagatataattaacgaggccatcttcagtgctaataggttaaccggcagcgatgttaacttgctagcggagaaccttttgagcccagaggatatggttctcttccataacctcacccagccacgtggggttaactggtgcgagcgcacaacgctgagcaatggaggctgccagtacctgtgcttgccggccccacagatcaacccccactcccccaaatttacctgtgcgtgccccgatggcatgttgctggcaagagacatgcgctcctgtctaacagaggctgaggccgctgtggctacacaggaaaccagcactgtacggctgaaagtgtcgagcacagctgttcgtacccaacataccacaaccagacctgttcccgacacctcacggctgcctggggctacacctgggctcactactgtggagattgtgacaatgtcacatcaggccctgggcgatgttgctggacgtggcaatgagaagaagccgtcatcagtcagagctctctccattgtactccccatcgtactactcgtgttcttgtgcctgggcgtttttttgctttggaagaactggcgcctcaaaaacatcaactctatcaactttgataatcctgtttaccagaagacaaccgaggacgaagtgcacatttgccataaccaggatggttattcctaccctagtcgtcagatggtgtcactggaggatgacgtggct

SEQ ID NO: 695 - DNA, 2580 bp, Artificial Sequence
  Description of Artificial Sequence: Synthetic Transcript Sequence
atgggcccgtggggatggaaattgcgctggaccgtggcgcttctcctcgcagccgctggaactgccgtgggcgatcgctgcgaacgcaatgaatttcagtgtcaagacggaaagtgcatctcctacaaatgggtctgcgatggtagcgcggagtgccaggatggatctgacgagagccaagaaacctgcctcagcgttacttgtaagtcaggagacttcagttgcgggggacgggtgaaccgctgcatcccgcagttctggcgctgcgacggacaagtggactgcgacaatggaagcgatgagcagggatgccccccaaagacctgttcgcaggacgaattcagatgtcacgatggtaaatgtatctcccggcagttcgtgtgcgattcggaccgggactgcctggatggctcggacgaagcatcctgcccggtgcttacctgcggcccagcctcgttccagtgtaactcgtccacctgtattcctcaactgtgggcatgcgacaacgaccctgattgcgaggacggctcagacgaatggccgcagcgttgtaggggactgtacgtgttccagggcgacagctccccatgttccgccttcgaattccattgcctgtcgggtgaatgcatccactctagctggcggtgtgacggtggacctgattgcaaggacaagtccgatgaagagaactgcgcggtcgccacgtgcaggccggacgagtttcaatgctccgacgggaactgcattcacggatccaggcaatgcgaccgggagtacgactgcaaggatatgtcggatgaagtgggatgtgtgaacgtcaccttgtgcgaaggaccaaataagttcaagtgccactccggggaatgcatcactctcgacaaggtttgtaacatggcccgggattgccgggactggtcagatgaaccgataaaagagtgcggcacggctgcctgcctcgataacaacggtggttgctcgcatgtgtgcaatgccctgaagattggagccgaatgcttgtgcccggacggattccagctcgtggctcagagaagatgcgaggacatcgatgaatgtcaggacccagatacttgctcccaactgtgtgtgaacctggagggcggatacaagtgccaatgcgaggagggattccaactcgatcctcatactaaagcctgcaaggcggtcgggtccatcgcgtacctcttctttaccaatcggcacgaagtgaggaagatgacgctggatcgcagcgagtacacttcactcatccccaacctgagaaatgtggtggccttggataccgaagtcgcatcgaaccgcatctactggtccgatctgtcccagcgcatgatctgctcgacccaactggaccgggcacacggcgtgagctcgtacgacacggtgatctcccgtgatatccaagcccctgacggactggcagtcgattggattcactctaatatctattggacggactcagtgctgggaaccgtctccgtcgccgacactaaaggcgtgaagcgcaagaccctgttcagagaaaacggctcgaaaccgagggccattgtggtcgacccggtccacgggttcatgtattggaccgattggggtactccagcaaagatcaaaaagggaggacttaatggggtggacatctactcgctggtcactgaaaacatccagtggcctaacggaatcactttggacctcctctcagggcggctgtactgggtggattcaaagctccattcgatctcaagcatcgacgttaacggagggaatagaaaaacgatcctggaggatgagaaacggttggcccatccatttagcctggccgtgtttgaagataaggtgttctggaccgacatcatcaatgaggctatcttcagcgcaaacagactcaccggtagcgacgtgaacctgttggcggagaacctgctgtcacctgaagatatggtgctgttccacaacctgactcagccccgcggagtgaattggtgcgaacggactaccctcagtaatggcggatgccaatacctttgcctgccggctccacaaatcaacccccactcgccaaagttcacctgtgcttgtccggatggcatgcttttggctcgcgacatgcgatcctgtctgactgaagccgaggctgcggtggcgacccaggaaacttcaactgtccgcctgaaggtgtcaagcaccgcagtgagaactcagcataccactacccggccggtgccagacacctcgcgcctgcccggggcgacccctggcctgactactgtcgagatcgtcaccatgtcccatcaggccctgggagatgtcgctggccgaggaaacgaaaagaagccgtcgtcagtgcgcgcgctttcgatcgtgctcccgatcgtcctgctcgtgtttctgtgtctcggtgtatttcttctgtggaagaattggcgcctcaagaacattaattcgatcaacttcgacaacccggtgtaccagaaaactaccgaggacgaagtgcatatttgccacaatcaggacggatactcatacccgagcagacagatggtttccctggaggacgacgtcgcg

SEQ ID NO: 696 - DNA, 2580 bp, Artificial Sequence
  Description of Artificial Sequence: Synthetic Transcript Sequence
atgggcccgtggggctggaagctgcgctggaccgtcgctctgctgctggccgctgccggcaccgctgtgggtgatcgctgcgagcgcaacgagttccagtgccaagacggtaagtgtatctcctataagtgggtctgcgacggttccgcggaatgccaggacggtagtgacgagtctcaggagacctgtttgtccgtcacgtgtaagagcggcgacttcagttgcgggggtcgcgtcaaccggtgcatcccccagttctggaggtgcgacggtcaggtcgattgtgataatggatccgatgagcagggttgtccacccaaaacctgctcgcaggacgagttccgctgccacgacggcaagtgtatctctcgtcagttcgtctgcgacagcgaccgcgactgtctggacggctccgacgaggctagctgcccagtcctaacatgcggtccggcgtccttccagtgcaattcctcgacttgcatcccccagctttgggcatgtgataatgatcctgactgcgaagatggatcggacgaatggccgcaacggtgcagaggtctgtacgttttccagggtgacagttccccctgttccgccttcgaattccattgtttgagcggggagtgtatccatagctcttggcgttgcgacggaggccctgactgcaaggataagtctgacgaggaaaactgtgctgtggccacgtgcaggcccgacgagttccagtgctcagatggtaactgtatccacggttcccgtcagtgcgatcgtgagtacgattgcaaggatatgtctgatgaggtcggttgtgttaacgtgacattgtgcgaggggcctaacaagttcaaatgtcatagtggcgagtgtatcaccctggacaaggtctgcaacatggcccgagactgtagagattggtccgacgagccgattaaggagtgcggcaccgcggcctgcttggacaacaacggcggttgttcgcacgtgtgtaacgccctgaagatcggtgctgagtgcctctgcccggacggtttccagttggtcgcccagcggcggtgcgaagatatcgacgagtgtcaagatcccgacacttgctcgcaactctgtgtcaatttagagggcggctacaagtgccagtgcgaggagggcttccagctggaccctcacactaaggcctgtaaagcggtcggttccatcgcctatctgttttttaccaaccggcatgaggtccgcaagatgactttggaccgctcggagtacaccagcctcattcccaacttgcgcaacgtcgtggccctggacacggaggttgcctcgaataggatctattggtcggatctttcacagcgaatgatctgttcaacccagttagacagggcccacggtgtatcgtcctatgatacggtcatcagccgggatatccaggcgcctgatggcttggctgtggattggatccattctaacatctattggacggactcggttttgggcactgtttccgtcgcggatactaagggcgttaagcgcaagacgctcttccgggagaatggaagtaagcctagggctatcgttgtcgacccggtgcacggctttatgtactggacagattgggggacccccgccaagataaaaaagggaggcttgaatggagttgatatatactccctcgttaccgaaaatatccagtggcctaatggaataacccttgatcttctgtcagggcgcctgtactgggtcgactcgaagctgcacagcattagctcaatcgacgtcaacggcggaaaccgtaagaccatcctcgaggatgagaagcgtctcgcccatcccttctccttggccgtgttcgaggacaaagtcttttggaccgatattattaacgaggctatcttctccgccaaccgtttgaccggcagtgacgtgaatctgttggccgagaatttgctctcccccgaggacatggttcttttccacaacctgacgcaacctcgtggagtcaattggtgcgagcggaccactctttccaacgggggctgccagtacctgtgcctgccggcgcctcagatcaacccgcactcccctaaattcacttgcgcttgccccgacggcatgttgctggcccgcgatatgcgttcttgtttgacggaagccgaagccgctgttgccacacaggagacctccaccgtccgccttaaggtctcgagcactgctgtccgcacccagcacactaccacgcgacctgtccctgacacgagtcgcctcccgggtgctacaccgggcttaactacggtcgagatcgtgaccatgagccatcaggctctgggagacgtggctggacgcggtaatgagaagaagccatcttcagtccgcgctctctctatcgttctgcccattgtcctgctggtctttctgtgccttggcgtcttcctattgtggaagaattggaggctcaagaacatcaacagtatcaacttcgacaaccccgtctatcagaagactaccgaagatgaggtccatatttgccacaaccaggatggttactcgtatccgtcccgccagatggtctctctggaggatgatgtggcc

SEQ ID NO: 697 - DNA, 2580 bp, Artificial Sequence
  Description of Artificial Sequence: Synthetic Transcript Sequence
atgggaccttggggatggaaactcagatggactgtcgcactcctgcttgcagcagctggcaccgcggtgggagatagatgtgaacgcaacgaatttcagtgtcaggacggtaagtgtatttcgtataagtgggtctgtgatggatcggcagagtgccaggatggtagtgacgaatcgcaagaaacttgcctgtctgtcacctgtaagtccggagatttttcgtgtggtgggcgggtgaatagatgcataccacaattttggagatgcgatggtcaagttgattgtgataacggttccgatgaacagggatgcccaccaaaaacttgttcacaagacgagtttagatgtcatgatgggaagtgcatcagtagacaatttgtgtgtgactccgatcgagattgcctcgatggatccgacgaggcctcctgcccagtgttgacttgtgggccagcgagctttcaatgtaattcttccacttgcattccgcagctttgggcttgcgacaatgacccggattgtgaagatgggtctgatgaatggccccaacgatgtaggggtctgtacgtttttcagggagattcatcaccgtgttcggcctttgagttccactgtctttcaggcgaatgtatccacagcagctggcgctgtgatggcgggccagattgcaaagacaagtcagacgaagagaattgtgccgtggcgacctgtcggcccgatgaattccaatgttccgatggaaattgtatccatggtagcagacaatgtgacagagagtacgattgtaaggatatgagtgatgaagtcgggtgtgtcaacgtcaccctctgtgagggcccaaataagtttaagtgtcattcaggcgagtgtataactctcgataaggtctgcaatatggcccgggattgccgcgactggtcggacgagcctatcaaggaatgtggaactgcagcctgcctggacaataacggaggttgtagccacgtgtgtaacgcgcttaagattggtgccgaatgcctttgtccggacggcttccaactggtcgcacagagacgatgtgaggacattgacgaatgtcaagatcctgatacctgttcccagctgtgcgtaaatcttgaaggtggatacaagtgtcagtgtgaagagggatttcagctcgaccctcatacgaaggcatgcaaggcggtcgggtcgattgcatacctgtttttcaccaaccgccatgaggttcgaaagatgactctggacagatcggaatacacttctctgatcccaaaccttcgaaacgtggtggcacttgatactgaagtggcttccaatcgaatatactggtcggacctgagccaaaggatgatttgctcaacccagctggatagggctcatggggtgagctcatacgataccgtgatctcccgggacatccaagcacccgacggacttgccgtggattggattcattcgaacatatactggacggattccgttcttggtaccgtgtccgtggcagataccaagggtgtgaaaagaaaaactctgtttcgggagaatggctcgaagcctcgcgctatagtggtcgatccagtgcatggatttatgtactggaccgactggggaactccagcaaagattaagaagggcggcctgaacggtgtggatatctattcccttgttactgagaacattcagtggcctaacgggattactctcgatctcttgagcggacgtctgtactgggtggatagcaaactgcattccatttcgtcgattgacgttaacggcggaaacagaaaaactatcctggaggatgagaaacgtttggcccaccctttttcgctggcagtgttcgaggataaagtgttctggaccgatatcatcaatgaagcgattttctctgcaaacaggctcaccggcagtgatgtgaaccttttggcagaaaacctgctctcccctgaagatatggtcctttttcataacttgacccagcctcgaggtgtgaactggtgcgaacggactactctttcaaacggtggatgccaatacctgtgtttgcccgcaccacagattaacccacactcgcccaagttcacctgtgcatgcccagacggaatgcttcttgcacgcgacatgcgttcgtgcctgactgaagccgaagccgcagtggccacccaagaaaccagcacggtgagacttaaggtttcgagcactgcagtccgcacccaacataccaccacgaggccggtccctgatacctcgagactgcctggagcaacccccggactgacgaccgtggagatcgtcacgatgagccaccaggccctcggtgacgtggcaggacggggaaatgaaaagaaaccctcgagcgtgcgggcattgagcatcgtgcttcctattgtcctcttggtgttcctctgtctgggagtgttcttgctttggaaaaactggaggcttaagaatatcaacagtattaactttgacaatcctgtttaccaaaaaacgaccgaagatgaagtacacatttgccataatcaagacgggtacagctaccctagcaggcagatggtgtctctcgaagatgacgtggcg

SEQ ID NO: 698 - DNA, 2580 bp, Artificial Sequence
  Description of Artificial Sequence: Synthetic Transcript Sequence
atgggtccctgggggtggaaactgcgctggaccgtggcattgcttttggccgctgccggaaccgcagttggcgacagatgcgaaagaaacgagtttcagtgccaggatggtaagtgtataagttacaagtgggtttgcgatggatccgcagagtgccaggacgggtcagacgagtctcaagaaacctgcctgtccgtcacgtgtaaatccggtgacttttcttgcggtggacgagtgaatagatgtataccccagttctggagatgtgacggtcaggtggattgtgataacggcagtgatgagcaaggctgccccccgaagacatgttcccaagacgaattccgctgtcatgacgggaagtgcatatctaggcaatttgtttgtgacagcgacagagattgcttggacggaagtgacgaggcctcatgccctgtgctgacatgcggtcccgcaagcttccagtgtaacagtagcacatgcatccctcagctgtgggcctgtgataatgaccccgattgtgaagacggctccgatgagtggcctcaacgatgtcgcgggctgtatgtgtttcagggcgactcctccccttgcagcgcgtttgagttccattgtctctcaggggagtgcatacacagttcttggagatgcgatggcggccccgactgtaaagacaaaagcgacgaggagaactgcgccgttgcaacttgcaggcctgatgaattccaatgtagtgacggcaattgtatacatggatccaggcagtgcgaccgggagtacgattgcaaagatatgtcagacgaagtgggctgcgtgaatgtgaccctgtgcgagggacccaataagtttaagtgccattccggagaatgcatcacactggacaaagtttgcaatatggcaagagactgtagagattggagcgacgagcccataaaggaatgcgggaccgccgcttgtcttgataacaatggtgggtgttcacatgtgtgcaacgctctgaagatcggggctgaatgcctttgccccgacggattccagttggtcgcacagcgacgctgcgaggacatcgatgaatgccaagatcccgatacttgctcacagctctgcgtgaatcttgagggcggctataaatgtcagtgcgaggagggattccagctggaccctcatacaaaagcatgcaaggctgtaggttctatcgcctacctctttttcacgaatcgccacgaggtgcgcaaaatgaccctggatcgctccgagtataccagccttattcctaatcttcgcaacgttgttgctctggatactgaagtggcctcaaacaggatttactggtccgaccttagtcagcggatgatctgcagcacccagctggatagggcacatggcgttagctcatatgacaccgtaatttccagggatattcaggctcccgacggcctggcagtggattggattcatagtaacatctattggactgattcagtgctcggcacggtgtccgtagcggatactaagggtgtcaaaaggaaaactctcttcagagagaatggcagtaagcctcgggcaatcgtggtggaccctgtgcatgggtttatgtactggacagattggggcacacccgcaaagatcaagaaaggcgggctcaatggcgtggatatctattccctggtgacagaaaatattcaatggccaaacggcatcactctcgacctcctgtctggacggctgtactgggtcgactctaagctgcactcaatcagttccatcgacgtcaacggcgggaatcggaagaccatcctggaagatgagaagaggcttgcccaccccttttctctggccgtctttgaggacaaagtcttctggacggacattatcaatgaggctatcttctccgcgaaccgcctcactggatctgacgtcaaccttctcgccgaaaacctcctgtctcctgaagatatggtgctgttccataacctcacacagcctcgaggggttaactggtgtgaaaggacaaccctgagtaatggagggtgtcaatacctctgcctccccgctccccaaatcaacccacattctcccaagttcacgtgtgcatgccccgacgggatgctcctggccagagacatgcgatcctgcctgactgaggctgaggccgctgttgcaactcaagagactagcaccgtgcgacttaaagtgagttccaccgccgtccgaacccaacacactaccactaggcccgtgcctgatacctcccgattgccaggcgctacccctgggctcacaacggtggaaatcgtgacaatgtcacaccaggcgcttggggacgtggcaggcagaggtaatgaaaaaaaaccatcaagcgtacgggcactgagtatcgtgctgcctattgttctcctcgtgttcctgtgtttgggtgtattcctgctctggaaaaactggcggctgaagaatatcaacagcattaatttcgataaccccgtgtatcaaaaaaccacggaggacgaagttcacatttgccacaatcaggacggatattcctatcctagccgccagatggtttctctggaagacgatgtcgct

SEQ ID NO: 699 - DNA, 2580 bp, Artificial Sequence
  Description of Artificial Sequence: Synthetic Transcript Sequence
atgggcccgtggggatggaagttgagatggaccgtcgccctgctcctggcagcagcgggtaccgccgtgggggaccggtgtgagagaaacgaatttcaatgccaagacggaaaatgcattagctacaagtgggtttgcgatggatcagcggagtgccaggacggttcggacgagtcccaagaaacctgtctcagcgttacttgtaagtcgggtgatttttcgtgcgggggacgggtgaacagatgcattccccagttttggcgctgcgatggtcaggtggactgtgacaatgggtcggacgagcagggatgcccgccaaagacttgctcgcaagacgaattccgctgtcatgatggaaaatgtatcagccggcaatttgtgtgcgactctgatagagactgcttggacgggtcggatgaggcgtcctgccctgtcctcacctgtggacctgcatcgttccagtgcaattccagcacctgtatcccacagttgtgggcatgtgataacgaccctgactgcgaagatggcagcgatgaatggcctcaacggtgcagaggactgtacgtgttccagggcgactcgtcgccgtgttcggctttcgagttccactgccttagcggagagtgcattcattccagctggcggtgtgacggaggacccgattgtaaggataagtcggacgaagagaattgcgccgtggcaacctgccggccggacgaattccagtgctccgatggaaactgcatccatggatcgagacaatgtgatagggagtatgactgcaaggacatgagcgacgaagtcgggtgcgtgaatgtgaccctgtgcgagggaccgaacaagttcaaatgccactcaggagaatgtatcaccttggataaggtgtgtaatatggcccgtgattgccgcgactggtccgacgaacctatcaaagagtgtggaaccgctgcgtgccttgacaataacggtgggtgtagccatgtctgcaacgccctgaagatcggggcggagtgtctgtgcccagatggatttcagctggtggcgcaacgccggtgcgaagatatcgacgagtgtcaggaccctgacacttgctcgcagctctgtgtgaacctggaaggcggttacaagtgccagtgcgaagaaggattccagttggatccacacaccaaggcttgcaaagcggtgggctcaatcgcctacctgttcttcaccaaccgccatgaggtgcggaagatgaccctggaccgcagcgaatacacttccctgatcccgaatcttaggaacgtggttgccctcgatactgaggtggcaagcaacagaatctactggagcgatctgagccagcggatgatttgcagcactcaactggatcgcgcgcatggagtcagctcctacgatacggtcatttcgagagacatccaggcgccggatggactggcggtggactggatacactcgaacatctactggaccgacagcgtgctcggaactgtgtctgtcgccgacactaagggagtgaagcgcaagacccttttccgcgagaacggctccaagccacgcgccatcgtcgtggatccagtccatggatttatgtactggactgactggggaactcctgcgaagatcaagaagggaggattgaacggagtggacatctacagcttggtgactgagaatatccagtggccaaacggtattactctcgatctgctctcgggacgcctgtactgggtggattccaagctccattctatctcatccatcgatgtcaatgggggcaaccgcaaaacgatccttgaggatgagaaacggcttgctcatcccttctctctggccgtgttcgaggacaaggtcttttggaccgacatcattaacgaggccatcttttcggccaaccggctgacgggaagcgacgtgaatctgctggcagaaaatctgctgagcccagaagatatggtgctgttccacaatctcactcaaccgcgcggagtgaactggtgtgagcgcactactctgtccaacgggggatgtcaatacctctgtctgcctgcccctcagatcaatccgcattcgccgaagttcacttgcgcgtgccctgacgggatgttgctggcccgggacatgaggtcctgtctgaccgaagccgaagcggccgtggcgacgcaagaaacctccacggtgcgcctgaaagtgtcgtcgaccgccgtgagaacccaacacactactactcggccagtcccggatacctcacgcctgccgggggccacgcctgggctgactactgtggagatcgtgaccatgtcgcatcaggcactgggagacgtcgccggccgaggtaacgagaaaaaaccgagctcagtccgggccctgtccatcgtgctgccgatcgtgctgctcgtgtttctctgcctcggcgtgttcctgctgtggaagaattggcgtctcaaaaacatcaattcaatcaacttcgataaccccgtgtaccaaaagactacggaagatgaagtgcatatctgccataaccaggacggctactcttacccgtcgagacagatggtgtcgctggaggatgatgttgcc

SEQ ID NO: 700 - DNA, 2580 bp, Artificial Sequence
  Description of Artificial Sequence: Synthetic Transcript Sequence
atgggtccgtggggctggaaactccgatggacggtggccttgttgctagcagctgcggggacagcggtcggagacaggtgcgagagaaatgaattccagtgccaggacggtaagtgcatttcttacaagtgggtatgtgatggtagcgccgagtgccaagatggctctgatgagagccaggagacctgcctgtctgtcacgtgcaaaagcggggacttcagctgcggcggccgcgtgaatcgatgtatccctcaattttggcgctgtgatggccaagtggactgtgacaacggctccgacgagcagggctgccctcctaagacctgcagccaggacgagttccgctgccacgacggtaagtgtattagccgccagtttgtgtgtgacagcgatagagactgtctggacggaagcgacgaagccagctgtcctgttctgacctgcggcccagcgtcgttccaatgcaatagtagcacctgcataccacagttgtgggcatgtgacaatgatcctgattgtgaggacggcagcgacgagtggccacagagatgtagaggactctacgtgttccaaggcgactcatctccatgcagtgccttcgaattccactgtctgagcggggaatgcatccactcatcttggcgctgcgacggtggcccggattgtaaggacaaatctgacgaggaaaattgcgcggttgcgacctgccgcccagatgaatttcaatgttctgatggtaattgcatccacggtagccgccaatgcgaccgtgagtatgactgcaaagatatgtcagacgaggtcgggtgcgttaacgtgaccctgtgcgaaggccctaacaaatttaagtgccacagcggcgaatgtataacactggacaaagtgtgtaacatggccagggactgcagggactggagcgacgagccgatcaaagaatgtggcactgcggcttgtctggataacaacggaggctgcagccatgtctgtaacgcgctcaagatcggcgccgaatgcctgtgtccagatggctttcaattagtggcacaacgcagatgtgaagatattgatgagtgccaggaccctgatacctgcagccaactgtgtgtgaacttggagggcgggtacaaatgccaatgcgaagaaggctttcagctggacccgcacacgaaagcgtgcaaggccgttggaagcattgcctacctattctttaccaaccggcacgaagtgcgcaagatgacgctcgatcggtctgaatacacctccctgattccgaatctgcggaacgtggtggccctcgataccgaggtcgcgtctaatcgcatctactggagcgatctcagccaacggatgatttgctcaacgcagctggatagggcgcatggcgtcagctcctacgataccgtgatatccagggacattcaagctcctgatggcttggctgtggactggatccactcaaatatttactggacggacagtgtactggggacggtctccgtcgcagataccaaaggtgtgaagcggaaaaccctgtttcgagaaaatggaagcaaaccgcgagccatcgtggtggatccggttcatggcttcatgtactggacggactggggtaccccggcgaaaattaagaaaggtggcctgaatggtgtggacatctatagccttgtgaccgagaacattcagtggcctaacggaattaccttggatctgctgtctggaaggttgtactgggtcgactctaagctgcatagcatttcctcaatagacgtgaatggcggtaatagaaaaactatcctggaggatgaaaaacgcctggctcaccctttctcactggcagtgttcgaagataaagtcttctggacggacattatcaacgaggcaatcttttctgcaaacagattgacgggatctgacgtcaacctgttggcggaaaacttgctgtctccggaggacatggtgctgtttcataacttaacgcagcctaggggagtcaactggtgtgagcgcaccaccctgagcaacggtggctgccagtacctgtgtctaccggcgcctcagattaatcctcactccccgaagttcacatgtgcatgccctgatggcatgctgttggcacgtgatatgagaagctgcctgaccgaggctgaagccgctgtcgcgacacaggagacctccacggttcgtctgaaggtgagcagcacggcagtacgcacacagcacactaccacgaggccggtgcctgacacctctcgcctgccgggtgcaaccccgggcctgacaacggtggaaattgtaaccatgtcacatcaggcactcggtgatgtggcgggtcgcggtaatgagaaaaaaccatcttctgtacgcgccctgagcattgtcctgcctatcgtcttgctggtgtttctctgcttgggggtgttcttgctgtggaaaaattggcgcctaaagaacatcaacagcatcaattttgacaacccagtctaccagaaaacgacggaggatgaagtgcatatctgtcacaatcaagatggttacagctacccttctcgtcagatggtgagtctggaagatgatgtggca

SEQ ID NO: 701 - DNA, 2580 bp, Artificial Sequence
  Description of Artificial Sequence: Synthetic Transcript Sequence
atggggccttgggggtggaaactacgctggacagtggccctactcttagccgctgccggaactgccgtcggggatagatgcgaacgtaatgaattccaatgccaggatgggaaatgtatttcctataagtgggtctgcgatggatctgctgaatgccaggatgggtcagatgagtcgcaggaaacatgcttgtcggtgacatgcaaatctggggattttagttgcggaggaagagtgaatagatgtatcccccagttttggcgttgcgatgggcaggtcgattgcgataatgggtctgatgagcagggatgtcctcccaaaacatgttcacaagatgaatttcggtgccacgacgggaagtgtatcagtcgccagttcgtgtgcgattccgatagggattgtctagacgggtccgacgaggcctcatgtcccgtccttacatgtgggcccgctagtttccagtgcaattcttctacatgtataccccagctatgggcttgcgataacgatcctgattgcgaagacggatctgatgagtggccgcagaggtgtcgaggactgtatgtgttccagggggattcctctccctgttctgcgttcgagttccattgtctctcaggggagtgtatccatagtagttggaggtgcgacggagggccagattgtaaagataaatcagatgaagaaaactgcgccgtagccacatgtcggccagatgaattccagtgttccgatgggaattgcatacatgggtcccgacagtgtgatcgggagtacgattgtaaagatatgtcagatgaagtggggtgcgtgaatgtaacactgtgtgaaggaccaaataaatttaaatgtcactcaggagaatgtataactcttgataaagtatgcaatatggctagggactgcagagactggagtgatgagcccataaaagaatgcggaactgcggcttgtctggataacaatggaggatgctcccacgtatgcaacgccttaaaaataggagccgaatgtctttgtcccgatggattccaattggtcgctcagcgacgctgcgaagatatcgatgagtgtcaagatcccgatacttgctctcagctctgtgtcaacctggaaggagggtataaatgtcagtgcgaagagggatttcagctagatccacacacaaaagcatgtaaggctgtgggatctatagcttatctgttttttactaaccgacatgaggttcgaaaaatgacattagatagatcagaatatacaagtctaatacccaatctaagaaacgtcgtagctcttgatactgaagttgcgtccaatcggatatattggtccgatctgtcccagagaatgatctgctccactcagttggatcgggcccacggggtctcctcttatgatacagtgatatcccgagatatccaggctcctgatgggctagctgttgattggattcattctaacatctattggacagattctgtactgggaactgtctctgttgctgatacaaaaggagtcaaacgcaaaactttatttagagaaaatggatcaaaaccgcgtgcaatcgtggtggatcctgttcacgggtttatgtattggacagattggggaacacccgccaaaatcaaaaagggggggctgaatggagtggatatatattccctagtgactgaaaatattcagtggcctaatggaattacactagatcttctgtctgggcggctgtattgggtggatagtaaactgcattctataagttctatagatgttaacggagggaataggaaaacgatcctcgaagatgaaaaacgacttgcacacccattttcattggcagtattcgaagacaaagtgttctggacagatatcataaacgaagcgatattttccgctaatcggctgacggggtctgatgtgaacctcctggcagaaaatttgctctctcccgaggatatggtgctctttcataacttaacacagcccagaggggtgaactggtgtgaacggactacactctctaacggggggtgccagtacctatgcctccccgcaccacagatcaatcctcattctcccaagtttacatgtgcatgcccagatgggatgctccttgcaagagacatgcggtcatgtctgactgaagctgaggcagccgtcgccacacaggaaacatctactgtaaggttaaaagtgtcttccacagcagtgcgcacacagcatacaactacacgcccggtgcccgatacaagtaggctacccggggccactcccggactcacaacagtcgaaatagtcactatgtcacatcaggctttgggagatgtggctggaagagggaacgaaaaaaaaccatcctccgtgagagctctctcgatagtactgcccattgtgctcctggtatttctatgcctgggggtcttccttctgtggaaaaactggcgcctcaagaatatcaattccatcaactttgataatcccgtctaccagaaaacaacagaagatgaagtccatatctgccataatcaggatgggtattcctacccctcccggcagatggtctcgttagaagatgatgtggcc

SEQ ID NO: 702 - DNA, 2580 bp, Artificial Sequence
  Description of Artificial Sequence: Synthetic Transcript Sequence
atgggtccttggggatggaaacttcgctggactgtggcactgcttctggctgcagcaggtaccgctgtgggcgatagatgcgagagaaacgagtttcaatgtcaagacggaaagtgtatttcatacaagtgggtctgtgacggcagcgcagagtgtcaggacggcagcgatgagagccaagaaacctgcctgagcgtgacttgtaagagcggggatttttcatgcggtggaagagtgaatcgctgtatccctcagttctggagatgcgatggacaggtggactgtgataatggttcggacgagcaggggtgcccacccaagacctgttcccaggatgaattccgatgtcacgacggtaagtgcatctcacgccagtttgtctgtgattccgatagggactgtcttgatggcagtgacgaggcatcgtgccctgtgttgacctgtggccccgcctcctttcaatgtaactcttcaacctgtattcctcaactgtgggcctgtgacaatgacccagactgcgaagatgggtcggacgaatggccacaacgatgtcgtgggctgtacgtttttcaaggtgactcgagcccatgcagcgcgttcgaattccattgtttgtctggcgaatgtattcacagctcctggcgctgcgatggaggccccgattgcaaagataagtcggacgaagaaaactgtgccgtcgccacctgtaggcccgatgaatttcaatgctctgatgggaattgtattcacggttcccgacagtgcgaccgagaatatgattgtaaagacatgtccgatgaagtgggatgtgtgaatgtgaccctttgcgagggacctaacaagttcaagtgccattcgggagagtgtatcacgcttgataaagtgtgcaacatggcacgcgattgtagagattggagcgatgaaccaatcaaagaatgcgggactgcagcgtgccttgacaacaacggcggatgctcacatgtgtgtaatgccctcaagattggagctgaatgcctgtgtccagacggtttccaacttgtagcgcagcgccgctgtgaagatatcgatgagtgccaggacccagatacgtgctcccagctctgtgttaacctggaaggaggttacaagtgtcagtgtgaagaaggtttccaactggatccacacactaaagcctgtaaggccgtgggcagcattgcatacttgttcttcaccaacaggcacgaggtgcggaagatgaccctggatcggtctgagtatacgtccctcattccaaaccttagaaacgtggtggccctggataccgaagtcgcaagcaatcgaatatactggtccgatttgtcgcaaagaatgatttgttcgacccaactcgacagagcacatggggtgtccagctacgacaccgtcatctcaagggatattcaggcacccgatggtctggcggttgactggatacattcgaatatctactggactgattcggtgctgggaactgtctccgttgctgacactaaaggggtgaagaggaaaactctttttcgagaaaacggatcaaagcctagagcaattgtggtcgatcctgtccatggattcatgtactggaccgattggggtactcccgcaaagattaagaagggtgggctgaacggagtggacatctactccctggtgactgaaaacattcagtggccgaacgggattacgctggatctcctgtctggaaggctttactgggtcgattcgaagctgcactccattagctccattgatgtcaatggcggtaaccgcaagacgatccttgaagatgagaagcggcttgcgcatccgtttagtctcgcagtctttgaagataaggtattttggaccgatatcattaacgaagcgatattcagcgcaaatcggctgactggatccgacgtcaatttgcttgcagagaatctgctctcgcctgaggatatggtgctgtttcataaccttacccagcctagaggcgtaaattggtgtgaacggaccaccctgagtaatggggggtgtcaatacctctgtctgcctgccccacagataaatcctcatagccctaagtttacctgtgcgtgtcccgatggtatgctcctggcacgcgacatgagatcatgtctgaccgaagccgaggcagcagtcgctactcaagagacgagcaccgtgagactgaaggtttcgtcgactgcagtgcggacccaacacactacgaccaggcccgtgccggatacgtcgcgtctccccggagcaacccctggacttaccactgtggaaatagtgactatgtcccatcaggcccttggagatgtggccggtcgtggcaacgagaagaaaccatcgtcggtgagagccctgtcgatcgtgcttcctatcgtgctgctggtgtttctctgcttgggcgtttttctgctctggaaaaactggcggctcaagaacattaactcaattaactttgataatccggtgtaccaaaaaacgactgaagatgaagtgcatatatgccataaccaagatgggtactcctaccctagccggcaaatggtatctcttgaggacgatgtggca

SEQ ID NO: 703 - DNA, 2580 bp, Artificial Sequence
  Description of Artificial Sequence: Synthetic Transcript Sequence
atgggaccttgggggtggaagttgagatggactgtcgcactgctgctcgccgcggcaggcactgccgtcggagatcggtgcgaacgaaatgagtttcagtgtcaggatgggaaatgtatctcatacaagtgggtttgtgatggcagcgcagaatgtcaagatggttccgatgaatcccaagaaacctgcttgtccgtcacgtgcaaatccggtgacttcagctgtggggggcgagtcaatcggtgcattccacagttttggcgttgtgatgggcaagtcgactgcgataacggttcggatgaacaggggtgtccacccaagacctgttcgcaagatgagtttcgctgtcatgatggaaagtgcatatcgaggcagtttgtctgtgattcggatcgggattgcttggatggatcggacgaagcaagctgtccagtgctcacctgcggtccagcatcctttcaatgtaactcatcgacttgtattccccagctctgggcctgtgataatgaccccgattgtgaggacggatccgatgaatggcctcagagatgtcgcggcctctacgtgtttcaaggtgacagctcaccttgctcagcctttgaattccattgcctgtcgggggagtgtatacatagctcgtggcgctgtgatgggggaccggattgtaaagataagtcagatgaagaaaattgtgcggttgcaacgtgtaggccagatgagttccaatgtagcgatgggaactgtattcatggatcaagacagtgcgatagagagtacgactgtaaagatatgagcgatgaagtgggctgtgtgaatgtgactctctgtgaaggcccaaacaagttcaaatgtcattcgggagagtgcattacccttgacaaagtctgcaatatggcaagagattgtcgagactggtccgatgaaccgattaaagaatgtggcactgcagcatgtttggacaacaacggtggatgcagccatgtgtgtaacgcacttaagattggggcagaatgcctctgccccgacggatttcagcttgtcgcgcaacgtcgctgtgaggacatcgacgaatgtcaagacccagacacctgttctcagctctgcgtgaatctggagggcggatacaagtgtcagtgcgaagagggttttcaacttgatccgcacactaaggcttgtaaggcagtcggttccatcgcctacctcttctttaccaacagacacgaagtgcggaagatgacgctggaccgctcagagtacactagcctcattccaaacctgcgcaacgtcgtggcgctggacactgaagtggcatcaaatagaatttactggagcgatctgtcccagaggatgatctgctccactcaattggatagggcacacggagtctccagctacgacacggttattagccgcgacatccaagcacctgatggacttgccgtggattggatacattctaatatctactggaccgattcagtgcttggcactgtgtccgtggccgacactaagggtgtgaagcgcaagaccctgttccgggaaaacggctcgaaaccccgggctattgttgtggaccccgttcatggattcatgtactggactgattgggggaccccagcaaagattaagaagggaggactcaatggagtggacatttactcgctggtcaccgagaatatccaatggccgaacggtatcaccctggatctcctgtcgggtaggctctattgggtggattctaagctccactccatttcaagcattgatgtcaacggcggaaacagaaagaccatattggaagatgagaaaaggcttgcccaccctttttccctggcagtgtttgaagataaggtgttctggactgacatcattaacgaggcaattttcagcgcaaacaggttgactggatccgacgtgaacctgctggccgagaacctgctttcccccgaggatatggttctgtttcataatctgacccaaccacgaggagtcaactggtgcgaaaggactaccctgtcgaatgggggatgccaatatctttgtttgcccgcaccccaaatcaatccgcacagccccaagtttacctgtgcttgtcctgacggcatgcttcttgctcgtgacatgcgctcctgtcttaccgaagcagaggcggccgtcgccacccaggagacttcaaccgtgcggctgaaagtgagctcgaccgcggtcagaacccagcacaccaccacgaggcctgtgcccgatacttcacgtctccccggagcgactccggggctgaccaccgtggaaattgtgaccatgagccatcaggcgctcggagacgtggccggacgaggtaacgaaaagaagccctcatcggtgcgggcgctttccattgtgcttccaatagtgcttctggtctttctttgtctcggagtgtttttgctctggaaaaactggagactgaagaacatcaattcgataaactttgataacccagtgtaccaaaaaaccactgaggatgaggtccatatctgccataaccaagacggatactcgtacccctcgcggcagatggtgtcccttgaagatgacgttgct

SEQ ID NO: 704 - DNA, 2580 bp, Artificial Sequence
  Description of Artificial Sequence: Synthetic Transcript Sequence
atgggcccctggggctggaagctgcgttggactgttgcgttgctcctcgccgctgctgggaccgccgttggggaccgatgcgaaagaaacgagttccaatgccaagacggtaagtgcatctcttataagtgggtctgtgatggctctgccgagtgtcaagacggctcagatgagagccaagagacatgcctttcggtgacgtgtaagtcgggcgatttcagttgtggcggtagagttaatcggtgcatcccccagttttggcgctgtgacggccaggtcgattgtgacaacggctccgacgaacagggctgccctcctaaaacgtgttctcaagatgagtttcgttgccatgatgggaaatgcatctcccgacaatttgtgtgcgattccgaccgagactgtttggacgggagcgacgaagcgagctgccctgtgctaacttgtggaccagcatcttttcagtgtaattcctcgacttgcatccctcagctgtgggcctgtgataatgaccccgactgcgaagacgggtctgatgaatggccgcaacggtgccgaggtttatatgttttccagggagattctagtccgtgttccgcattcgaattccattgtctctctggtgagtgcattcattcatcgtggcgttgtgacggagggcccgactgcaaggataagtctgacgaggaaaactgtgccgtggcgacctgcaggcccgacgagttccaatgttcggacggcaattgtatccatgggtctcgacaatgcgatagggaatacgattgtaaagacatgagtgatgaggtcggatgtgtcaacgtcaccttgtgcgaggggccgaataagtttaagtgtcacagtggcgaatgtataacacttgacaaagtttgcaacatggcgcgtgactgtagagattggtctgacgagccaatcaaggaatgcggcacagcggcatgcttggacaacaatggagggtgctcccatgtttgtaatgcccttaagattggcgctgaatgcctgtgtcctgacggattccaactcgtagcgcaacggagatgtgaagatatcgacgagtgtcaagatccggacacttgtagccaattatgtgtgaatttggaggggggttacaagtgtcaatgcgaggagggtttccaactcgacccacacactaaagcttgtaaagctgttggaagtatagcctacttgtttttcaccaatcgacatgaagtgaggaagatgactcttgaccgcagtgagtacacgtcactaattccgaatcttcgaaacgttgtcgcactcgacaccgaagtggcgtctaaccgtatctactggagtgacctctcccaacgcatgatctgtagcacgcagttagaccgggctcacggcgtatcaagctatgatacagtgattagcagagatatccaagcgcccgatggcctcgctgtcgactggattcattcaaatatctattggacagacagcgtgctgggtaccgttagtgtagccgataccaagggcgtgaaacgcaagactctcttcagagagaatggcagcaaaccacgcgcaattgtggtggatcccgtccacggcttcatgtattggacagactgggggactccggccaaaatcaagaagggaggactgaacggtgttgacatctactcgttggtaacggaaaatattcaatggccaaacggtataacgctcgatctcctgagcggtcgtctttattgggtcgacagtaaactgcattctatttcctctatcgacgtgaatggcggtaacaggaaaaccattctcgaagacgagaagcgccttgcccatccatttagtctggcagtctttgaagataaggttttttggacggatatcattaatgaagcgattttttctgcgaaccgcttaactggatccgatgtcaacctgctggcggaaaaccttctcagtcccgaggatatggtcttatttcacaatctgacacaaccccgtggagtcaactggtgtgagcggacgaccctctctaatggcggttgtcagtatctttgtctgcctgccccacagataaatccacactcaccgaaattcacctgcgcttgccctgatgggatgttgttggcacgtgatatgcgcagctgcctgaccgaggcggaagcagcggtggctacccaggagacctcgactgtccggctcaaggttagttcaactgcggtgcgaactcagcacacgaccaccaggcctgtgcccgatacatcacggcttccaggagcgacgccaggactcactacagttgagatcgtgacaatgtcacaccaggcgttaggggatgttgccggacgtggcaatgaaaagaagccctcgtcagttcgagcactgtctatcgtcctccccattgttctccttgtgttcctgtgtttgggggttttcctgttatggaagaattggcgtctcaagaacatcaatagtattaacttcgataaccccgtttatcagaagactacagaagatgaagtgcatatctgtcacaatcaggacggttattcatatcccagccgtcaaatggttagtctagaggacgatgttgcc

SEQ ID NO: 705 - DNA, 2580 bp, Artificial Sequence
  Description of Artificial Sequence: Synthetic Transcript Sequence
atgggcccttggggttggaaactccgctggacagtggctctgctcctcgctgcagctggcacagcggtgggggaccgatgtgagcggaacgagtttcagtgccaggacggaaagtgcatatcctataaatgggtttgtgacggatcagctgaatgtcaggacggatctgacgagtctcaggaaacttgccttagtgtaacgtgtaagtccggggacttcagttgtggcggccgagtgaataggtgtataccccagttttggcgatgtgatggccaggtagattgcgataatggctctgatgagcaaggctgcccgcctaaaacctgcagccaggatgagttccggtgccacgacggaaagtgcatttctcgacaattcgtgtgcgacagtgatagagattgtttagatggttccgatgaggcttcgtgccctgtgctgacatgcgggccagcctcatttcaatgtaactcaagtacctgtatccctcagctgtgggcatgcgacaatgacccagactgtgaggatggatctgacgagtggccccagcgatgtaggggactgtatgtgttccaaggggactcctcgccatgttccgccttcgagttccactgtctctctggcgaatgcatccattccagctggcgctgcgatggcgggcctgactgcaaagacaagagtgacgaggagaactgcgcagtcgctacctgtcgtccagatgagttccagtgcagtgatggcaattgtatccacgggtctcggcagtgtgatagagagtacgactgtaaggatatgagcgatgaggtcggctgcgtgaatgtgaccctgtgcgagggtccaaacaagtttaagtgccactcaggcgaatgcataacgttggacaaggtgtgcaatatggcaagggactgtagagattggtctgacgaacctattaaggagtgtggtacagctgcatgccttgataacaacgggggatgctcacacgtttgcaacgccctgaaaattggcgcggagtgtctttgtcccgatgggttccagttagttgcgcaaaggagatgcgaggacattgacgaatgccaggatccagacacctgtagtcagctgtgcgtgaacctcgaaggcggatataaatgccagtgcgaggagggcttccaactggacccccacacaaaggcttgtaaggcagtgggtagtattgcctatctattttttactaacaggcatgaagttcggaaaatgaccctggaccggtctgagtacacgagcctcatacccaatcttaggaatgtcgtggcacttgatacagaggtggcaagcaatcgcatctattggagtgatttgagccagagaatgatctgttccactcagctcgatagagcccatggcgttagtagttacgataccgtgattagccgcgacatacaggcacctgatgggttggcggttgattggattcattcaaatatctattggaccgactccgttctgggaacagtctccgtggccgatacaaagggagtcaaaagaaaaaccctttttcgagagaacggatccaaaccaagagcaatcgtggtggaccccgtgcacggcttcatgtactggacagactggggcacccccgcaaagattaagaaggggggcctgaatggagtggacatctattccctggtgacggagaatatacagtggcccaatggcattactctggaccttctgtccggaagactatactgggtggatagcaaattacattccataagttcaatcgatgtcaacggtggcaacagaaagaccattctggaagatgagaaaagactcgcacaccccttttcactggcggtttttgaagataaggtgttttggactgacataatcaacgaagccatattttcagctaacagactgactggatctgacgtcaacttattagcggagaacttactttctccagaggacatggttttattccacaatctgacccagcctaggggcgtcaattggtgtgaacgaactactctgtctaacggcggctgccaatacctctgcctgcctgcacctcagataaatccgcacagccctaaattcacatgtgcctgccccgatggaatgctgctggcccgggacatgcgatcctgcctcaccgaggcagaggccgccgtggcaacccaggagacctcaacggttcgcctcaaagtaagctctaccgctgtgaggacccaacacactacaaccagaccagtccccgacacctctagactaccaggcgccacccctggtctgaccaccgttgagatagtgactatgtctcaccaggcactgggcgatgtggcgggacgtgggaacgagaagaaaccctcttccgtgagagcactttcgatcgtgctccccatcgtccttttggtgttcctgtgtctcggggtgtttttgctgtggaagaactggcgattaaagaatatcaacagtatcaacttcgataatcctgtgtaccagaagaccactgaagacgaggtgcatatctgccacaaccaggatggttatagttatccttcccgacaaatggtgtcactcgaggacgatgtggct

SEQ ID NO: 706 - DNA, 2580 bp, Artificial Sequence
  Description of Artificial Sequence: Synthetic Transcript Sequence
atgggaccttggggatggaagttgcggtggacggtggcacttctcctcgcagcagcagggactgcagtgggtgatcgatgcgaacggaacgagtttcaatgtcaagatgggaaatgtatctcttacaagtgggtgtgtgatggtagcgcagagtgtcaagacggctctgatgaatcgcaagaaacctgtctgtccgtgacctgtaaatccggggatttttcatgtggggggcgggtgaacaggtgcattccccagttttggagatgcgacggtcaggtggattgcgataacggcagtgacgagcaaggatgccctccaaagacgtgctcgcaagacgaatttcggtgtcatgacggtaaatgtatttcgagacaatttgtgtgcgatagcgaccgcgattgtctggatggttcggacgaagcgtcctgtcctgtgctgacttgcggacctgcgagcttccaatgtaattcgtcaacttgcattccacaactgtgggcttgtgataacgaccctgattgcgaagatggctcagacgaatggccgcagagatgtcgcggactttacgtgttccagggtgattcgtccccttgcagcgcattcgaattccattgtctgagcggagagtgcatccattcctcctggcgatgcgatggaggtccagattgtaaggataaatccgacgaagaaaactgtgccgtcgcaacttgtcgacctgatgagtttcaatgctcagacggaaattgtattcacggttcccgccaatgtgatcgcgaatacgattgcaaagatatgtcggatgaagtcggctgtgtgaacgtcaccctgtgtgaaggaccgaacaaattcaaatgccattcgggggaatgcattaccctggataaggtctgcaacatggcaagagactgccgcgattggtcggacgaacccattaaagagtgcgggaccgcagcctgtttggataacaacggtgggtgcagccacgtctgtaacgccctgaaaatcggggcggaatgcctgtgtccagacggattccaactggtcgcacaaagacgttgcgaggacatcgatgaatgtcaagatcccgatacctgctcccagctgtgtgtgaacctggagggtggatacaagtgtcagtgtgaagaaggattccaacttgatccacacactaaggcatgtaaggcagtgggttccattgcctaccttttctttacgaacagacatgaagtccgcaaaatgactctggacagatcggaatacacttcattgattcctaaccttcgaaatgtcgtggcactggatactgaggtcgcatcgaaccgtatttactggtcggatctctcgcaacgaatgatatgttccactcaactggaccgcgcgcatggagtgtcgtcctacgatacggtcatttcgagagacatccaggcgccagacggactcgcagtggattggattcactcgaacatttactggaccgacagcgtccttggtaccgtgtcggtggcagacaccaaaggtgtgaagaggaaaactctttttcgggaaaatggatcgaaaccacgagcaatcgtggtggatccggtgcacggctttatgtactggaccgattggggaacgcctgctaaaatcaagaaaggaggcctgaatggtgtcgacatttactcccttgttaccgagaatatacaatggccaaacggtataacccttgaccttctgagcggacgcctgtactgggtcgactcaaagctgcattcaatttcgtcaatcgacgtaaacgggggcaatcggaaaactattcttgaagatgaaaagaggctggcgcatcccttctccctggcagtgtttgaggacaaggtgttctggactgacataatcaacgaagccattttctcagcaaaccggctgacgggtagcgatgtcaaccttctcgccgaaaacctgctctcacctgaggacatggtcctgttccataatctcacccaacctagaggcgtgaattggtgtgagagaactactctctccaatggggggtgtcagtacctttgcctgccggctccacagataaacccccattcccctaagttcacttgcgcctgccctgacggtatgctcctggcaagagacatgcgctcgtgtctgactgaagcagaagcagccgtggcaacccaggagactagcactgtccggcttaaagtctcgtccaccgctgtgaggacccaacataccactaccagaccggtgcccgacacttcccgcctgcctggagcaactccaggactgaccacggtggagatagttaccatgagccatcaagcactcggtgatgtggcagggagagggaatgaaaagaagccatcatcagtccgcgccctgtccatcgtgctcccaattgtgctgcttgtgtttctctgtctcggcgtttttctcctttggaagaactggagacttaagaacatcaattcaatcaattttgacaacccggtgtaccaaaagactactgaggacgaagtgcatatttgtcacaaccaggatggctactcctacccttcacggcagatggtgtccctcgaggatgacgtcgca

SEQ ID NO: 707 - DNA, 2580 bp, Artificial Sequence
  Description of Artificial Sequence: Synthetic Transcript Sequence
atggggccgtggggatggaaattgcgttggaccgtagccctgttgttagcagcggcgggtactgcagtcggggatagatgtgaaagaaatgagtttcagtgtcaagatggaaaatgtatttcctataagtgggtatgtgatggctctgccgaatgccaggacggatcagatgaaagtcaggagacatgtcttagtgtaacatgcaaatcaggagactttagttgcggaggacgcgttaatagatgtataccacaattttggcgttgcgatggacaggtagattgtgataatggctcagatgagcaagggtgcccacctaaaacatgttctcaagatgaattccgatgccatgatgggaaatgcattagtcgtcaattcgtatgcgattcggacagagattgtttggatggcagtgatgaagcatcatgcccagttcttacttgcggacccgctagttttcagtgtaatagtagtacctgcataccgcaattgtgggcctgcgataacgatccagattgtgaggacggatctgatgaatggccacaacggtgtagaggactatatgtttttcaaggggactcatcaccgtgctctgctttcgagttccactgtttgtccggggaatgcatacatagtagttggagatgtgatggaggtccagactgcaaagataaatcagacgaagagaattgcgcagttgcaacatgccgaccagatgaatttcaatgctcagacgggaattgcatccacggatcacgacagtgcgaccgagaatacgattgcaaggatatgtctgatgaagtgggttgcgtgaatgttactttgtgtgaaggaccaaacaaatttaaatgccactctggagaatgcatcacactagataaagtttgtaatatggctcgggattgtcgtgattggtcagacgaaccgataaaagagtgcggcacagctgcatgcctggataacaatggaggttgttctcacgtgtgcaatgcattgaagatcggagctgaatgtctttgccccgatggattccaactggttgcccaaagacgatgtgaggatattgatgaatgccaagatcccgatacttgctctcaactatgtgttaatttggaaggaggctataaatgccaatgtgaggagggatttcagttggatccacatacaaaggcatgcaaggcagtcggatccattgcttacctgttttttacgaacagacatgaagtcagaaaaatgacacttgatcgctcggaatatacaagtttgatcccaaacctccgaaacgttgttgctcttgatacagaagttgctagcaaccgaatctactggtcggatcttagtcagcggatgatctgctctacacagctggaccgtgcacacggagtatcgtcgtatgatacagttatttctcgagacattcaagctcctgatggattagccgtcgattggatacactctaacatttattggactgattccgttttggggactgtgtctgtagctgatacaaagggagttaaaagaaagaccttgtttagagagaatggttctaaaccccgagcaatagtcgtcgatcctgtgcacggttttatgtattggacggattggggaaccccagcaaaaatcaagaagggaggtctcaatggcgtagatatttactctttggttacggaaaatattcaatggccaaatggaatcacacttgatcttttatcgggaagattgtactgggtggatagtaaacttcacagtatctcgtcaattgatgtcaacggcggaaacagaaagacgatcttggaagatgagaaacgattggcgcacccattttctctggcggtgttcgaggacaaggtattttggactgatatcattaatgaagctatcttctcagcgaatcgacttacgggtagcgatgtcaatttgttggcagagaacctcctttcacctgaagatatggttttatttcacaatcttacgcaaccgcggggagttaattggtgcgaacgaacgactttatcaaatgggggttgtcaatatctttgcctccctgcgccgcagattaatccacattctcctaaattcacctgcgcttgtccagacggaatgctccttgcgcgcgatatgcgatcctgcctcacagaagccgaggctgcagttgcaacacaagaaacttctacagttagactcaaggtatcatcgaccgcagtacgaactcagcacacaacaacacgtccagtgccagacacaagcagactacccggggccaccccaggacttaccacagtagaaattgttactatgagtcatcaagccctgggagacgtggctggccgaggaaatgaaaaaaagccttcttcggttcgagctttgtccatcgttctgccaattgtccttttggtcttcttgtgccttggcgtgtttctgttgtggaagaactggaggttgaagaatattaatagcattaatttcgataatccagtttatcaaaaaacaacggaggacgaagtgcatatctgtcataatcaggatggatattcgtatccttccagacagatggtgagtctcgaagacgatgtggct

SEQ ID NO: 708 - DNA, 2580 bp, Artificial Sequence
  Description of Artificial Sequence: Synthetic Transcript Sequence
atgggaccatggggctggaaacttcgttggactgtggcactgctgctggcagcagcgggcactgcagtcggcgaccggtgtgaacgtaacgaattccagtgtcaagatgggaagtgtatttcgtacaagtgggtctgtgacggttcggcagagtgccaagatggttccgacgaatcacaagaaacttgtctgagcgtgacctgtaagagcggcgacttcagctgcggagggagggtgaatcggtgtattccccagttttggagatgcgatgggcaggtcgattgtgataatggttcagacgaacagggatgtccaccaaagacttgtagccaggacgaattcagatgtcatgatggtaagtgcatttcccggcagtttgtgtgtgatagcgatagagactgtttggacggaagcgacgaagcctcgtgtccagtgcttacttgcggtcctgcctcatttcagtgcaattctagcacctgcatcccacaactgtgggcctgtgataacgatcccgactgtgaggacggatcggatgaatggccacagcggtgcagaggtctgtacgtgtttcagggagattcgagcccttgttccgcgtttgagtttcactgtctctcgggagaatgcatccactcctcgtggcgctgcgatggtggacccgattgcaaggacaagtcggatgaggaaaattgtgcagtggctacctgcagaccagacgaatttcaatgtagcgatggaaactgtatccacggttcaagacagtgcgaccgcgagtatgactgcaaggatatgtccgatgaggtcgggtgcgtgaacgtgactctttgcgagggtcctaacaaattcaagtgccattcaggtgaatgcatcacgctggacaaagtgtgtaacatggcgcgcgactgtagggactggagcgatgaaccgattaaagaatgtggaactgcagcatgtctggacaataacgggggatgttcgcatgtgtgcaacgcactcaagataggtgcagagtgtctgtgtccagacggatttcagttggtcgcacagcgccgatgcgaagatattgacgaatgccaagaccctgacacctgttcccagctttgcgtcaatttggaaggggggtataagtgccaatgcgaagagggattccaacttgatcctcataccaaggcctgtaaggcagtcggatccatcgcatacctgttctttaccaacagacacgaagtgaggaagatgaccctggatcgttccgagtacacgagcctgatccctaacctgcgcaacgtcgtggcccttgatactgaagtggcatcgaatagaatttactggtcagatctgtcgcagcggatgatttgtagcacccaacttgatagggcacatggagtgtcgtcgtacgatactgtgatatctcgcgatatccaagcaccagatggattggccgtcgattggatacattcaaacatttactggactgactcggttctggggaccgtttcggtggctgacaccaagggagttaagcggaaaaccctgttcagggaaaacggatccaaacccagagcaatagtggtggaccccgtgcacggatttatgtactggaccgattgggggaccccagccaagataaagaagggaggactcaacggagtggacatatactcgctcgtgactgagaatattcagtggccaaacggaattactctggacctcctctcgggacgtctctactgggtggattcgaaacttcattccatttcgtcgatcgatgtcaatggcgggaataggaaaactattctcgaagatgaaaagcggctggcacatccatttagcttggccgtctttgaagataaggtgttctggactgacattatcaatgaagcaattttctcggcaaacagactgaccggctccgatgtgaatctgcttgctgaaaatctgttgtcccccgaagatatggtcctttttcataacctgactcagcctaggggcgtgaactggtgtgaaagaactaccctctcgaacggaggatgtcagtacctttgtttgcctgcgccccaaatcaatccccactcaccgaagtttacttgtgcttgtcccgatggcatgttgctcgcacgtgatatgcgcagctgccttactgaggcggaagcagccgtggcaacccaagagacttccactgtcagactgaaagtgtcctcaaccgctgtgcgtactcagcacactaccactcggcccgtgcccgacacctcaaggctgcctggcgccaccccgggtctgactactgtggaaatcgtgaccatgtcgcaccaagccctgggtgatgtggccggacggggaaacgagaagaagccctcatccgtgcgtgcacttagcatcgttcttcctatagtcttgcttgtgtttctgtgtcttggagttttccttttgtggaagaactggcgcttgaagaatatcaactcgatcaatttcgataacccagtctaccaaaagaccaccgaggatgaggtgcatatatgtcataatcaagatggatacagctatccttcacggcagatggtgtcccttgaggatgatgtggca

SEQ ID NO: 709 - DNA, 2580 bp, Artificial Sequence
  Description of Artificial Sequence: Synthetic Transcript Sequence
atgggaccatggggttggaagctgcgatggactgttgccctgctgctggccgctgctgggacagcagtaggcgataggtgtgaaaggaatgagtttcagtgccaagacggaaaatgtatttcatacaaatgggtgtgcgatggcagtgccgaatgtcaggatgggagcgatgaatctcaagagacatgcctgtctgtgacttgcaagagtggtgacttctcatgtggtggccgcgtaaaccgctgcataccacagttttggcggtgcgatggccaggtggactgtgacaatgggtcagatgaacagggctgtcctcccaaaacgtgtagtcaggacgagtttagatgtcacgatggcaagtgcattagccggcagtttgtatgtgactcagatcgcgattgcctcgacggttctgacgaggcctcttgccctgtgctgacatgtggaccagcctcattccaatgcaacagcagtacgtgcatcccacagctgtgggcttgtgacaatgacccagactgtgaagatggttcagatgagtggccacaacggtgcaggggtttatatgtcttccagggagattcgtccccctgctcggcctttgagtttcactgcctgagtggggagtgcatccacagtagctggagatgtgacggcgggcctgattgcaaagacaagagtgatgaagagaactgtgctgtagctacatgtaggcctgatgagtttcagtgcagcgatggaaattgcatacacgggtcccgacagtgcgacagggagtatgactgcaaagacatgtccgacgaagtggggtgtgtgaatgttacgctctgtgagggccctaataaattcaaatgtcatagtggcgagtgcatcacactagacaaagtttgtaatatggcacgagactgcagagactggtcagacgagcctataaaggagtgcgggactgcggcttgcctggataataacggcggttgctcccatgtttgcaacgcactgaagataggcgcggaatgtctttgccctgatgggtttcagctggtcgcccaacgtagatgcgaggatatcgacgaatgtcaagatcccgacacatgtagccagctgtgtgtgaacctggagggaggatataaatgccagtgtgaagagggcttccagctggatccccacactaaagcctgcaaggccgtggggtccatcgcctacctgtttttcacgaatagacacgaggtgaggaagatgaccctggatagaagcgagtatacaagcctaattcctaatcttcggaatgtggtcgccctagatactgaagtggcctctaaccggatctattggagcgacctaagtcaacgcatgatctgtagcactcaactggacagggcccacggcgtgtcatcatatgacacagtgatttcacgagacattcaggcccccgacggactagccgtggattggatacactcaaacatttattggacagactccgtcctagggacagtttcagtggctgataccaaaggcgttaagaggaaaacacttttccgcgagaatgggtcgaagcctagggcaatcgtcgtagaccctgtccatgggttcatgtactggaccgattggggaacccccgctaaaatcaagaaggggggactcaatggcgtggatatttatagcctcgttacagaaaatattcagtggccaaacggtatcaccctcgatctgctgtctgggcggctctattgggtcgactccaagctgcactctatctcatcaatcgatgtcaacggcggaaaccgcaagaccattttggaggacgagaaaaggcttgctcatcctttcagcctggctgtgtttgaggacaaggtcttctggaccgatatcattaacgaagcaatcttcagcgctaaccggctgaccggttctgatgtaaaccttctggctgaaaatttactcagtcccgaggacatggtgctctttcataacctgacacagcctcggggcgtcaactggtgtgagcggacaacgctctcgaatgggggttgtcagtatctgtgtctgccagccccacagattaaccctcactctccaaaattcacctgtgcatgcccagacggaatgctcttggctcgcgatatgagaagttgcctgactgaggcggaggcagccgtggctactcaggaaacatctacagtgcggttgaaggtgtctagtacggctgtgcggacccagcacacaactactagacccgtgcctgatacgagccgcctgccaggagctacccccggactcacgaccgtcgagatagttactatgtcccatcaggccctgggcgacgtggcaggccggggaaatgagaaaaaaccctcctccgtccgcgctctgtcgattgttctgccaatcgtgcttttagtgttcctgtgtctgggcgtcttcctcctgtggaagaactggcggttaaagaatattaacagcattaacttcgacaatcccgtctatcagaagaccacagaggacgaagtgcatatttgccacaaccaggacggttacagttacccctctagacagatggtatccttggaagatgacgtcgcc

SEQ ID NO: 710 - DNA, 2580 bp, Artificial Sequence
  Description of Artificial Sequence: Synthetic Transcript Sequence
atgggaccgtggggatggaagctgcgctggaccgtggccttgctgctggcagccgcgggtacggcagtgggggaccgctgtgaaagaaatgaattccagtgtcaggacggaaaatgcatttcctacaagtgggtgtgcgacggcagcgccgaatgtcaagatggctccgatgaatcgcaagagacttgccttagcgtcacctgtaagtcaggagatttctcttgcggggggcgcgtgaaccggtgcatcccacaattctggcggtgcgatggacaggtggattgcgataacggatccgatgaacagggatgtccgccgaaaacctgctcgcaggacgaattcagatgccacgacggcaagtgcatctcacgccagttcgtgtgcgactcagaccgcgactgcctggatggctcggatgaggcttcatgcccagtgctgacttgcggacctgcttcattccagtgcaactccagcacctgcatcccccaactctgggcctgtgacaatgaccctgactgcgaagatggatccgacgagtggccacaacggtgccgggggctgtacgtttttcagggagattcgtcgccgtgctcggccttcgagtttcactgcctctccggagaatgcatccacagcagctggaggtgcgatggtggcccggactgcaaggacaaatcggacgaagagaattgcgcggttgcaacttgccggccggatgagttccaatgcagcgatggaaactgcatccatggatccagacagtgcgaccgggagtacgattgcaaagatatgtcggacgaagtgggatgcgtgaatgtgaccctctgtgaaggacctaacaagtttaagtgtcactcgggagagtgcatcaccctcgataaagtctgcaacatggctcgggactgcagagactggtcggatgaaccgatcaaagaatgcggcaccgccgcctgcttggacaataacggaggatgcagccacgtgtgcaacgcactgaagattggcgcagaatgtctgtgtcccgacggattccagctggtggcgcagcgcaggtgcgaggacatcgatgagtgccaagatccggatacttgcagccaactgtgcgtgaacctggagggtggatacaaatgccagtgtgaggaggggttccaactggatccgcacaccaaagcatgcaaggcggtgggatcgatcgcttacctgttcttcactaaccggcacgaagtgcgcaagatgaccctcgataggagcgaatacacctccctgatcccaaacctccgcaatgtggtggcgttggatactgaagttgcttcaaatagaatctactggtcggatctctcgcagcgcatgatctgctccacgcagctggacagagcccacggagtttcctcatacgataccgtgatctccagagacatccaagctccggacggacttgcggtggactggattcactccaacatctactggactgattcagtgctggggactgtgagcgtggctgatactaaaggcgtgaaacggaaaacgctcttcagagagaatggatcaaagccccgcgctattgtggtcgacccggtgcatggattcatgtactggaccgattggggaacgccggcaaaaatcaagaaaggtgggttgaacggcgtggacatctactccttggtcaccgaaaacatccagtggccgaatggaatcactctggatctgctctccggtcggctgtactgggttgactcaaagctgcattcaatctcctctatcgatgtgaacggaggaaatagaaagacgatcttggaggacgagaagagactcgcacatccattctcgttggctgtgttcgaagataaggttttctggactgatatcatcaacgaggccatctttagcgccaataggcttactggctcggatgtgaacctcctggcagagaacctgctgagcccggaggacatggtgctgttccacaacctcacccaaccacgcggagttaactggtgcgaacgcaccaccctctcgaacggcggatgccagtacctctgccttccagccccgcagattaatccccattcgccgaagtttacctgcgcctgccctgacgggatgttgctggcacgggatatgcgatcgtgtttgaccgaggctgaggcggccgtcgcgactcaggagacttcgaccgtccggctcaaggtgagctcaaccgcagtgcgcacgcaacatactaccacgcgccctgtcccggacacctcgcgtctcccgggcgctaccccgggattgaccaccgtcgaaattgtgacgatgagccatcaagccctgggtgatgtggccggacgcggaaacgaaaagaagccttcgtcagtccgagcactttccatcgtgcttcctattgtgctgctggtattcctctgcctgggtgttttcctgctctggaaaaactggcgcttgaaaaacatcaattccatcaactttgacaacccagtctaccaaaagaccactgaggatgaggtgcatatctgtcataaccaggacgggtacagctacccatcgcgccagatggtgtccctggaggatgatgtggca

SEQ ID NO: 711 - DNA, 2580 bp, Artificial Sequence
  Description of Artificial Sequence: Synthetic Transcript Sequence
atggggccgtggggttggaagttgcggtggaccgtcgccctgctgctggcagcggctggtaccgccgtgggcgaccgctgcgagcggaatgagtttcaatgtcaggatggaaaatgcatcagctacaaatgggtgtgtgatggatcagctgaatgccaagacggaagtgacgagtcgcaggagacttgcctgtcagtgacctgcaaatccggagatttctcgtgcgggggccgggtgaatcgctgcatcccgcagttctggcggtgtgatggtcaagtggattgcgacaacggctcggacgaacagggatgtccaccgaaaacttgttcacaggacgaattccgctgccatgatggaaagtgtatctcacggcagttcgtctgcgattccgacagggactgccttgacggaagcgacgaagcctcctgtccggtgcttacttgcggcccggcctcgtttcagtgcaactcgagcacgtgtatcccacaactttgggcctgcgacaatgacccggattgcgaggacggctcagacgaatggccccagcggtgtagagggttgtacgtgttccagggcgactcatccccctgctcggcatttgaattccattgtctctccggcgagtgcattcattcatcctggaggtgcgacggaggtccggactgcaaggacaagagcgacgaagagaattgcgccgtggccacttgcagaccagatgaattccaatgttcagacggcaattgtatccacggatcacgccagtgcgacagggaatacgactgtaaagacatgtcggatgaagtcggatgcgtgaacgtgaccctctgcgagggaccgaacaagttcaagtgtcactccggagagtgtataacgctggacaaggtgtgcaacatggcccgggattgccgcgattggtcggatgaaccgatcaaggagtgtggaaccgcggcctgcctggacaacaacggaggatgctcacatgtgtgtaatgccctcaaaatcggagcggagtgcctgtgcccggatgggttccagttggtggcccagcggcgctgtgaagatatcgacgagtgccaagacccggacacctgctctcagctctgcgtcaatttggagggcggatacaagtgccagtgcgaagagggattccagctggacccgcacactaaggcttgcaaagccgtcggatcaatcgcatacctcttcttcaccaaccgccacgaagtgcggaagatgactcttgaccgatcggaatacacttcgctgatcccaaacctgcggaacgtggtggcccttgacactgaagtcgcctctaatcggatctactggtccgatctgagccaaaggatgatctgctctacccaactggaccgggctcatggagtttcgtcgtacgacactgtgatcagccgcgacatccaggcgccggacggactcgccgtggattggatccattcgaacatctattggaccgattccgtcctggggactgtcagcgttgctgacactaagggcgttaagagaaaaaccttgtttagagaaaatggctccaagcctcgggccatcgtggtcgatccggtgcacggattcatgtattggaccgactggggtactccggcgaaaatcaagaaaggcggactcaacggagtggacatctacagcttggtgaccgaaaacatccagtggcccaacggaatcacgcttgacctgctgagcgggcgcttgtattgggtcgacagcaagctgcatagcatctcatccatcgacgttaacggaggcaatcgaaagactatcctcgaggacgagaagagattggcgcatccattcagcctggccgttttcgaagataaggtgttctggactgatatcatcaacgaagcaatcttttcggcgaaccggctgaccggctcagatgtgaaccttctcgccgaaaatctcctctcgcctgaagatatggtgctgttccacaacctgactcaaccgcgcggcgtcaactggtgcgaacggaccaccctctcaaacggcggctgccaatacctgtgcctgccggcaccgcagatcaatccgcactccccgaagtttacgtgtgcctgtcccgacgggatgctcctggcacgcgatatgcgctcctgccttaccgaagccgaggccgcggtggcgacccaagaaacctccactgtccggctgaaggtgagctccaccgccgtgcggacccagcacactaccacccgcccggtgcccgatacttcaagactgccgggcgccaccccggggctgaccactgtcgaaatcgtcacgatgtcccatcaagcgctgggagatgtcgctggacggggaaatgagaagaagccgtcgtcggtcagagccctgtcgatcgtgctgccgatcgtgctcctcgtctttctttgcctcggagtctttcttctctggaagaactggcgccttaagaacatcaattccatcaacttcgataacccggtgtaccaaaagaccactgaagatgaagtgcacatctgccacaatcaggacggatacagctacccttcccgtcaaatggtttccttggaggacgacgtggca

SEQ ID NO: 712 - DNA, 2580 bp, Artificial Sequence
  Description of Artificial Sequence: Synthetic Transcript Sequence
atgggaccttggggatggaagctgaggtggacggtggcgctgttgctggcggcagcaggtaccgcagtgggagataggtgcgagcgaaacgagtttcaatgccaggacggtaagtgcatttcctacaagtgggtgtgtgatggatcagccgaatgtcaagacggatcggacgagtctcaagaaacctgcctgagtgttacttgtaaatccggagacttcagctgtggtggtcgcgtgaaccgctgcattcctcagttttggcgctgtgatgggcaggtggattgtgataatgggtcggacgaacaaggttgcccacctaagacttgctcgcaagatgaatttagatgccatgacggtaagtgtatttccagacagttcgtgtgcgacagcgatcgagactgccttgacggctcggatgaagcctcgtgcccagtgctgacttgtggtcctgcctccttccagtgtaactcatcgacctgtatccctcaactgtgggcatgtgataacgatccagattgtgaagatggatctgatgaatggccacagcggtgtagaggactgtacgtttttcaaggtgattcgagcccctgttcagcatttgagttccattgtcttagcggtgagtgtattcattcgagctggcgttgcgatggaggcccagattgcaaagataagtccgacgaagagaattgcgcagtcgcaacttgtcgcccggacgaattccaatgttcagacggtaactgtattcacggctcaagacaatgtgatagagagtacgattgcaaggatatgtcggatgaggtgggctgtgtgaacgtgactctgtgcgaaggcccgaacaagttcaaatgtcacagcggcgaatgcattacgctggataaggtgtgcaacatggcacgggattgtcgcgattggtccgatgaacccatcaaggaatgcgggacggcagcttgtcttgataacaacggaggctgcagccacgtgtgtaatgcgctgaaaattggagcagaatgtctgtgtccagatggatttcagctggtcgctcaacgacgctgtgaagatatcgatgaatgtcaagatccagacacctgtagtcaactgtgtgttaatctggagggcggctacaagtgtcagtgcgaagaaggatttcagctcgaccctcatactaaggcatgcaaggcggtgggttccatcgcatacctcttctttactaaccggcatgaagtgcgcaagatgactctggacagaagcgaatacacctccctgattccaaatctgaggaacgtcgtggcactggatactgaagtggcatccaatcggatttactggtctgatctgtctcaacgaatgatctgctccacgcagctcgacagagcacatggggtttcttcctatgatacggtgatttcgagggatatccaagctcctgatgggctggctgtcgattggatacattcaaacatctactggaccgatagcgttctcgggactgtgagcgtggcagataccaagggtgtgaaacgcaaaacgctcttcagggagaatggctcgaaaccaagagccattgtcgtcgatcctgtgcatggattcatgtactggacggactggggtactcccgctaaaatcaaaaagggcggactgaatggagtggacatctactcgcttgtcaccgagaatatccagtggccaaatgggattacccttgaccttctttccggtcgcctctactgggtggatagcaagctgcattcaatctcgtccatagatgtgaacggtggcaaccgtaagacgattcttgaggacgagaagcggctggcgcaccctttctcacttgcagtgttcgaggataaagtgttttggaccgacataatcaacgaggccatcttttccgcgaatcggttgactggtagcgacgtgaatctcctcgccgaaaacctgctttcgccggaggacatggtcttgtttcataacctgactcaacctcggggagtgaattggtgtgaacgcactactctttccaacgggggatgccaatacctctgtttgccagccccacagataaacccgcattcgccgaagtttacttgcgcttgtcccgatggtatgctgctggcgagagatatgaggtcgtgtctcacggaagcagaagcagcagtcgcaacccaggaaacctcaaccgtgaggctgaaggtgagcagcacggcagtgagaacccagcataccacgactaggcctgtgcctgacacgtcgaggctgccaggtgccaccccaggtttgaccactgttgaaatagttacgatgtcccaccaagccttgggggatgttgccggccgcggtaacgagaagaagccctcatccgtgcgggcactttccatagtactccctattgtgctgttggtctttctgtgtctcggtgtttttcttctctggaaaaactggcgtcttaagaacattaactcgatcaacttcgataatcctgtgtatcaaaagaccaccgaagatgaagtgcacatttgtcacaatcaggatggctacagctacccttcgcggcaaatggtcagcctcgaggacgatgtcgca

SEQ ID NO: 713 - DNA, 2580 bp, Artificial Sequence
  Description of Artificial Sequence: Synthetic Transcript Sequence
atgggaccctggggatggaaattgcgttggacagtggcactcctcctcgcagctgctggtacagccgtgggggaccgttgcgagcgtaacgaatttcagtgccaagatggaaagtgcatttcctataaatgggtgtgcgatggcagcgccgagtgtcaggacggctcagatgagagccaggagacctgcctgagtgttacctgcaagagcggagattttagttgcggaggacgcgttaataggtgcattccgcaattctggcggtgcgacggacaggtcgactgtgacaacggatctgatgagcagggatgcccacccaaaacctgtagccaggacgaatttcgctgtcacgatggaaagtgtatctctcgacagtttgtttgtgattcagatagggactgcctggatggtagcgatgaagccagttgtccggtgctcacttgcgggcccgcaagcttccagtgcaatagctcaacctgtattccacagttgtgggcttgtgacaatgacccagattgtgaagacggctccgatgagtggcctcagaggtgccgtgggctgtacgtcttccagggagatagcagcccatgtagtgcattcgagtttcattgcctttccggcgagtgcatccattcctcttggaggtgcgatgggggcccagactgcaaagataagtcagatgaagagaactgcgctgtcgccacttgcaggccagatgaatttcagtgttcagacggcaattgcatccatggatctcggcaatgcgacagggagtatgattgtaaagatatgtcagacgaagtgggatgcgtaaatgtcactctatgtgaaggacctaataaattcaagtgtcacagcggggaatgtataaccctagacaaagtgtgcaacatggcaagggactgccgggattggtctgacgagcctataaaggaatgcggcaccgcagcatgtctcgacaacaatggcggatgttcacatgtgtgcaatgcgttgaagatcggggcggagtgcctgtgcccagacggattccagttagtggcccagcgccgctgcgaggacatcgatgagtgtcaggatcctgacacctgctcccagctgtgcgtcaatctcgaaggaggctataagtgccagtgtgaggagggattccagctggatccccatacaaaggcttgcaaagcagtgggatccatcgcgtacttgttcttcactaatcgccatgaagttcgcaagatgactcttgaccggtcagagtatacgagtctcatccctaatctcaggaacgttgtcgcactggatacagaggtggcttctaacagaatatattggtcggacctgtctcagaggatgatctgcagtacgcagttagacagggcccacggagtgtcaagctacgataccgttatcagcagagacatccaggctcctgatggcctggcagttgactggattcacagcaacatctattggactgatagtgtcctgggaaccgtcagcgtggccgacaccaagggcgtgaaaaggaagactctgtttagagagaatggctcaaagccccgcgcaatcgttgtggacccagtgcatggcttcatgtactggactgattggggaactcctgcaaaaatcaaaaaaggaggactgaatggcgttgatatttacagcctcgtcaccgaaaatatccagtggcctaatggcatcactctagacctactgagtggccgcctttactgggttgacagcaaattgcactccatcagcagcatcgacgtgaatggtggaaacagaaagaccatcctagaagacgaaaagcgtctggcccatccctttagcctggctgtatttgaagataaggtgttttggacagacatcatcaacgaagccattttctcagcgaatcgcctcacgggctcggatgttaacctgctcgcagagaatttactgtcccccgaagacatggtgttatttcacaacctaacacagcctaggggtgttaattggtgcgaacgtacaaccttgagtaacggtggatgccaatacctgtgtcttccagcacctcaaatcaaccctcatagcccaaaatttacctgcgcctgccccgacggaatgctccttgcccgtgacatgcgctcatgcttgactgaggccgaagccgctgttgccacccaagagactagcacagttaggctgaaggtgtcttccactgccgtcagaactcagcatacaaccactcggcccgttccagacaccagtaggcttcctggagctactccaggcctcactaccgtggaaatagtaactatgagccatcaagccctgggcgatgtggctggaaggggtaacgaaaagaaaccatctagtgttcgagccctcagcattgttttgccgatagtacttctggtgtttctctgcctgggcgtttttctgctttggaaaaattggagattgaaaaacatcaacagtatcaacttcgacaatccggtttaccaaaagaccaccgaagatgaagtgcatatttgccacaatcaagatggttattcttatccaagcagacagatggttagcctggaggatgacgttgca

SEQ ID NO: 714 - DNA, 2580 bp, Artificial Sequence
  Description of Artificial Sequence: Synthetic Transcript Sequence
atgggaccgtggggttggaagctgaggtggactgtggctctcctcctggccgcagctggaaccgcggtgggagacagatgcgagaggaacgagttccagtgccaggacgggaagtgcatctcttacaagtgggtgtgcgatgggtccgcagaatgccaagatggctccgatgagagccaagaaacctgcctgtcggtgacctgcaaatccggcgacttctcatgcggcggacgggtgaaccgctgtatcccacagttctggcggtgcgacggtcaagtggactgcgataatggctcggatgaacaaggatgtccgccaaagacttgcagccaggacgagttcagatgtcacgacgggaagtgtatctcccgccaattcgtgtgcgattcagacagagactgcctggacgggagcgacgaagcctcgtgtccggtgctcacctgtggaccggcctcattccagtgcaactcctcgacctgtatcccgcagctgtgggcttgcgataacgacccagattgtgaggatggttcggatgagtggccgcaacggtgccggggcctgtacgtctttcagggagactcatcaccatgctcagcattcgagttccactgcctgtccggtgaatgtattcactcatcatggaggtgcgacggaggcccggactgcaaggacaagtcggatgaagagaactgcgccgtcgcaacgtgccggcctgacgaattccaatgctcagatggaaattgcatccatggaagccgtcagtgcgacagggaatatgactgcaaggatatgtcggatgaggtcggatgcgtgaacgtgactctgtgtgaggggccaaataagttcaagtgccactccggggagtgtatcactcttgacaaagtctgtaacatggcccgggactgccgggattggagcgacgaaccgatcaaagaatgtggaactgctgcctgtctggacaacaatggcgggtgctcgcacgtctgcaatgcacttaagattggggcggaatgcctctgcccggacggattccagctggtggctcagcgccggtgtgaggacatcgacgaatgccaggatccggacacctgctcccagctgtgcgtcaatctggagggaggatacaagtgccagtgtgaagagggtttccaactggacccgcatactaaggcgtgcaaggccgtcggttccatcgcttacctcttcttcaccaatcgccacgaagtgagaaagatgactctcgaccggagcgaatacacttcgctcatcccgaacctccggaacgtggtcgccctggacactgaagtggcgtcaaaccgaatctactggtctgatctgtcccaacggatgatctgctcgactcaactggaccgcgcgcacggcgtcagcagctacgatactgttataagccgcgatatccaggccccggatggcctggctgtcgactggatccactccaacatctactggacggattcagtgctgggaactgtgtcggtggctgacactaagggcgtgaagcggaaaacgctctttcgcgagaatggcagcaagccgcgcgcaatcgtggttgacccagttcatggcttcatgtactggactgactggggaactccggctaagatcaagaagggaggcctcaacggggtcgacatctatagcctggtgacggaaaacatccagtggccaaacggaatcactctggacctcctgtcgggcagattgtattgggtggactcgaaacttcattcaatctccagcatcgatgtcaacggtggaaatagaaagactatcctggaagatgagaagcgcctggcgcatccattctcattggccgtgttcgaggataaggtcttttggaccgacattatcaatgaagcgatcttctcagccaaccgcctgaccggatcagatgtcaatttgctcgccgagaacctcctgtcgccggaggacatggtgctgttccataatctcactcaacctcgcggcgtgaactggtgcgaacggacgactctgagcaacggaggatgccagtacttgtgtctccctgcccctcagattaatccgcacagcccgaagttcacctgcgcatgtccggatggaatgctcctggctcgggatatgcgctcctgtctgaccgaagccgaagctgccgtggccacccaggagacttctacggtgagactcaaggtgtcgtcgaccgccgtccgcactcagcataccacgaccaggcccgtgcccgacactagccgcctgccaggagctacccctggtctgactactgtggagatcgttactatgtctcaccaggcgttgggagacgtcgcgggacggggcaacgaaaagaagccttcctcagtgcgagcactttcaatcgtgttgcctatcgtgctgctggttttcctgtgcctgggggtgttcctgctgtggaagaattggcggttgaagaacataaactctatcaacttcgacaaccccgtgtaccagaaaaccaccgaagatgaggtgcatatctgccataatcaggatggctactcgtacccctcccgccagatggtgtcgctggaagatgacgttgct

SEQ ID NO: 715 - DNA, 2580 bp, Artificial Sequence
  Description of Artificial Sequence: Synthetic Transcript Sequence
atgggaccatggggctggaaactgcggtggactgtcgcacttcttctggccgcagcaggaaccgccgttggagatcgttgcgaacgcaatgagttccagtgtcaagacggcaaatgtatatcatacaagtgggtgtgtgatggttcagcagagtgccaggacgggagcgatgagtcacaggaaacatgcttgtctgttacgtgcaaaagtggggatttttcctgcggcgggagagtcaaccgctgcatccctcagttttggcgctgtgatgggcaagtagattgcgacaacgggagtgatgaacaggggtgcccacctaagacctgttctcaggacgagtttcggtgtcacgacggcaaatgtatatctcgccagtttgtttgtgacagcgaccgggattgcctggacgggtcggacgaggcctcatgtcccgtgctgacctgcggtcccgcctccttccagtgtaacagcagtacatgcattcctcaactctgggcgtgtgacaacgaccctgattgtgaagatggaagtgatgagtggcctcagcggtgtagaggcctctatgtgtttcagggggatagcagcccctgtagcgctttcgaatttcactgcctttctggcgagtgtattcacagtagctggcggtgtgacggggggcctgattgcaaggacaagtctgacgaagagaattgcgctgttgccacgtgccgcccagacgaatttcagtgtagtgacggaaattgcattcacggttcaaggcagtgcgatcgtgagtatgactgtaaagatatgtccgatgaggtggggtgcgtaaatgtcacactgtgcgaaggcccaaacaaattcaaatgccatagcggcgaatgcatcacattggacaaagtctgcaatatggccagggattgtagagactggtcggatgagccaatcaaggaatgcggaaccgctgcgtgcctggataacaatgggggctgttcgcacgtttgcaacgcattgaaaatcggagcggaatgtctgtgcccagatgggttccagctagtggcacagcgtaggtgtgaggacatcgacgagtgtcaggaccccgacacctgtagccagttgtgtgtgaacctcgagggtggatacaaatgccaatgcgaggagggcttccaactggatccccacacaaaggcttgtaaagctgtgggcagcatcgcctacctgtttttcacaaatcggcatgaggtgaggaagatgacccttgatagatctgagtacactagcttgattccaaatctaaggaacgtcgtagcattggacacagaggtagcgagcaaccgcatttactggtctgacctgagccagcgcatgatttgctcgacgcagctggatagggcgcatggggtctcctcatacgatacagtgatttctagagacatccaagctcctgatggcctggccgtggattggattcattctaacatttactggacagactctgtgctgggcacggtgtcagtggccgatactaagggtgtcaagcggaagactctcttccgcgagaacggaagtaagccgagggccatcgtggtcgaccctgtccacggttttatgtactggacagactggggaactccagctaagatcaagaagggcgggctcaacggggtcgacatctattcactggtgacagagaatattcagtggcccaatgggatcactctggatctgctaagtggccgattgtactgggtcgactctaagctgcatagtatcagcagcattgatgtgaacggtggaaacagaaagacaattctggaagatgagaaaagactcgcacatccattctctctggccgtgtttgaagacaaggtgttctggacggatattatcaacgaagccattttttccgcgaaccgactgacaggctcggatgtaaatctactagccgagaatctgctgtcccccgaagacatggttttgtttcacaatctgactcagcccagaggtgtaaactggtgtgagaggaccacgctgagcaatgggggttgccaatatctgtgccttcccgctccgcagattaatccccactccccaaagtttacctgcgcctgcccagacggcatgctactggcccgtgacatgaggagctgccttacagaagcagaggccgctgtggcgacccaggagacctccaccgtccgcctgaaggtcagttctaccgccgtccgcacgcagcatacaaccacgagacccgtgcctgacacatctaggctcccaggggccacccccggtctaactaccgtcgaaattgtaaccatgtcccatcaagccctgggcgacgtggccggtagggggaacgaaaaaaagccatcatccgtgagagccctgtctatcgttttgccgatcgtcttactggtctttctgtgtttgggagtcttcctcctgtggaagaactggcgactaaagaacatcaactcaattaatttcgataatcccgtttaccaaaagaccactgaggatgaagtgcacatctgtcacaaccaggacgggtactcatatcccagtaggcagatggtctcactggaagatgatgtcgcg

SEQ ID NO: 716 - DNA, 2580 bp, Artificial Sequence
  Description of Artificial Sequence: Synthetic Transcript Sequence
atgggaccatggggttggaagctgcgctggaccgtggcgctcctgctcgcggctgccggaacggcagtgggagacagatgcgaacgaaatgagttccagtgccaagacggaaaatgtatttcttacaaatgggtgtgcgatggatcggccgagtgccaggatggaagcgacgagtcacaagagacttgcctttcggtgacgtgtaagtccggtgacttttcatgtggtggacgggtgaacagatgtatcccacaattttggagatgtgatggacaggtcgactgtgacaacggatcagacgagcagggatgcccacccaagacttgttcgcaggacgaattcagatgccacgacggcaaatgcatctcacgccagtttgtttgcgactccgaccgggactgtctcgacggaagtgacgaggcctcctgcccggtcctgacctgcggtcccgcgagcttccaatgcaacagctccacttgcatcccacagctctgggcctgcgacaatgacccggattgcgaggatgggtcggacgagtggccgcagcgctgtcggggactgtacgtctttcagggtgactccagcccgtgctcagcattcgaattccactgcttgtcgggagaatgcatccactcatcctggcggtgcgacggcggccctgattgcaaggacaaatccgatgaagaaaactgcgctgtcgcgacgtgccgccctgacgaattccagtgctcggacggtaattgcatccatggaagtcgacagtgtgacagggaatacgactgtaaggatatgtcagacgaggtgggttgcgtcaacgtgactctttgcgaaggaccgaataagttcaagtgccattccggcgaatgtatcacccttgataaggtgtgcaacatggcgagagactgtagggattggtcagacgaaccgattaaagagtgcggcactgctgcctgtctcgacaacaacggcggatgttcacacgtgtgcaacgcgctgaagattggagccgaatgcctgtgccctgacggttttcaacttgtggcccagagacggtgtgaggatatcgatgagtgtcaggacccggatacctgttctcaactctgcgtgaacctggaaggaggctacaagtgccaatgcgaagagggcttccaactggatccacacactaaggcctgcaaagcagtaggctcgatcgcctacctcttcttcaccaaccgccacgaggtccgaaagatgactctggaccggtcggaatatacgtcactgatcccgaatctgcggaacgtggttgccctggacaccgaggtcgcctccaatcgcatctactggtcggatctttcccaacgcatgatttgctcaactcagctcgaccgcgcccatggcgtgtcgtcctatgatactgtgatttcgagggatatccaggctcccgacgggctcgcagtggactggatccactctaatatctactggaccgactccgtgctgggaactgtcagtgtcgccgacaccaaaggagtgaagaggaaaactctgttccgggagaatgggtcgaagccgcgcgccattgtggttgacccagtgcacggcttcatgtactggactgactgggggactccggcgaagatcaagaagggaggccttaacggagttgacatttactccctcgtgaccgaaaacatacagtggcctaacggaatcaccctcgatctgttgtcggggagactgtactgggttgactcgaaactgcattcgatctcatccatcgacgtgaatggcggcaaccgcaagaccatcctggaagatgagaaacggctggcgcatccattttcgctggcagtgtttgaggataaggtcttttggaccgacatcattaatgaagccatcttctcggccaatcggctgaccggatccgacgtcaacctgctggccgaaaacctgctgagcccagaagatatggtgctcttccacaatctgactcaaccacgcggtgtcaattggtgcgagagaactactctcagcaacggtggctgccaatacctttgcctgccagctccgcagatcaacccgcattcgccaaagtttacgtgcgcttgcccggatgggatgctgctggctcgcgacatgaggtcctgcctgaccgaagcggaggccgccgtggccacccaggaaacttccaccgtgagactgaaggttagttctacggccgtgcggacccagcacaccactacccgccccgttccggatacgtccaggctgccgggtgcaactcctggactcacgaccgtcgaaatcgtcaccatgtcgcatcaagcactcggagacgtggcaggaagagggaatgagaagaagccatcctcagtgcgcgccctgtcaatcgtgctgccgatcgtgctcctcgtgtttctttgtctcggtgttttcttgctgtggaaaaactggcgactgaaaaacatcaactccattaacttcgacaatccggtgtaccaaaagaccaccgaagatgaggtccacatctgccacaaccaggatgggtactcatacccgtcgcgccaaatggtgtcgcttgaggacgacgtggcc

SEQ ID NO: 717 - DNA, 2580 bp, Artificial Sequence
  Description of Artificial Sequence: Synthetic Transcript Sequence
atgggcccctggggatggaaattgcgctggaccgtggccctattgctggctgccgccggaacagctgtaggggacaggtgcgagaggaatgaatttcaatgccaggatggtaaatgtatcagttacaagtgggtttgcgacggttctgccgaatgccaagacggcagtgacgaatcacaggagacttgtttgtccgtcacgtgtaagagcggtgacttttcctgcggcggccgagtgaacaggtgtatcccccagttttggcggtgcgatgggcaggtggattgtgacaacggaagtgatgagcagggatgcccgccaaaaacctgttcccaggatgagtttcgctgccatgatgggaagtgcatttccaggcagtttgtgtgcgattccgaccgtgattgcttagatggcagcgatgaggctagctgcccggtgctgacatgcggacctgcgtcttttcagtgtaatagctctacatgcatcccccagctctgggcgtgcgataacgaccctgactgcgaggacggatctgacgaatggcctcagagatgtcggggattgtatgtgttccagggtgacagctcaccctgtagtgcctttgagtttcattgcctgtctggagaatgtatacactcatcatggaggtgtgatgggggccccgactgtaaggataaatccgacgaggaaaactgcgctgtcgccacttgtaggcctgatgagttccagtgttcagacgggaactgtattcacggatcacgccagtgcgatcgggaatatgactgcaaagacatgagcgatgaggtggggtgtgtgaacgtcacgctgtgcgagggccctaacaagtttaagtgccactccggcgagtgtattacattggacaaagtgtgtaatatggcccgcgactgccgggactggtctgacgagcccatcaaagaatgcggtactgctgcgtgcttggacaacaacggcgggtgttcccacgtttgcaatgccctgaaaattggcgccgaatgcctctgtcccgacggctttcagctcgttgcgcagcggaggtgtgaggatatagacgagtgccaggaccctgacacctgttcacagctgtgtgtgaatttggaggggggctacaaatgtcagtgtgaggaaggatttcaattagaccctcacacaaaagcatgcaaagctgtgggaagcatcgcatatttattctttacaaatcgccatgaagtgcgcaaaatgactttggaccgtagcgagtacacatccctgattccgaatctgcgaaacgtggtggccctagataccgaggtagcaagcaaccgaatctattggagcgatctatctcagagaatgatctgttctactcagctcgatcgggcacatggcgtctcgtcatatgacacagtcatctccagagacatacaggccccagatggcttggcagtggattggatacattcgaacatctactggactgatagcgtgttggggacagtgtccgtcgctgataccaaaggggtcaagcggaagaccctgtttcgtgagaacggtagcaaaccgagggctatcgtcgtggacccagtgcatggctttatgtattggaccgactggggaacccctgcaaagattaaaaagggaggcctgaatggtgtcgatatttattcactggttacagaaaatatacagtggccaaacggcataacattggatcttctgtcagggcgactgtactgggtggacagtaagctccatagtatctccagtatagatgtgaatggtgggaaccgaaagactatccttgaggacgagaaacggctggcccatcctttttccctggctgtcttcgaagacaaagtattctggaccgacattataaacgaggccatctttagcgccaatcgacttaccggctccgacgttaatctgttggcggagaacctgctcagccctgaggatatggtgttatttcataatttgacgcagccccgtggcgtgaactggtgtgagcgcacaaccctgtcaaatggcggctgtcagtacctctgccttcctgcacctcaaataaacccacattctcccaaatttacttgcgcttgcccagacgggatgttgttggctcgggacatgcgatcttgtctgacagaggcagaagccgcggtagctactcaggagaccagtacagttaggctgaaagtatcctctactgcggtccgcactcagcatacgacaacccggcctgtacccgacacgagccgcctgccgggagctacgcccggactgactacggtagaaatcgtgactatgagtcatcaggcgttgggcgatgtcgccggacgagggaacgaaaaaaagccatcttcagtgcgggcactaagtatagtgttaccgatcgtgctgctcgtttttctttgtctgggagtttttcttctgtggaaaaattggcgtctgaaaaacatcaactctataaatttcgacaaccctgtgtatcagaagactacagaggatgaagtgcatatctgtcacaaccaagatggctactcctatccgagccgtcagatggtcagccttgaggatgacgtcgca

SEQ ID NO: 718 - DNA, 2580 bp, Artificial Sequence
  Description of Artificial Sequence: Synthetic Transcript Sequence
atgggaccctgggggtggaagcttcgttggacagtcgccctgctgctggcagctgctgggacagctgtcggcgacagatgcgaacggaacgagtttcagtgccaagacggcaagtgcatatcctataaatgggtctgtgatggcagtgccgagtgccaggacggatccgatgagagtcaggaaacgtgcctgtccgtcacctgcaaaagcggggattttagctgtgggggaagagtgaataggtgcatcccccaattctggaggtgcgacggacaggttgattgcgacaacgggagcgatgaacagggatgcccgccgaagacttgcagccaggatgaattccggtgccatgacggtaagtgtatctcaaggcagtttgtctgtgattcagatagggactgtctcgatggttcagacgaagcatcctgcccagtcctgacatgcgggcctgccagtttccagtgcaattccagcacttgcatcccccagctttgggcctgtgacaatgatccagattgcgaggatgggagtgatgagtggccccaaagatgtaggggcctgtacgtctttcaaggcgattcaagtccttgttctgcattcgagtttcattgtttgagtggagagtgcattcactcctcttggcggtgtgacggaggccccgattgtaaagacaaaagcgacgaggaaaactgtgctgtcgccacatgcaggcccgacgagtttcagtgtagcgatggaaactgtatccatgggagccgccagtgcgacagggagtatgactgtaaggacatgagcgatgaggttgggtgcgtgaacgtgaccctttgcgagggcccgaataagttcaaatgtcactccggtgaatgcatcaccttagataaagtgtgcaacatggctcgcgactgtcgggattggtctgacgagcctattaaggagtgcggcacggccgcttgcctggataacaatggcggatgttcacatgtatgtaatgctttaaaaatcggtgcggaatgtttgtgtcccgatggattccagcttgtagcccagcgaaggtgcgaagacatagacgagtgccaggatcccgatacttgctcacagttgtgcgttaacctcgagggcggctataagtgtcagtgtgaggaaggcttccaacttgacccccacaccaaggcatgtaaggccgtcggtagcatcgcttacttgttctttaccaatcgccacgaggtcagaaagatgacgctcgaccggtcagaatacacatccctgattcccaaccttcggaacgtggtggccctggacactgaagtggcatccaatcggatctactggtctgatctcagtcagcgcatgatctgtagtacacagcttgatcgggcccatggagtcagttcttacgatacagtaatatccagggacattcaggcccctgacgggttggccgtggattggatccactccaatatctattggacagactcagttttaggaacagtgagcgtggcggacacaaagggcgtcaagcgtaagacgctttttcgcgagaacggttctaaacctagggccatcgtcgtcgatcctgtgcatggcttcatgtattggacagattggggaactcccgccaaaattaaaaagggcgggctgaatggcgtagacatctatagtctggttacggagaacatccagtggcctaatgggattacgctcgatttgctatccggcagactgtattgggttgatagtaagttacatagcatatctagtatagatgtgaacggaggaaatcgaaagactatcctggaggatgaaaagaggttggctcacccattcagcctggccgtttttgaagataaggtcttttggaccgacattatcaacgaagctattttttccgccaataggctgacaggtagcgacgtcaacctgctcgccgaaaatttgctgtcacctgaggacatggtcttgttccacaacctcacacagccccgtggcgttaattggtgtgagcgcaccacactctccaatgggggctgtcaatacctctgtctgcccgcccctcagatcaatccccactcacccaagtttacctgcgcctgccctgacgggatgttactggccagagatatgcgatcatgcctgaccgaggcggaagcagccgttgccacccaagaaacttccaccgtgcggctcaaggtaagttcaacagctgtgcgcacccaacacacaaccactcgaccagtacccgacacctcgaggttaccaggtgctactccggggctcaccaccgtagagattgtgactatgagccaccaggcgctcggggacgtggccgggcgggggaatgaaaaaaaaccaagtagcgtacgtgctctttcaatcgtcttgccgattgtcctgctggtctttttgtgtttgggagtgttccttctgtggaagaactggcgcctgaaaaatatcaattccattaactttgataatccagtctaccagaagacaacagaagatgaggtccatatttgtcacaaccaggatgggtactcctacccgagcagacagatggtcagtcttgaggacgacgtggcc

SEQ ID NO: 719 - protein, 40 aa, Homo sapiens
GTNECLDNNGGCSHVCNDLKIGYECLCPDGFQLVAQRRCE

SEQ ID NO: 720 - protein, 50 aa, Homo sapiens
KNWRLKNINSINFDNPVYQKTTEDEVHICHNQDGYSYPSRQMVSLEDDVA

SEQ ID NO: 721 - protein, 8 aa, Homo sapiens
NFDNPVYQ

SEQ ID NO: 722 - protein, 10 aa, Homo sapiens
NQDGYSYPSR

SEQ ID NO: 723 - protein, 6 aa, Homo sapiens
LEDDVA

SEQ ID NO: 724 - protein, 862 aa, Artificial Sequence
  Description of Artificial Sequence: LDLR protein
MSTADLMRRWVIALLLAAAGVAAEDSCSRNEFQCRDGKCIASKWVCDGSPECPDGSDESPETCMSVTCQSNQFSCGGRVSRCIPDSWRCDGQVDCENDSDEQGCPPKTCSQDDFRCQDGKCISPQFVCDGDRDCLDGSDEAHCQATTCGPAHFRCNSSICIPSLWACDGDVDCVDGSDEWPQNCQGRDTASKGVSSPCSSLEFHCGSSECIHRSWVCDGEADCKDKSDEEHCAVATCRPDEFQCADGSCIHGSRQCDREHDCKDMSDELGCVNVTQCDGPNKFKCHSGECISLDKVCDSARDCQDWSDEPIKECKTAECLDNNGGCSHICKDLKIGSECLCPSGFRLVDLHRCEDIDECQEPDTCSQLCVNLEGSYKCECQAGFHMDPHTRVCKAVGSIGYLLFTNRHEVRKMTLDRSEYTSLLPNLKNVVALDTEVTNNRIYWSDLSQKKIYSALMDQAPNLSYDTIISEDLHAPDGLAVDWIHRNIYWTDSVPGSVSVADTKGVKRRTLFQEAGSRPRAIVVDPVHGFMYWTDWGTPAKIKKGGLNGVDIHSLVTENIQWPNGITLDLSSGRLYWVDSKLHSISSIDVNGGNRKTILEDENRLAHPFSLAIYEDKVYWTDVINEAIFSANRLTGSDVNLVAENLLSPEDIVLFHKVTQPRGVNWCETTALLPNGGCQYLCLPAPQIGPHSPKFTCACPDGMLLAKDMRSCLTEVDTVLTTQGTSAVRPVVTASATRPPKHSEDLSAPSTPRQPVDTPGLSTVASVTVSHQVQGDMAGRGNEEQPHGMRFLSIFFPIALVALLVLGAVLLWRNWRLKNINSINFDNPVYQRTTEDELHIARSQDGYTYPSRQMVSLEDDVA

SEQ ID NO: 725 - protein, 862 aa, Artificial Sequence
  Description of Artificial Sequence: LDLR protein
MSTADLMRRWVIALLLAAAGVAAEDSCSRNEFQCRDGKCIASKWVCDGSPECPDGSDESPETCMSVTCQSNQFSCGGRVSRCIPDSWRCDGQVDCENDSDEQGCPPKTCSQDDFRCQDGKCISPQFVCDGDRDCLDGSDEAHCQATTCGPAHFRCNSSICIPSLWACDGDVDCVDGSDEWPQNCQGRDTASKGVSSPCSSLEFHCGSSECIHRSWVCDGEADCKDKSDEEHCAVATCRPDEFQCADGSCIHGSRQCDREHDCKDMSDELGCVNVTQCDGPNKFKCHSGECISLDKVCDSARDCQDWSDEPIKECKTAECLDNNGGCSHICKDLKIGSECLCPSGFRLVDLHRCEDIDECQEPDTCSQLCVNLEGSYKCECQAGFHMDPHTRVCKAVGSIGYLLFTNRHEVRKMTLDRSEYTSLLPNLKNVVALDTEVTNNRIYWSDLSQKKIYSALMDQAPNLSYDTIISEDLHAPDGLAVDWIHRNIYWTDSVPGSVSVADTKGVKRRTLFQEAGSRPRAIVVDPVHGFMYWTDWGTPAKIKKGGLNGVDIHSLVTENIQWPNGITLDLSSGRLYWVDSKLHSISSIDVNGGNRKTILEDENRLAHPFSLAIYEDKVYWTDVINEAIFSANRLTGSDVNLVAENLLSPEDIVLFHKVTQPRGVNWCETTALLPNGGCQYLCLPAPQIGPHSPKFTCACPDGMLLAKDMRSCLTEVDTVLTTQGTSAVRPVVTASATRPPKHSEDLSAPSTPRQPVDTPGLSTVASVTVSHQVQGDMAGRGNEEQPHGMRFLSIFFPIALVALLVLGAVLLWRNWRLRNINSINFDNPVYQRTTEDELHIARSQDGYTYPSRQMVSLEDDVA

SEQ ID NO: 726 - protein, 862 aa, Artificial Sequence
  Description of Artificial Sequence: LDLR protein
MSTADLMRRWVIALLLAAAGVAAEDSCSRNEFQCRDGKCIASKWVCDGSPECPDGSDESPETCMSVTCQSNQFSCGGRVSRCIPDSWRCDGQVDCENDSDEQGCPPKTCSQDDFRCQDGKCISPQFVCDGDRDCLDGSDEAHCQATTCGPAHFRCNSSICIPSLWACDGDVDCVDGSDEWPQNCQGRDTASKGVSSPCSSLEFHCGSSECIHRSWVCDGEADCKDKSDEEHCAVATCRPDEFQCADGSCIHGSRQCDREHDCKDMSDELGCVNVTQCDGPNKFKCHSGECISLDKVCDSARDCQDWSDEPIKECKTNECLDNNGGCSHICKDLKIGSECDCPSGFRLVDLHRCEDIDECQEPDTCSQLCVNLEGSYKCECQAGFHMDPHTRVCKAVGSIGYLLFTNRHEVRKMTLDRSEYTSLLPNLKNVVALDTEVTNNRIYWSDLSQKKIYSALMDQAPNLSYDTIISEDLHAPDGLAVDWIHRNIYWTDSVPGSVSVADTKGVKRRTLFQEAGSRPRAIVVDPVHGFMYWTDWGTPAKIKKGGLNGVDIHSLVTENIQWPNGITLDLSSGRLYWVDSKLHSISSIDVNGGNRKTILEDENRLAHPFSLAIYEDKVYWTDVINEAIFSANRLTGSDVNLVAENLLSPEDIVLFHKVTQPRGVNWCETTALLPNGGCQYLCLPAPQIGPHSPKFTCACPDGMLLAKDMRSCLTEVDTVLTTQGTSAVRPVVTASATRPPKHSEDLSAPSTPRQPVDTPGLSTVASVTVSHQVQGDMAGRGNEEQPHGMRFLSIFFPIALVALLVLGAVLLWRNWRLKNINSINFDNPVYQRTTEDELHIARSQDGYTYPSRQMVSLEDDVA

SEQ ID NO: 727 - protein, 862 aa, Artificial Sequence
  Description of Artificial Sequence: LDLR protein
MSTADLMRRWVIALLLAAAGVAAEDSCSRNEFQCRDGKCIASKWVCDGSPECPDGSDESPETCMSVTCQSNQFSCGGRVSRCIPDSWRCDGQVDCENDSDEQGCPPKTCSQDDFRCQDGKCISPQFVCDGDRDCLDGSDEAHCQATTCGPAHFRCNSSICIPSLWACDGDVDCVDGSDEWPQNCQGRDTASKGVSSPCSSLEFHCGSSECIHRSWVCDGEADCKDKSDEEHCAVATCRPDEFQCADGSCIHGSRQCDREHDCKDMSDELGCVNVTQCDGPNKFKCHSGECISLDKVCDSARDCQDWSDEPIKECKTNECLDNNGGCSHICKDLKIGSECDCPSGFRLVDLHRCEDIDECQEPDTCSQLCVNLEGSYKCECQAGFHMDPHTRVCKAVGSIGYLLFTNRHEVRKMTLDRSEYTSLLPNLKNVVALDTEVTNNRIYWSDLSQKKIYSALMDQAPNLSYDTIISEDLHAPDGLAVDWIHRNIYWTDSVPGSVSVADTKGVKRRTLFQEAGSRPRAIVVDPVHGFMYWTDWGTPAKIKKGGLNGVDIHSLVTENIQWPNGITLDLSSGRLYWVDSKLHSISSIDVNGGNRKTILEDENRLAHPFSLAIYEDKVYWTDVINEAIFSANRLTGSDVNLVAENLLSPEDIVLFHKVTQPRGVNWCETTALLPNGGCQYLCLPAPQIGPHSPKFTCACPDGMLLAKDMRSCLTEVDTVLTTQGTSAVRPVVTASATRPPKHSEDLSAPSTPRQPVDTPGLSTVASVTVSHQVQGDMAGRGNEEQPHGMRFLSIFFPIALVALLVLGAVLLWRNWRLRNINSINFDNPVYQRTTEDELHIARSQDGYTYPSRQMVSLEDDVA

SEQ ID NO: 728 - protein, 862 aa, Artificial Sequence
  Description of Artificial Sequence: LDLR protein
MSTADLMRRWVIALLLAAAGVAAEDSCSRNEFQCRDGKCIASKWVCDGSPECPDGSDESPETCMSVTCQSNQFSCGGRVSRCIPDSWRCDGQVDCENDSDEQGCPPKTCSQDDFRCQDGKCISPQFVCDGDRDCLDGSDEAHCQATTCGPAHFRCNSSICIPSLWACDGDVDCVDGSDEWPQNCQGRDTASKGVSSPCSSLEFHCGSSECIHRSWVCDGEADCKDKSDEEHCAVATCRPDEFQCADGSCIHGSRQCDREHDCKDMSDELGCVNVTQCDGPNKFKCHSGECISLDKVCDSARDCQDWSDEPIKECKTNECLDNNGGCSHICKDLKIGSECLCPSGFRLVDLHRCEDIDECQEPDTCSQLCVNLEGSYKCECQAGFHMDPHTRVCKAVGSIGYLLFTNRHEVRKMTLDRSEYTSLLPNLKNVVALDTEVTNNRIYWSDLSQKKIYSALMDQAPNLSYDTIISEDLHAPDGLAVDWIHRNIYWTDSVPGSVSVADTKGVKRRTLFQEAGSRPRAIVVDPVHGFMYWTDWGTPAKIKKGGLNGVDIHSLVTENIQWPNGITLDLSSGRLYWVDSKLHSISSIDVNGGNRKTILEDENRLAHPFSLAIYEDKVYWTDVINEAIFSANRLTGSDVNLVAENLLSPEDIVLFHKVTQPRGVNWCETTALLPNGGCQYLCLPAPQIGPHSPKFTCACPDGMLLAKDMRSCLTEVDTVLTTQGTSAVRPVVTASATRPPKHSEDLSAPSTPRQPVDTPGLSTVASVTVSHQVQGDMAGRGNEEQPHGMRFLSIFFPIALVALLVLGAVLLWRNWRLKNINSINFDNPVYQRTTEDELHIARSQDGYTYPSRQMVSLEDDVA

SEQ ID NO: 729 - protein, 862 aa, Artificial Sequence
  Description of Artificial Sequence: LDLR protein
MSTADLMRRWVIALLLAAAGVAAEDSCSRNEFQCRDGKCIASKWVCDGSPECPDGSDESPETCMSVTCQSNQFSCGGRVSRCIPDSWRCDGQVDCENDSDEQGCPPKTCSQDDFRCQDGKCISPQFVCDGDRDCLDGSDEAHCQATTCGPAHFRCNSSICIPSLWACDGDVDCVDGSDEWPQNCQGRDTASKGVSSPCSSLEFHCGSSECIHRSWVCDGEADCKDKSDEEHCAVATCRPDEFQCADGSCIHGSRQCDREHDCKDMSDELGCVNVTQCDGPNKFKCHSGECISLDKVCDSARDCQDWSDEPIKECKTNECLDNNGGCSHICKDLKIGSECLCPSGFRLVDLHRCEDIDECQEPDTCSQLCVNLEGSYKCECQAGFHMDPHTRVCKAVGSIGYLLFTNRHEVRKMTLDRSEYTSLLPNLKNVVALDTEVTNNRIYWSDLSQKKIYSALMDQAPNLSYDTIISEDLHAPDGLAVDWIHRNIYWTDSVPGSVSVADTKGVKRRTLFQEAGSRPRAIVVDPVHGFMYWTDWGTPAKIKKGGLNGVDIHSLVTENIQWPNGITLDLSSGRLYWVDSKLHSISSIDVNGGNRKTILEDENRLAHPFSLAIYEDKVYWTDVINEAIFSANRLTGSDVNLVAENLLSPEDIVLFHKVTQPRGVNWCETTALLPNGGCQYLCLPAPQIGPHSPKFTCACPDGMLLAKDMRSCLTEVDTVLTTQGTSAVRPVVTASATRPPKHSEDLSAPSTPRQPVDTPGLSTVASVTVSHQVQGDMAGRGNEEQPHGMRFLSIFFPIALVALLVLGAVLLWRNWRLRNINSINFDNPVYQRTTEDELHIARSQDGYTYPSRQMVSLEDDVA

SEQ ID NO: 730 - protein, 40 aa, Mus musculus
KTNECLDNNGGCSHICKDLKIGSECLCPSGFRLVDLHRCE

SEQ ID NO: 731 - protein, 50 aa, Mus musculus
RNWRLKNINSINFDNPVYQKTTEDELHICRSQDGYTYPSRQMVSLEDDVA

SEQ ID NO: 732 - RNA, 2758 nt, Artificial Sequence
  Description of Artificial Sequence: Synthetic Transcript Sequence
gggaaauaagagagaaaagaagaguaagaagaaauauaagagccaccaugagcaccgcggaucugaugcgucgcugggucaucgcccugcuccuggcugcugccggaguugcagcagaagacucaugcagcaggaacgaguuccaguguagagacggaaaaugcaucgcuagcaagugggugugcgauggcagccccgagugcccggauggcuccgaugaguccccagagacaugcaugucugucaccugucaguccaaucaauucagcuguggaggccgugucagccgaugcauuccugacuccuggagaugugauggacagguagacugugaaaaugacucagacgaacaaggcuguccccccaagacgugcucccaggaugacuuccgaugccaggauggcaagugcaucuccccgcaguuugugugugauggagaccgagauugccuagauggcucugaugaggcccacugccaggccaccacuuguggccccgcccacuuccgcugcaacucauccauaugcauccccagucuuugggccugcgacggggaugucgacuguguugacggcuccgaugaguggccacagaacugccagggccgagacacggccuccaaaggcguuagcagccccugcuccucccuggaguuccacugugguagcagugaguguauccaucgcagcugggucugugacggcgaggcagacugcaaggacaagucagaugaggagcacugcgcgguggccaccugccgaccugaugaauuccagugugcagauggcuccugcauucacgguagccgccagugugaccgugaacaugacugcaaggacaugagcgacgagcucggcugcgucaaugugacacagugugauggccccaacaaguucaagugucacaguggggagugcaucagcuuggacaaggugugcgacuccgcccgcgacugccaggacuggucggaugagcccaucaaggagugcaagaccgcagaguguuuggacaacaaugguggcuguucccacaucugcaaggaccucaagauuggcucugagugccugugucccagcggcuuccgguugguggaccuccacaggugugaagauauugacgagugucaggagccagacaccugcagccagcucugugugaaccuggaaggcagcuacaagugugagugccaggccggcuuccacauggacccacacaccagggucugcaaggcugugggcuccauaggcuaucugcucuucaccaaccgccacgagguccggaagaugacccuggaccgcagcgaguacaccagucugcuccccaaccugaagaaugugguggcucucgacacggaggugaccaacaauagaaucuacugguccgaccugucccaaaaaaagaucuacagcgcccugauggaccaggccccuaacuuguccuacgacaccaucaucagugaggaccugcaugccccugacgggcuggcgguagacuggauccaccgcaacaucuacuggacagauucagucccaggcagcguaucuguggcugacaccaagggcguaaagaggaggacacuguuccaagaggcaggguccagacccagagccaucguaguggacccugugcauggcuucauguacuggacagauuggggaacacccgccaagaucaagaaaggggguuugaaugguguggacauccacucacuggugaccgaaaacauccaguggccaaauggcaucacacuagaucuuuccaguggccgucucuauuggguugauuccaaacuccacucuaucuccagcaucgaugucaaugggggcaaucggaaaaccauuuuggaggaugagaaccggcuggcccaccccuucuccuuggccaucuaugaggacaaaguguauuggacagaugucauaaacgaagccauuuucagugccaaucgacucacggguucagaugugaauuugguggcugaaaaccucuuguccccggaggacauuguccuguuccacaaggucacacagccuagaggggugaacuggugugagacaacagcccuccuccccaauggugguugccaguaccugugccugcccgccccacagaucgguccccacucgcccaaauucaccugcgccugcccugauggcaugcugcuggccaaggacaugcggagcugccucacagaagucgacacuguacugaccacccaggggacauccgccguccggccuguggucaccgcaucagcuaccaggccaccgaagcacagugaggaucucucagcucccaguacuccuaggcagccuguggacaccccagggcucagcacaguggcgucagugacagugucccaccaaguccagggugacauggcuggcagagggaaugaggagcagccacaugguaugagguuccuguccaucuucuucccuauugcacugguugcccuccuuguccuuggggccguccugcuguggaggaacuggcggcugaagaacaucaacagcauaaacuuugacaacccagucuaccagcguaccacagaggacgagcuccacauugcacgaagccaggauggcuauaccuaccccucaagacagauggucagccuggaggacgauguggcaugauaauaggcuggagccucgguggccaugcuucuugccccuugggccuccccccagccccuccuccccuuccugcacccguacccccguggucuuugaauaaagucugagugggcggcucuaga

SEQ ID NO: 733 - RNA, 2758 nt, Artificial Sequence
  Description of Artificial Sequence: Synthetic Transcript Sequence
gggaaauaagagagaaaagaagaguaagaagaaauauaagagccaccaugagcaccgcggaucugaugcgucgcugggucaucgcccugcuccuggcugcugccggaguugcagcagaagacucaugcagcaggaacgaguuccaguguagagacggaaaaugcaucgcuagcaagugggugugcgauggcagccccgagugcccggauggcuccgaugaguccccagagacaugcaugucugucaccugucaguccaaucaauucagcuguggaggccgugucagccgaugcauuccugacuccuggagaugugauggacagguagacugugaaaaugacucagacgaacaaggcuguccccccaagacgugcucccaggaugacuuccgaugccaggauggcaagugcaucuccccgcaguuugugugugauggagaccgagauugccuagauggcucugaugaggcccacugccaggccaccacuuguggccccgcccacuuccgcugcaacucauccauaugcauccccagucuuugggccugcgacggggaugucgacuguguugacggcuccgaugaguggccacagaacugccagggccgagacacggccuccaaaggcguuagcagccccugcuccucccuggaguuccacugugguagcagugaguguauccaucgcagcugggucugugacggcgaggcagacugcaaggacaagucagaugaggagcacugcgcgguggccaccugccgaccugaugaauuccagugugcagauggcuccugcauucacgguagccgccagugugaccgugaacaugacugcaaggacaugagcgacgagcucggcugcgucaaugugacacagugugauggccccaacaaguucaagugucacaguggggagugcaucagcuuggacaaggugugcgacuccgcccgcgacugccaggacuggucggaugagcccaucaaggagugcaagaccaacgaguguuuggacaacaaugguggcuguucccacaucugcaaggaccucaagauuggcucugagugcgauugucccagcggcuuccgguugguggaccuccacaggugugaagauauugacgagugucaggagccagacaccugcagccagcucugugugaaccuggaaggcagcuacaagugugagugccaggccggcuuccacauggacccacacaccagggucugcaaggcugugggcuccauaggcuaucugcucuucaccaaccgccacgagguccggaagaugacccuggaccgcagcgaguacaccagucugcuccccaaccugaagaaugugguggcucucgacacggaggugaccaacaauagaaucuacugguccgaccugucccaaaaaaagaucuacagcgcccugauggaccaggccccuaacuuguccuacgacaccaucaucagugaggaccugcaugccccugacgggcuggcgguagacuggauccaccgcaacaucuacuggacagauucagucccaggcagcguaucuguggcugacaccaagggcguaaagaggaggacacuguuccaagaggcaggguccagacccagagccaucguaguggacccugugcauggcuucauguacuggacagauuggggaacacccgccaagaucaagaaaggggguuugaaugguguggacauccacucacuggugaccgaaaacauccaguggccaaauggcaucacacuagaucuuuccaguggccgucucuauuggguugauuccaaacuccacucuaucuccagcaucgaugucaaugggggcaaucggaaaaccauuuuggaggaugagaaccggcuggcccaccccuucuccuuggccaucuaugaggacaaaguguauuggacagaugucauaaacgaagccauuuucagugccaaucgacucacggguucagaugugaauuugguggcugaaaaccucuuguccccggaggacauuguccuguuccacaaggucacacagccuagaggggugaacuggugugagacaacagcccuccuccccaauggugguugccaguaccugugccugcccgccccacagaucgguccccacucgcccaaauucaccugcgccugcccugauggcaugcugcuggccaaggacaugcggagcugccucacagaagucgacacuguacugaccacccaggggacauccgccguccggccuguggucaccgcaucagcuaccaggccaccgaagcacagugaggaucucucagcucccaguacuccuaggcagccuguggacaccccagggcucagcacaguggcgucagugacagugucccaccaaguccagggugacauggcuggcagagggaaugaggagcagccacaugguaugagguuccuguccaucuucuucccuauugcacugguugcccuccuuguccuuggggccguccugcuguggaggaacuggcggcugaagaacaucaacagcauaaacuuugacaacccagucuaccagcguaccacagaggacgagcuccacauugcacgaagccaggauggcuauaccuaccccucaagacagauggucagccuggaggacgauguggcaugauaauaggcuggagccucgguggccaugcuucuugccccuugggccuccccccagccccuccuccccuuccugcacccguacccccguggucuuugaauaaagucugagugggcggcucuaga

SEQ ID NO: 734 - RNA, 2758 nt, Artificial Sequence
  Description of Artificial Sequence: Synthetic Transcript Sequence
gggaaauaagagagaaaagaagaguaagaagaaauauaagagccaccaugagcaccgcggaucugaugcgucgcugggucaucgcccugcuccuggcugcugccggaguugcagcagaagacucaugcagcaggaacgaguuccaguguagagacggaaaaugcaucgcuagcaagugggugugcgauggcagccccgagugcccggauggcuccgaugaguccccagagacaugcaugucugucaccugucaguccaaucaauucagcuguggaggccgugucagccgaugcauuccugacuccuggagaugugauggacagguagacugugaaaaugacucagacgaacaaggcuguccccccaagacgugcucccaggaugacuuccgaugccaggauggcaagugcaucuccccgcaguuugugugugauggagaccgagauugccuagauggcucugaugaggcccacugccaggccaccacuuguggccccgcccacuuccgcugcaacucauccauaugcauccccagucuuugggccugcgacggggaugucgacuguguugacggcuccgaugaguggccacagaacugccagggccgagacacggccuccaaaggcguuagcagccccugcuccucccuggaguuccacugugguagcagugaguguauccaucgcagcugggucugugacggcgaggcagacugcaaggacaagucagaugaggagcacugcgcgguggccaccugccgaccugaugaauuccagugugcagauggcuccugcauucacgguagccgccagugugaccgugaacaugacugcaaggacaugagcgacgagcucggcugcgucaaugugacacagugugauggccccaacaaguucaagugucacaguggggagugcaucagcuuggacaaggugugcgacuccgcccgcgacugccaggacuggucggaugagcccaucaaggagugcaagaccaacgaguguuuggacaacaaugguggcuguucccacaucugcaaggaccucaagauuggcucugagugccugugucccagcggcuuccgguugguggaccuccacaggugugaagauauugacgagugucaggagccagacaccugcagccagcucugugugaaccuggaaggcagcuacaagugugagugccaggccggcuuccacauggacccacacaccagggucugcaaggcugugggcuccauaggcuaucugcucuucaccaaccgccacgagguccggaagaugacccuggaccgcagcgaguacaccagucugcuccccaaccugaagaaugugguggcucucgacacggaggugaccaacaauagaaucuacugguccgaccugucccaaaaaaagaucuacagcgcccugauggaccaggccccuaacuuguccuacgacaccaucaucagugaggaccugcaugccccugacgggcuggcgguagacuggauccaccgcaacaucuacuggacagauucagucccaggcagcguaucuguggcugacaccaagggcguaaagaggaggacacuguuccaagaggcaggguccagacccagagccaucguaguggacccugugcauggcuucauguacuggacagauuggggaacacccgccaagaucaagaaaggggguuugaaugguguggacauccacucacuggugaccgaaaacauccaguggccaaauggcaucacacuagaucuuuccaguggccgucucuauuggguugauuccaaacuccacucuaucuccagcaucgaugucaaugggggcaaucggaaaaccauuuuggaggaugagaaccggcuggcccaccccuucuccuuggccaucuaugaggacaaaguguauuggacagaugucauaaacgaagccauuuucagugccaaucgacucacggguucagaugugaauuugguggcugaaaaccucuuguccccggaggacauuguccuguuccacaaggucacacagccuagaggggugaacuggugugagacaacagcccuccuccccaauggugguugccaguaccugugccugcccgccccacagaucgguccccacucgcccaaauucaccugcgccugcccugauggcaugcugcuggccaaggacaugcggagcugccucacagaagucgacacuguacugaccacccaggggacauccgccguccggccuguggucaccgcaucagcuaccaggccaccgaagcacagugaggaucucucagcucccaguacuccuaggcagccuguggacaccccagggcucagcacaguggcgucagugacagugucccaccaaguccagggugacauggcuggcagagggaaugaggagcagccacaugguaugagguuccuguccaucuucuucccuauugcacugguugcccuccuuguccuuggggccguccugcuguggaggaacuggcggcugaagaacaucaacagcauaaacuuugacaacccagucuaccagcguaccacagaggacgagcuccacauugcacgaagccaggauggcuauaccuaccccucaagacagauggucagccuggaggacgauguggcaugauaauaggcuggagccucgguggccaugcuucuugccccuugggccuccccccagccccuccuccccuuccugcacccguacccccguggucuuugaauaaagucugagugggcggcucuaga

SEQ ID NO: 735 - RNA, 2752 nt, Artificial Sequence
  Description of Artificial Sequence: Synthetic Transcript Sequence
gggaaauaagagagaaaagaagaguaagaagaaauauaagagccaccauggguccguggggcuggaagcuuagauggacagucgcgcuccuccuugcagcagcaggaacugcggucggagaucgaugcgagcgcaacgaguuccaaugccaagaugggaaguguauuucguacaagugggucugcgauggaucagcggaaugucaggacggaagcgaugagagccaagaaacaugccucucagugacaugcaagucgggagacuucucgugcggaggacgcguaaacagauguauuccacaguuuuggcgcugcgauggucagguggacugcgacaacgguucagaugaacagggauguccuccgaaaacgugcucacaagacgaguuucgcugccaugauggaaagugcauuucgcggcaguucguaugugauucggaucgggacugucuggacggcucggacgaagcgucaugcccgguacuuacuugcgggccagccucauuccaaugcaacagcucaacgugcauuccccagcugugggccugugacaaugauccugauugugaggacgguagcgacgaguggccgcagagauguagggguuuguacguauuccaaggagacucaagccccuguuccgccuuugaguuucacugccugucgggugaaugcauccacuccagcuggcgaugugauggugggcccgacugcaaagauaagagcgacgaggagaauugcgcggucgcgacgugcagacccgaugaguuccagugcuccgauggaaacugcauccacgggagccggcagugugaucgcgaguacgauuguaaagacaugucagacgaggucggaugcgugaacgucacguugugcgaggguccgaacaaguuuaagugccauucgggcgaauguauuacgcucgauaaagucugcaacauggcgcgagauuguagggauuggucagacgaacccaucaaggagugcggcacugcugaguguuuggacaauaacggcggguguucgcacgucugcaaugaucucaaaauuggguaugagugucuguguccugacggauuccagcuggucgcgcagcgcagaugcgaggacaucgacgagugccaggaccccgacacauguucgcaguugugugucaaccuugaaggaggguacaagugccagugcgaggagggauuucagcuugacccgcacacgaaagcauguaaagcggugggguccauugcguauuuguuuuucacaaacagacaugaagugcggaagaugacccuugaucgcagcgaauauacgucacugaucccuaaucuuaggaaugucguggcccuugacacggagguagcaucaaauagaaucuacugguccgaccucucacagagaaugaucuguucaacacaguuggaucgggcgcacggggugucgucguacgauacgguaauuagccgcgacauccaggcgccagacggacucgcggucgacuggauccauagcaacaucuacuggacagacuccguguugggaaccguauccguagcugacacaaagggagugaagcggaaaacucuuuuuagagagaacggcagcaaaccgagagcaaucguggucgauccggugcauggauucauguauuggaccgauuggggaacgccagccaaaaucaagaaaggcgguuugaauggggucgacaucuacucgcuggugacugagaauauucaguggccaaacgggaucaccuuggacuuguugucggggagguuguauuggguggacucaaagcuccacucgaucagcucgaucgacgugaacggcggaaauaggaaaacuauucucgaagaugagaaaagacuggcccaccccuucucgcucgcgguguucgaggacaaaguauuuuggacagacaucaucaacgaagcgaucuuuucagccaaccgccugacagggucggaugucaaucucuuggccgaaaaccuucugagcccggaagauauggucuuguuucacaauuugacccaacccagaggugugaauuggugcgaacggacgacauugucgaacggagguugccaguaucucugucucccugcaccccagauuaauccccauucacccaaguucacgugugcgugcccagacggaaugcuucuugcgagggacaugagauccugucucaccgaagcggaagcggcaguggccacacaagagacuucgacuguccgccuuaaaguguccucgacggcgguccgaacucagcauacgaccacacgacccgugcccgauaccucgcgguugcccggagcaacaccgggguugacgacaguagaaaucguaaccaugagccaccaggcacuuggagaugucgcaggcagaggcaaugagaagaaacccagcucggucagagcccucagcaucgugcugccuauugugcugcuuguguuucucuguuuggguguguucuuguuguggaagaacuggcgccuuaagaauaucaacucgauuaacuucgauaauccgguauaccagcgcaccacagaggaugaagugcauauugcccacaaccaagauggcuauucguacccguccaggcaaaugguaucacuugaggacgacguggccugauaauaggcuggagccucgguggccaugcuucuugccccuugggccuccccccagccccuccuccccuuccugcacccguacccccguggucuuugaauaaagucugagugggcggcucuaga

SEQ ID NO: 736 - RNA, 2752 nt, Artificial Sequence
  Description of Artificial Sequence: Synthetic Transcript Sequence
gggaaauaagagagaaaagaagaguaagaagaaauauaagagccaccauggguccguggggcuggaagcuuagauggacagucgcgcuccuccuugcagcagcaggaacugcggucggagaucgaugcgagcgcaacgaguuccaaugccaagaugggaaguguauuucguacaagugggucugcgauggaucagcggaaugucaggacggaagcgaugagagccaagaaacaugccucucagugacaugcaagucgggagacuucucgugcggaggacgcguaaacagauguauuccacaguuuuggcgcugcgauggucagguggacugcgacaacgguucagaugaacagggauguccuccgaaaacgugcucacaagacgaguuucgcugccaugauggaaagugcauuucgcggcaguucguaugugauucggaucgggacugucuggacggcucggacgaagcgucaugcccgguacuuacuugcgggccagccucauuccaaugcaacagcucaacgugcauuccccagcugugggccugugacaaugauccugauugugaggacgguagcgacgaguggccgcagagauguagggguuuguacguauuccaaggagacucaagccccuguuccgccuuugaguuucacugccugucgggugaaugcauccacuccagcuggcgaugugauggugggcccgacugcaaagauaagagcgacgaggagaauugcgcggucgcgacgugcagacccgaugaguuccagugcuccgauggaaacugcauccacgggagccggcagugugaucgcgaguacgauuguaaagacaugucagacgaggucggaugcgugaacgucacguugugcgaggguccgaacaaguuuaagugccauucgggcgaauguauuacgcucgauaaagucugcaacauggcgcgagauuguagggauuggucagacgaacccaucaaggagugcggcacuaacgaguguuuggacaauaacggcggguguucgcacgucugcaaugaucucaaaauuggguaugagugugauuguccugacggauuccagcuggucgcgcagcgcagaugcgaggacaucgacgagugccaggaccccgacacauguucgcaguugugugucaaccuugaaggaggguacaagugccagugcgaggagggauuucagcuugacccgcacacgaaagcauguaaagcggugggguccauugcguauuuguuuuucacaaacagacaugaagugcggaagaugacccuugaucgcagcgaauauacgucacugaucccuaaucuuaggaaugucguggcccuugacacggagguagcaucaaauagaaucuacugguccgaccucucacagagaaugaucuguucaacacaguuggaucgggcgcacggggugucgucguacgauacgguaauuagccgcgacauccaggcgccagacggacucgcggucgacuggauccauagcaacaucuacuggacagacuccguguugggaaccguauccguagcugacacaaagggagugaagcggaaaacucuuuuuagagagaacggcagcaaaccgagagcaaucguggucgauccggugcauggauucauguauuggaccgauuggggaacgccagccaaaaucaagaaaggcgguuugaauggggucgacaucuacucgcuggugacugagaauauucaguggccaaacgggaucaccuuggacuuguugucggggagguuguauuggguggacucaaagcuccacucgaucagcucgaucgacgugaacggcggaaauaggaaaacuauucucgaagaugagaaaagacuggcccaccccuucucgcucgcgguguucgaggacaaaguauuuuggacagacaucaucaacgaagcgaucuuuucagccaaccgccugacagggucggaugucaaucucuuggccgaaaaccuucugagcccggaagauauggucuuguuucacaauuugacccaacccagaggugugaauuggugcgaacggacgacauugucgaacggagguugccaguaucucugucucccugcaccccagauuaauccccauucacccaaguucacgugugcgugcccagacggaaugcuucuugcgagggacaugagauccugucucaccgaagcggaagcggcaguggccacacaagagacuucgacuguccgccuuaaaguguccucgacggcgguccgaacucagcauacgaccacacgacccgugcccgauaccucgcgguugcccggagcaacaccgggguugacgacaguagaaaucguaaccaugagccaccaggcacuuggagaugucgcaggcagaggcaaugagaagaaacccagcucggucagagcccucagcaucgugcugccuauugugcugcuuguguuucucuguuuggguguguucuuguuguggaagaacuggcgccuuaagaauaucaacucgauuaacuucgauaauccgguauaccagcgcaccacagaggaugaagugcauauugcccacaaccaagauggcuauucguacccguccaggcaaaugguaucacuugaggacgacguggccugauaauaggcuggagccucgguggccaugcuucuugccccuugggccuccccccagccccuccuccccuuccugcacccguacccccguggucuuugaauaaagucugagugggcggcucuaga

SEQ ID NO: 737 - RNA, 2752 nt, Artificial Sequence
  Description of Artificial Sequence: Synthetic Transcript Sequence
gggaaauaagagagaaaagaagaguaagaagaaauauaagagccaccauggguccguggggcuggaagcuuagauggacagucgcgcuccuccuugcagcagcaggaacugcggucggagaucgaugcgagcgcaacgaguuccaaugccaagaugggaaguguauuucguacaagugggucugcgauggaucagcggaaugucaggacggaagcgaugagagccaagaaacaugccucucagugacaugcaagucgggagacuucucgugcggaggacgcguaaacagauguauuccacaguuuuggcgcugcgauggucagguggacugcgacaacgguucagaugaacagggauguccuccgaaaacgugcucacaagacgaguuucgcugccaugauggaaagugcauuucgcggcaguucguaugugauucggaucgggacugucuggacggcucggacgaagcgucaugcccgguacuuacuugcgggccagccucauuccaaugcaacagcucaacgugcauuccccagcugugggccugugacaaugauccugauugugaggacgguagcgacgaguggccgcagagauguagggguuuguacguauuccaaggagacucaagccccuguuccgccuuugaguuucacugccugucgggugaaugcauccacuccagcuggcgaugugauggugggcccgacugcaaagauaagagcgacgaggagaauugcgcggucgcgacgugcagacccgaugaguuccagugcuccgauggaaacugcauccacgggagccggcagugugaucgcgaguacgauuguaaagacaugucagacgaggucggaugcgugaacgucacguugugcgaggguccgaacaaguuuaagugccauucgggcgaauguauuacgcucgauaaagucugcaacauggcgcgagauuguagggauuggucagacgaacccaucaaggagugcggcacuaacgaguguuuggacaauaacggcggguguucgcacgucugcaaugaucucaaaauuggguaugagugucuguguccugacggauuccagcuggucgcgcagcgcagaugcgaggacaucgacgagugccaggaccccgacacauguucgcaguugugugucaaccuugaaggaggguacaagugccagugcgaggagggauuucagcuugacccgcacacgaaagcauguaaagcggugggguccauugcguauuuguuuuucacaaacagacaugaagugcggaagaugacccuugaucgcagcgaauauacgucacugaucccuaaucuuaggaaugucguggcccuugacacggagguagcaucaaauagaaucuacugguccgaccucucacagagaaugaucuguucaacacaguuggaucgggcgcacggggugucgucguacgauacgguaauuagccgcgacauccaggcgccagacggacucgcggucgacuggauccauagcaacaucuacuggacagacuccguguugggaaccguauccguagcugacacaaagggagugaagcggaaaacucuuuuuagagagaacggcagcaaaccgagagcaaucguggucgauccggugcauggauucauguauuggaccgauuggggaacgccagccaaaaucaagaaaggcgguuugaauggggucgacaucuacucgcuggugacugagaauauucaguggccaaacgggaucaccuuggacuuguugucggggagguuguauuggguggacucaaagcuccacucgaucagcucgaucgacgugaacggcggaaauaggaaaacuauucucgaagaugagaaaagacuggcccaccccuucucgcucgcgguguucgaggacaaaguauuuuggacagacaucaucaacgaagcgaucuuuucagccaaccgccugacagggucggaugucaaucucuuggccgaaaaccuucugagcccggaagauauggucuuguuucacaauuugacccaacccagaggugugaauuggugcgaacggacgacauugucgaacggagguugccaguaucucugucucccugcaccccagauuaauccccauucacccaaguucacgugugcgugcccagacggaaugcuucuugcgagggacaugagauccugucucaccgaagcggaagcggcaguggccacacaagagacuucgacuguccgccuuaaaguguccucgacggcgguccgaacucagcauacgaccacacgacccgugcccgauaccucgcgguugcccggagcaacaccgggguugacgacaguagaaaucguaaccaugagccaccaggcacuuggagaugucgcaggcagaggcaaugagaagaaacccagcucggucagagcccucagcaucgugcugccuauugugcugcuuguguuucucuguuuggguguguucuuguuguggaagaacuggcgccuuaagaauaucaacucgauuaacuucgauaauccgguauaccagcggaccacagaggaugaagugcauauugcacacaaccaagauggcuauucguacccguccaggcaaaugguaucacuugaggacgacguggccugauaauaggcuggagccucgguggccaugcuucuugccccuugggccuccccccagccccuccuccccuuccugcacccguacccccguggucuuugaauaaagucugagugggcggcucuaga

SEQ ID NO: 738 - RNA, 2726 nt, Artificial Sequence; identical to SEQ ID NO: 63
  Description of Artificial Sequence: Synthetic Transcript Sequence

SEQ ID NO: 739 - RNA, 758 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugaagcgcugccuucugcggggcuugccuucuggccaugcccuucuucucucccuugcaccuguaccucuuggucuuugaauaaagccugaguaggaag

SEQ ID NO: 740 - RNA, 1805 nt, Artificial Sequence
  Description of Artificial Sequence: Synthetic Transcript Sequence
gggaaauaagagagaaaagaagaguaagaagaaauauaagagccaccauggcggucgagucgcaagguggacggccucuugugcuugguuugcuccuuuguguacucggcccugucgugucacacgccgggaagauuuuguugauccccguggacggaucacauuggcuuucgaugcucggagccauccagcaguugcagcaaagggggcaugagauugugguccuggcuccggacgcgucgcucuacauucgcgauggugcauucuauacucuuaagacauauccagugcccuuccagcgcgaagaugucaaagagucauuugucucacugggacacaacguauucgagaacgacuccuucuugcagagagucaucaagacguacaagaaaaucaaaaaggauagcgccaugcuguugucagggugcucgcacuugcuucacaacaaggagcugauggcgucacuggcggagucgagcuuugaugucauguugacggacccguuuuugccguguagcccgaucguggcgcaauacuugucccuucccaccguauucuuccuccacgcgcuucccuguagccuggaguuugaggcgacccagugucccaaucccuuuucauacgugccucgaccguugucaucacauucggaccacaugacguuccuccagcgggugaagaauaugcucaucgccuuuucccaaaacuuccucugcgacgucgucuacuccccuuacgccacgcuggcauccgaguuucugcagcgagaggugacugugcaagaccuucucucgucggcaucaguaugguuguuccgaucagauuucguaaaggacuacccaagacccaucaugcccaacaugguguucguagggggaaucaauugccuccaccagaauccgcugagccaggaguuugaagcguauaucaacgcgucgggggaacacggaauugucguguuuagccuggggucgaugguaucggagauucccgaaaagaaggcgauggcaaucgcagacgcacucggaaagaucccccagacaguccuuuggcgguauacagggacgaggccgagcaauuuggcaaacaauacgauccuugugaaaugguugccgcagaaugaucuucucggucaucccaugacaagagccuucaucacgcacgccgguucgcaugggguauaugaaucgauuugcaauggcgugccuauggugaugaugccgcucuuuggugaccagauggacaaugcgaaaaggauggaaaccaagggagcaggagucacccugaaugugcuggaaaugacauccgaggaucucgaaaacgcgcuuaaagcggucauuaacgacaaaucguauaaggaaaacaucaugagguugagcucccuucacaaagauagaccugucgagccauuggaccuggccguguuuugggucgaguucgugaugcggcacaagggagcgccacacuugaggccagcugcgcaugaucugacgugguaucaguaccacucccucgaugugauuggcuuccugcuggcagucguguugacuguggcguuuaucacauucaaauguugcgcuuacggcuaccggaagugcuugggaaagaaaggacgcgugaaaaaggcccauaagucgaaaacacauugauaagcugccuucugcggggcuugccuucuggccaugcccuucuucucucccuugcaccuguaccucucaaacaccauugucacaaacaccauugucacaaacaccauugucacaaacaccauugucauggucuuugaauaaagccugaguaggaag

SEQ ID NO: 741 - RNA, 1796 nt, Artificial Sequence
  Description of Artificial Sequence: Synthetic Transcript Sequence
gggaaauaagagagaaaagaagaguaagaagaaauauaagagccaccauggaagaugcgaagaacaucaagaagggaccugccccguuuuacccuuuggaggacgguacagcaggagaacagcuccacaaggcgaugaaacgcuacgcccugguccccggaacgauugcguuuaccgaugcacauauugagguagacaucacauacgcagaauacuucgaaaugucggugaggcuggcggaagcgaugaagagauauggucuuaacacuaaucaccgcaucgugguguguucggagaacucauugcaguuuuucaugccgguccuuggagcacuuuucaucggggucgcagucgcgccagcgaacgacaucuacaaugagcgggaacucuugaauagcaugggaaucucccagccgacggucguguuugucuccaaaaaggggcugcagaaaauccucaacgugcagaagaagcuccccauuauucaaaagaucaucauuauggauagcaagacagauuaccaaggguuccagucgauguauaccuuugugacaucgcauuugccgccaggguuuaacgaguaugacuucguccccgagucauuugacagagauaaaaccaucgcgcugauuaugaauuccucggguagcaccgguuugccaaaggggguggcguugccccaccgcacugcuugugugcgguucucgcacgcuagggauccuaucuuugguaaucagaucauucccgacacagcaauccuguccgugguaccuuuucaucacgguuuuggcauguucacgacucucggcuauuugauuugcgguuucagggucguacuuauguaucgguucgaggaagaacuguuuuugagauccuugcaagauuacaagauccagucggcccuccuugugccaacgcuuuucucauucuuugcgaaaucgacacuuauugauaaguaugaccuuuccaaucugcaugagauugccucagggggagcgccgcuuagcaaggaagucggggaggcaguggccaagcgcuuccaccuucccggaauucggcagggauacgggcucacggagacaacauccgcgauccuuaucacgcccgagggugacgauaagccgggagccgucggaaaagugguccccuucuuugaagccaaggucguagaccucgacacgggaaaaacccucggagugaaccagaggggcgagcucugcgugagagggccgaugaucaugucagguuacgugaauaacccugaagcgacgaaugcgcugaucgacaaggaugggugguugcauucgggagacauugccuauugggaugaggaugagcacuucuuuaucguagaucgacuuaagagcuugaucaaauacaaaggcuaucagguagcgccugccgagcucgagucaauccugcuccagcaccccaacauuuucgacgccggaguggccggguugcccgaugacgacgcgggugagcugccagcggccgugguaguccucgaacaugggaaaacaaugaccgaaaaggagaucguggacuacguagcaucacaagugacgacugcgaagaaacugaggggagggguagucuuuguggacgaggucccgaaaggcuugacugggaagcuugacgcucgcaaaauccgggaaauccugauuaaggcaaagaaaggcgggaaaaucgcugucugauaagcugccuucugcggggcuugccuucuggccaugcccuucuucucucccuugcaccuguaccucuuggucuuugaauaaagccugaguaggaag

SEQ ID NO: 742 - RNA, 2752 nt, Artificial Sequence
  Description of Artificial Sequence: Synthetic Transcript Sequence
gggaaauaagagagaaaagaagaguaagaagaaauauaagagccaccaugagcaccgcggaucugaugcgucgcugggucaucgcccugcuccuggcugcugccggaguugcagcagaagacucaugcagcaggaacgaguuccaguguagagacggaaaaugcaucgcuagcaagugggugugcgauggcagccccgagugcccggauggcuccgaugaguccccagagacaugcaugucugucaccugucaguccaaucaauucagcuguggaggccgugucagccgaugcauuccugacuccuggagaugugauggacagguagacugugaaaaugacucagacgaacaaggcuguccccccaagacgugcucccaggaugacuuccgaugccaggauggcaagugcaucuccccgcaguuugugugugauggagaccgagauugccuagauggcucugaugaggcccacugccaggccaccacuuguggccccgcccacuuccgcugcaacucauccauaugcauccccagucuuugggccugcgacggggaugucgacuguguugacggcuccgaugaguggccacagaacugccagggccgagacacggccuccaaaggcguuagcagccccugcuccucccuggaguuccacugugguagcagugaguguauccaucgcagcugggucugugacggcgaggcagacugcaaggacaagucagaugaggagcacugcgcgguggccaccugccgaccugaugaauuccagugugcagauggcuccugcauucacgguagccgccagugugaccgugaacaugacugcaaggacaugagcgacgagcucggcugcgucaaugugacacagugugauggccccaacaaguucaagugucacaguggggagugcaucagcuuggacaaggugugcgacuccgcccgcgacugccaggacuggucggaugagcccaucaaggagugcaagaccaacgaguguuuggacaacaaugguggcuguucccacaucugcaaggaccucaagauuggcucugagugccugugucccagcggcuuccgguugguggaccuccacaggugugaagauauugacgagugucaggagccagacaccugcagccagcucugugugaaccuggaaggcagcuacaagugugagugccaggccggcuuccacauggacccacacaccagggucugcaaggcugugggcuccauaggcuaucugcucuucaccaaccgccacgagguccggaagaugacccuggaccgcagcgaguacaccagucugcuccccaaccugaagaaugugguggcucucgacacggaggugaccaacaauagaaucuacugguccgaccugucccaaaaaaagaucuacagcgcccugauggaccaggccccuaacuuguccuacgacaccaucaucagugaggaccugcaugccccugacgggcuggcgguagacuggauccaccgcaacaucuacuggacagauucagucccaggcagcguaucuguggcugacaccaagggcguaaagaggaggacacuguuccaagaggcaggguccagacccagagccaucguaguggacccugugcauggcuucauguacuggacagauuggggaacacccgccaagaucaagaaaggggguuugaaugguguggacauccacucacuggugaccgaaaacauccaguggccaaauggcaucacacuagaucuuuccaguggccgucucuauuggguugauuccaaacuccacucuaucuccagcaucgaugucaaugggggcaaucggaaaaccauuuuggaggaugagaaccggcuggcccaccccuucuccuuggccaucuaugaggacaaaguguauuggacagaugucauaaacgaagccauuuucagugccaaucgacucacggguucagaugugaauuugguggcugaaaaccucuuguccccggaggacauuguccuguuccacaaggucacacagccuagaggggugaacuggugugagacaacagcccuccuccccaauggugguugccaguaccugugccugcccgccccacagaucgguccccacucgcccaaauucaccugcgccugcccugauggcaugcugcuggccaaggacaugcggagcugccucacagaagucgacacuguacugaccacccaggggacauccgccguccggccuguggucaccgcaucagcuaccaggccaccgaagcacagugaggaucucucagcucccaguacuccuaggcagccuguggacaccccagggcucagcacaguggcgucagugacagugucccaccaaguccagggugacauggcuggcagagggaaugaggagcagccacaugguaugagguuccuguccaucuucuucccuauugcacugguugcccuccuuguccuuggggccguccugcuguggaggaacuggcggcugaagaacaucaacagcauaaacuuugacaacccagucuaccagaagaccacagaggacgagcuccacauuugccgaagccaggauggcuauaccuaccccucaagacagauggucagccuggaggacgauguggcaugauaauaggcuggagccucgguggccaugcuucuugccccuugggccuccccccagccccuccuccccuuccugcacccguacccccguggucuuugaauaaagucugagugggcggc

SEQ ID NO: 743 - RNA, 1507 nt, Artificial Sequence
  Description of Artificial Sequence: Synthetic Transcript Sequence
gggaaauaagagagaaaagaagaguaagaagaaauauaagagccaccaugcucuguuacgugacuagacccgaugcugugcucauggaaguggaagucgaagccaaggccaacggagaggacugccucaaccaagucugccgccgccuggggaucauugaagucgacuacuucggacugcaguuuaccggguccaagggcgaaagcuuguggcucaaucugaggaacagaaucagccagcagauggauggccuggcgccuuaucggcucaagcugagagugaaauucuucgucgaaccgcaccugauuuugcaagagcagacucgacacaucuucuuccuucauaucaaggagagccugcuugcgggacaucuucaguguucgccggaacaggcggucgagcuguccgcccugcuggcccagacuaaguucggcgacuacaaucagaacacggcucaguacagcuacgaggaccugugcgagaaggagcuguccuccucgacccugaacuccaucguggcaaagcacaaggagcuggaaggcaucucgcaagccucagccgaauaccaagugcugcagaucgugucggccauggaaaacuacggcauugaguggcacgccgugcgggacucagaaggucaaaagcuccugaucggagugggcccugaaggaaucuccaucugcaaagaggacuucucgcccaucaaccgcauugcauacccgguggugcaaauggccacccaguccggaaagaacguguaccugaccgugacaaaggaauccgggaacagcaucgugcugcuguuuaagaugaucucgacccgggccgcuucugggcuguaccgggccaucacugaaacccaugcguucuaucgcugcgacaccgucaccuccgccgugaugaugcaguacagcagagaucugaagggccaccucgcaucccuguuccugaacgagaacauuaaccucggaaagaaauacguguucgacauuaagcggaccucaaaggagguguacgaucacgcgcggagggccuuguacaacgccggagucguggaccuggugucccgcuccgaccaguccccuccaucgagcccccugaaguccuccgauuccucgaugucaugcagcuccugcgaggguuugagcugucagcagacccgggugcugcaggagaagcugaggaagcugaaggaggcuaugcucugcauggccuguugcgaggaggaaaucaauuccaccuucugcccuugcggucauaccgugugcugcgaaagcugcgccgcccagcuccaguccuguccggucugccggucccgcguggaacacgugcagcacguguacuugcccacccacacuucacugcucaaccuuacugugauuugauaauaggcuggagccucgguggccaugcuucuugccccuugggccuccccccagccccuccuccccuuccugcacccguacccccguggucuuugaauaaagucugagugggcggcucuaga

SEQ ID NO: 744 - protein, 860 aa, Homo sapiens [sequence omitted]

SEQ ID NO: 745 - DNA, 5292 bp, Homo sapiens
ctcttgcagtgaggtgaagacatttgaaaatcaccccactgcaaactcctccccctgctagaaacctcacattgaaatgctgtaaatgacgtgggccccgagtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaacgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggttctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccgacctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaaggggaggggatgtcaggcccagagaagcaagtggctttcaacacacaacagcagatggcaccaacgggaccccctggccctgcctcatccaccaatctctaagccaaacccctaaactcaggagtcaacgtgtttacctcttctatgcaagccttgctagacagccaggttagcctttgccctgtcacccccgaatcatgacccacccagtgtctttcgaggtgggtttgtaccttccttaagccaggaaagggattcatggcgtcggaaatgatctggctgaatccgtggtggcaccgagaccaaactcattcaccaaatgatgccacttcccagaggcagagcctgagtcactggtcacccttaatatttattaagtgcctgagacacccggttaccttggccgtgaggacacgtggcctgcacccaggtgtggctgtcaggacaccagcctggtgcccatcctcccgacccctacccacttccattcccgtggtctccttgcactttctcagttcagagttgtacactgtgtacatttggcatttgtgttattattttgcactgttttctgtcgtgtgtgttgggatgggatcccaggccagggaaagcccgtgtcaatgaatgccggggacagagaggggcaggttgaccgggacttcaaagccgtgatcgtgaatatcgagaactgccattgtcgtctttatgtccgcccacctagtgcttccacttctatgcaaatgcctccaagccattcacttccccaatcttgtcgttgatgggtatgtgtttaaaacatgcacggtgaggccgggcgcagtggctcacgcctgtaatcccagcactttgggaggccgaggcgggtggatcatgaggtcaggagatcgagaccatcctggctaacacgtgaaaccccgtctctactaaaaatacaaaaaattagccgggcgtggtggcgggcacctgtagtcccagctactcgggaggctgaggcaggagaatggtgtgaacccgggaagcggagcttgcagtgagccgagattgcgccactgcagtccgcagtctggcctgggcgacagagcgagactccgtctcaaaaaaaaaaaacaaaaaaaaaccatgcatggtgcatcagcagcccatggcctctggccaggcatggcgaggctgaggtgggaggatggtttgagctcaggcatttgaggctgtcgtgagctatgattatgccactgctttccagcctgggcaacatagtaagaccccatctcttaaaaaatgaatttggccagacacaggtgcctcacgcctgtaatcccagcactttgggaggctgagctggatcacttgagttcaggagttggagaccaggcctgagcaacaaagcgagatcccatctctacaaaaaccaaaaagttaaaaatcagctgggtacggtggcacgtgcctgtgatcccagctacttgggaggctgaggcaggaggatcgcctgagcccaggaggtggaggttgcagtgagccatgatcgagccactgcactccagcctgggcaacagatgaagaccctatttcagaaatacaactataaaaaaataaataaatcctccagtctggatcgtttgacgggacttcaggttctttctgaaatcgccgtgttactgttgcactgatgtccggagagacagtgacagcctccgtcagactcccgcgtgaagatgtcacaagggattggcaattgtccccagggacaaaacactgtgtcccccccagtgcagggaaccgtgataagcctttctggtttcggagcacgtaaatgcgtccctgtacagatagtggggattttttgttatgtttgcactttgtatattggttgaaactgttatcacttatatatatatatatacacacatatatataaaatctatttatttttgcaaaccctggttgctgtatttgttcagtgactattctcggggccctgtgtagggggttattgcctctgaaatgcctcttctttatgtacaaagattatttgcacgaactggactgtgtgcaacgctttttgggagaatgatgtccccgttgtatgtatgagtggcttctgggagatgggtgtcactttttaaaccactgtatagaaggtttttgtagcctgaatgtcttactgtgatcaattaaatttcttaaatgaaccaatttgtctaaaaaaaaaaa

SEQ ID NO: 746 - protein, 862 aa, Mus musculus
MSTADLMRRWVIALLLAAAGVAAEDSCSRNEFQCRDGKCIASKWVCDGSPECPDGSDESPETCMSVTCQSNQFSCGGRVSRCIPDSWRCDGQVDCENDSDEQGCPPKTCSQDDFRCQDGKCISPQFVCDGDRDCLDGSDEAHCQATTCGPAHFRCNSSICIPSLWACDGDVDCVDGSDEWPQNCQGRDTASKGVSSPCSSLEFHCGSSECIHRSWVCDGEADCKDKSDEEHCAVATCRPDEFQCADGSCIHGSRQCDREHDCKDMSDELGCVNVTQCDGPNKFKCHSGECISLDKVCDSARDCQDWSDEPIKECKTNECLDNNGGCSHICKDLKIGSECLCPSGFRLVDLHRCEDIDECQEPDTCSQLCVNLEGSYKCECQAGFHMDPHTRVCKAVGSIGYLLFTNRHEVRKMTLDRSEYTSLLPNLKNVVALDTEVTNNRIYWSDLSQKKIYSALMDQAPNLSYDTIISEDLHAPDGLAVDWIHRNIYWTDSVPGSVSVADTKGVKRRTLFQEAGSRPRAIVVDPVHGFMYWTDWGTPAKIKKGGLNGVDIHSLVTENIQWPNGITLDLSSGRLYWVDSKLHSISSIDVNGGNRKTILEDENRLAHPFSLAIYEDKVYWTDVINEAIFSANRLTGSDVNLVAENLLSPEDIVLFHKVTQPRGVNWCETTALLPNGGCQYLCLPAPQIGPHSPKFTCACPDGMLLAKDMRSCLTEVDTVLTTQGTSAVRPVVTASATRPPKHSEDLSAPSTPRQPVDTPGLSTVASVTVSHQVQGDMAGRGNEEQPHGMRFLSIFFPIALVALLVLGAVLLWRNWRLKNINSINFDNPVYQKTTEDELHICRSQDGYTYPSRQMVSLEDDVA

SEQ ID NO: 747 - DNA, 4549 bp, Mus musculus
gcagactcctcccccgcctggaaacctcgcccctagtactgggaatgactctgggcgtgcggcgtagtttgcagccgggacaccgtgaggcttgcgagcccagattcgcagccgagacaccgtggggcccgcgatccagtgtttgcagcgggaacatttcggggtctgtgatccgagtgaggacgcaacgcagaagctaaggatgagcaccgcggatctgatgcgtcgctgggtcatcgccctgctcctggctgctgccggagttgcagcagaagactcatgcagcaggaacgagttccagtgtagagacggaaaatgcatcgctagcaagtgggtgtgcgatggcagccccgagtgcccggatggctccgatgagtccccagagacatgcatgtctgtcacctgtcagtccaatcaattcagctgtggaggccgtgtcagccgatgcattcctgactcctggagatgtgatggacaggtagactgtgaaaatgactcagacgaacaaggctgtccccccaagacgtgctcccaggatgacttccgatgccaggatggcaagtgcatctccccgcagtttgtgtgtgatggagaccgagattgcctagatggctctgatgaggcccactgccaggccaccacttgtggccccgcccacttccgctgcaactcatccatatgcatccccagtctttgggcctgcgacggggatgtcgactgtgttgacggctccgatgagtggccacagaactgccagggccgagacacggcctccaaaggcgttagcagcccctgctcctccctggagttccactgtggtagcagtgagtgtatccatcgcagctgggtctgtgacggcgaggcagactgcaaggacaagtcagatgaggagcactgcgcggtggccacctgccgacctgatgaattccagtgtgcagatggctcctgcattcacggtagccgccagtgtgaccgtgaacatgactgcaaggacatgagcgacgagctcggctgcgtcaatgtgacacagtgtgatggccccaacaagttcaagtgtcacagtggggagtgcatcagcttggacaaggtgtgcgactccgcccgcgactgccaggactggtcggatgagcccatcaaggagtgcaagaccaacgagtgtttggacaacaatggtggctgttcccacatctgcaaggacctcaagattggctctgagtgcctgtgtcccagcggcttccggttggtggacctccacaggtgtgaagatattgacgagtgtcaggagccagacacctgcagccagctctgtgtgaacctggaaggcagctacaagtgtgagtgccaggccggcttccacatggacccacacaccagggtctgcaaggctgtgggctccataggctatctgctcttcaccaaccgccacgaggtccggaagatgaccctggaccgcagcgagtacaccagtctgctccccaacctgaagaatgtggtggctctcgacacggaggtgaccaacaatagaatctactggtccgacctgtcccaaaaaaagatctacagcgccctgatggaccaggcccctaacttgtcctacgacaccatcatcagtgaggacctgcatgcccctgacgggctggcggtagactggatccaccgcaacatctactggacagattcagtcccaggcagcgtatctgtggctgacaccaagggcgtaaagaggaggacactgttccaagaggcagggtccagacccagagccatcgtagtggaccctgtgcatggcttcatgtactggacagattggggaacacccgccaagatcaagaaagggggtttgaatggtgtggacatccactcactggtgaccgaaaacatccagtggccaaatggcatcacactagatctttccagtggccgtctctattgggttgattccaaactccactctatctccagcatcgatgtcaatgggggcaatcggaaaaccattttggaggatgagaaccggctggcccaccccttctccttggccatctatgaggacaaagtgtattggacagatgtcataaacgaagccattttcagtgccaatcgactcacgggttcagatgtgaatttggtggctgaaaacctcttgtccccggaggacattgtcctgttccacaaggtcacacagcctagaggggtgaactggtgtgagacaacagccctcctccccaatggtggttgccagtacctgtgcctgcccgccccacagatcggtccccactcgcccaaattcacctgcgcctgccctgatggcatgctgctggccaaggacatgcggagctgcctcacagaagtcgacactgtactgaccacccaggggacatccgccgtccggcctgtggtcaccgcatcagctaccaggccaccgaagcacagtgaggatctctcagctcccagtactcctaggcagcctgtggacaccccagggctcagcacagtggcgtcagtgacagtgtcccaccaagtccagggtgacatggctggcagagggaatgaggagcagccacatggtatgaggttcctgtccatcttcttccctattgcactggttgccctccttgtccttggggccgtcctgctgtggaggaactggcggctgaagaacatcaacagcataaactttgacaacccagtctaccagaagaccacagaggacgagctccacatttgccgaagccaggatggctatacctacccctcaagacagatggtcagcctggaggacgatgtggcatgagcagccgggagagccgtctctttccgggatccattgccaagcttaggcagaaaagacactctctccagacctccccatccagcactggtcctgccacctccctgggctctgtgttgctcaaagcaagataagagcaaagctgggctgggggccaagctcagctgcctgtctgccccaggttctgttttatatatttattgtctggggacagaaaaggctactggctgtgcttgaaattcgaattctgcctgggaatttttttttttctcccatcttcatttccttggaagccaaataggctgtcccagaagcttctgaattctactcttttcaacactaacacggaggaggaagagacccacccaggcagagagaagcctgctggacatgagacagcaggtactactgaccgggtcctgggtaccatagccagtccctaacctcaggacttcctgcattgaccttcatcccagagccttcctgcctgactctgccgcccccatcagaagccaggaaagtgactcgtgacattcggtactgatcttgctggatcttgaggccggcagctgccagtgatggatacccgctcatgcctttgccaaaacgtcacccgttcctggagggacaagcccaagtcgccattctcccttaatatttatcaagtgcctgagacaactggttgccttgctcaggagtcctggcctgctcagtgtcctgctgctcaggggtggccggcaggacccctgtcctgtgcccagcccccgagtctccgagtgaggcttgcacttctctctgcgcacttttcccgttctgtgctgggcacccacgtggtccacatttgtactcctaggttgcactgaccctggtgcattggatgggacctcaggccggaagtggccccgaatcattgaccacagaagataattgccaggctccaagcatccattgccttcttcagtactggggggaactcagggcctctgtctggtgtttagttagtctgtttgtttgtttgtttgtttgtttgtttggtggtttctggctctgcacagcagagttgtttagctcctctggtaacgtcatcctctctcacagagacatccagcctgctgaaggggagagatggggcgaggggagggatacacgcatggtttctcaggtgtggtggcacttggctttaatcctatgctcaagaggaagaggtgggcacatgtctgaggtccaagcctacatagtgagaccttatatatctaaaaaccaaaagaaatcccagactatttggtgggacttggaagaatacttagaaattgccacagatttgtcacatgggtaacctaagaagacagtggtggccttacttggattcctgggtagatccacctgtccactactcaagacacaagggcacactgcccagcccactgggacacttgtaaagagctctgtaatgtgccgatggcacctggctcggttttcattctgtatattcaaggatatcacacatatgtattaaatctatttatttttgcaaaccctgattgctgcacctctctgcaatttctccaggttaggctggggtgatactctgggatgctctgtatacaaagatgatttgaatgggctgatctcaggcctgtcctgtgcgttgctttgagtgggtgggaactgctttgaaacccttgttcagatgtttttataggctgaaaatatcatactgtgatggattaaattcttttttggaaaaaaaaaaaaaaaaaa

The invention claimed is:

1. A polynucleotide encoding a variant low density lipoprotein receptor (LDLR) wherein the variant LDLR comprises at least one amino acid substitution in the EGF-A domain which corresponds to the sequence of amino acid 314 to amino acid 353 of SEQ ID NO: 43 and at least two amino acid substitutions in the intracellular domain which corresponds to the sequence of amino acid 811 to amino acid 860 of SEQ ID NO: 43, wherein the polynucleotide comprises:
   A. (a) a first region of linked nucleosides encoding a polypeptide comprising the variant LDLR;
   B. (b) a first flanking region located 5' relative to said first region comprising at least one 5' terminal cap;
   C. (c) a second flanking region located 3' relative to said first region comprising a 3' tailing sequence of linked nucleosides; and
   D. wherein said polynucleotide is a mRNA comprising, at least one chemically modified nucleoside; and
   wherein the variant LDLR comprises an amino acid sequence selected from the group consisting of: SEQ ID NO: 50, SEQ ID NO: 51, SEQ ID NO: 52, SEQ ID NO: 53, SEQ ID NO: 724, SEQ ID NO: 725, SEQ ID NO: 726, and SEQ ID NO: 727; and/or the variant LDLR comprises an amino acid substitution in the intracellular domain corresponding to amino acid 816 of SEQ ID NO: 43, amino acid 830 of SEQ ID NO: 43, amino acid 839 of SEQ ID NO: 43, or any combination thereof.

2. The polynucleotide of claim 1, wherein the polypeptide comprises an amino acid sequence selected from the group consisting of SEQ ID NO: 50, SEQ ID NO: 51, SEQ ID NO: 52, SEQ ID NO: 53, SEQ ID NO: 724, SEQ ID NO: 725, SEQ ID NO: 726, and SEQ ID NO: 727.

3. The polynucleotide of claim 1, wherein the polypeptide comprises an amino acid sequence selected from SEQ ID NO: 50 or SEQ ID NO: 52.

4. The polynucleotide of claim 1, wherein the mRNA is fully modified.

5. The polynucleotide of claim 1, wherein the polynucleotide is formulated with a lipid nanoparticle.

6. The polynucleotide of claim 1, wherein the variant LDLR has higher expression and longer half-life than wild-type LDLR.

7. The polynucleotide of claim 1, wherein the amino acid substitution in the intracellular domain corresponds to amino acid 816 of SEQ ID NO: 43, amino acid 830 of SEQ ID NO: 43, amino acid 839 of SEQ ID NO: 43, or any combination thereof.

8. The polynucleotide of claim 7, wherein the amino acid substitutions in the intracellular domain is the combination of K830R and C839A.

9. The polynucleotide of claim 1, wherein the amino acid substitution in the EGF-A domain corresponds to amino acid 316 of SEQ ID NO: 43, 339 of SEQ ID NO: 43, or a combination thereof.

10. The polynucleotide of claim 1, wherein the amino acid substitution in the intracellular domain corresponds to amino acid 816 of SEQ ID NO: 43, amino acid 830 of SEQ ID NO: 43, amino acid 839 of SEQ ID NO: 43, or any combination thereof; and wherein the amino acid substitution in the EGF-A domain corresponds to amino acid 316 of SEQ ID NO: 43, 339 of SEQ ID NO: 43, or a combination thereof.

11. The polynucleotide of claim 10, wherein the amino acid substitution in the EGF-A domain is L339D and the amino acid substitution in the intracellular domain is the combination of K830R and C839A.

12. The polynucleotide of claim 2, wherein the mRNA is fully modified.

13. The polynucleotide of claim 2, wherein the polynucleotide is formulated with a lipid nanoparticle.

* * * * *